United States Patent 11,098,302 (IDENTIFICATION OF POLYNUCLEOTIDES ASSOCIATED WITH A SAMPLE) - sequence listing, part 52

SEQ ID NO: 177553 - DNA, 616 bp, Homo sapiens
  misc_feature: GYAE6OF01CDZNS.33.10.A10.1.454.CMB.1.raw
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctggggggaggcgtggtccagccgtggggggtccctgagactctcctgtgcagcctctggattcaccttcagttactatggcatgcacgtcgggtcccgccgaggcctccgagggcgaaggggctggagtggctatcgagttatatcacatgaatagaaaaataatactagtgacggactccggtagaacgggccgtattcgaagcagttcctaccgaagaacgaactaaacttaccaaagtaaacctacggtttagtaatcgtagaacctaaagtacggaaacggtgtacggacgtaaccgtggaaccgacgaccggtnttggttattactttcgngtaggaactaaagtntttaatacgtattagttatttagcttaggttactggtagggtaggggtgtggcgtaggtcggggaccaaggggtacccttgggtacctagtccgttctcccgtagaccgtccctacccgaaccgg

SEQ ID NO: 177554 - DNA, 683 bp, Homo sapiens
  misc_feature: GYAE6OF01EGHOR.33.10.A10.1.454.CMB.1.raw
tcagtacacacactcacgaccggtgctcgatttagcgtcgatctcagggtcttcgtggctcacgtccaccaccaagcatgtgacctcaggggtccgggagatcatgagggtgtccagtgtcaggtgcatctggtggagtcgtgggggaggcgtggtccagccgtggggggtccctgagactctcctgtgcagcctctggattcaccttcacgttactatgcactgcgccgtcggtccgccgacggcgtaccgacggcggacgggcgtcggtagtacggtcgtacgtactacgttaactatacaacgtagaaagtaagtaaatacgtaaaacgttaacgtccgtacgtacggtacggtacggtaccggtacggccgttacgtaacgtaccgaacgtactacgtacgtaacgtaacgaacgtcctaacgtaacgtaacgtacgtactacgtcgtacgtacgtacgtacgtacgtacgtacgtaacgtacgtacgacgtctacgtacgtacgtacgtcgtcgtaagttagtacgttaacgtaagtagtagttattacgtagttacgtacgttacggtacgggttcggttacgggtacgggtacggtacggggtaccggtacgggtacccgggtaccgggtacggtaccgtaccggttaccgtaccgttccgtaccgtcccgtcccg

SEQ ID NO: 177555 - DNA, 607 bp, Homo sapiens
  misc_feature: GYAE6OF01BUQNA.33.10.A10.1.454.CMB.1.raw
  modified_base (336)..(336): a, c, t, g, unknown or other
  misc_feature (336)..(336): n is a, c, g, or t
tcagtacacacactcacgaccggtgctcgatttagcgtcgatctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgatagaaaataaatactatgcgactccgtagaaggccattcagcatctccagagacaattccaaagaactacgttagtatctagacaaatgaaacggtntagagacctgacgacacggctgtgtatttctgtagacgtaaagtattaattacgatagtatttagacttggttactcgtggtaggggttgtgggcgtacggtggggaccgaacgggtacccgtgggtctacgttccggttaccttccctacgacgtccctaccgaacccgaaccgggtccctaacgtcccggttcccttaccccccgtcgggacccctaccccttacccgtacccgaaacgtaccgccctaacccggtcggtaccgggggg

SEQ ID NO: 177556 - DNA, 562 bp, Homo sapiens
  misc_feature: GYAE6OF01B70TE.33.10.A10.1.454.CMB.1.raw
  modified_base (233)..(233): a, c, t, g, unknown or other
  misc_feature (233)..(233): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccncaggctccaggcaaggggctggagtggctatcagttatatcacatgaatagaaaaataatactatgacggactccgtagaagggccattcagcatctccagagaacaattaccaaagaactacgttgtaactctagacaaagtgaacggtgtagacgacctgaacgacgacggntgtntatttcngtagacgaaagtatttatacgatagtatttgacttggttactcgtaggaggggtgtgggccgtacggtcggggaccgtaaggggtaccccttgggtacctagttccgtccttcccgtacgaccgtccccgtacccgaaacccgg

SEQ ID NO: 177557 - DNA, 251 bp, Homo sapiens
  misc_feature: GYAE6OF01CJ4XU.33.10.A10.1.454.CMB.1.raw
  modified_base (246)..(251): a, c, t, g, unknown or other
  misc_feature (246)..(251): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccagtgtgtgtactgagcgggctggcaaggcgcatagnnnnnn

SEQ ID NO: 177558 - DNA, 533 bp, Homo sapiens
  misc_feature: GYAE6OF01C5KW0.33.10.A10.1.454.CMB.1.raw
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (519)..(519): a, c, t, g, unknown or other
  misc_feature (519)..(519): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagcctggggggtccctgagactctcctgtgcagcctccggattcaccttcagttactatggcatgcacgtgggtccgccaggcctccgaggcgaaggggctggagtggctatcagttatatcacatgatagaaaataaatactatgcgactcgtgaaggcgatcagcatcncaganacaattccaanacacgttgtatctagacaaatgaacggtgtagacgacctgaacgacacggcttagtagttatttcgtgtagacgtaaatatttatagatgtatttgacttggttactgttggagggtgtcggcgacgtcgggaccgacgggtacctggtccagttccgtctcctacacgtcccncgaccgtaaccggg

SEQ ID NO: 177559 - DNA, 749 bp, Homo sapiens
  misc_feature: GYAE6OF01CU3C6.33.10.A10.1.454.CMB.1.raw
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcacgtgggtccgccaggcctccgaggcgaaggggctggagtggctatctagttatatcacatgataagaaaattaaatactaatggacggtactccggtaggaacgggaccgtattccgagactactcctaccgaaggaacgtaactaaacgttaccgaaacgtaaaccgtacggtttagtaacgtacgtagaaccgtaaagtacggtaacggtggtagaacgacgtacggaaccggaacgtaccgggtcttaggttacgttatttcggtaggtacggaacgtaaaagtttattaagttaacgtagttagtttacgtttacggtaacgtttacggtttacgtacggttaggggtaggggttggttcgggaccggtacgggtacggggtaccggaaccgggtaccgttgtacgtacgttcccggttcctccgtaccgacccgtcccgtaacccgacccggtacggacccccgttggtccccgttcccctaccccggcgtaccccctaccgtcccgtacgaacgccggtacccttaccggcgggttaacgggccctacggaccgggcccgtaccggtcggactcggcccggtggacccggtaacg

SEQ ID NO: 177560 - DNA, 721 bp, Homo sapiens
  misc_feature: GYAE6OF01B6FEH.33.10.A10.1.454.CMB.1.raw
  modified_base (235)..(235): a, c, t, g, unknown or other
  misc_feature (235)..(235): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctcctgtgcagcctctggattcaccttcagttactatggcatgcacgtgggtccnccaggcctccgaggcgaaggggctggagtggctatcagttatatcacatgatagaaaataatactatggacggactccggtaggaacgggcctattcgagctactcctaccaaggaacgtaacctaaacgtttacccgaaagtaaaccgtacggtttacgttaactacgttacgaaactaaacgttgggtaaaccgggttggtacgaacggtaacctacgggaaccgaaccgtacgggtcctttggtacgtttacgttttcgtaggtacgaacggtaaaagttagttttaacgtaacggtagtttaggttacgttttaggaccgtttagggttttaaccttcggttaggggtaggggttcggtacgggtacccggtaacggggttccgggggacccgtaaagggggtacccccgttgggttaccctacggttcccgttacccgttccccgtaccggaacccgtcccccgtacccgtaaaccccggg

SEQ ID NO: 177561 - DNA, 537 bp, Homo sapiens
  misc_feature: GYAE6OF01CYOGF.33.10.A10.1.454.CMB.1.raw
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
  modified_base (352)..(352): a, c, t, g, unknown or other
  misc_feature (352)..(352): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccnccaggctccaggcaaggggctggagtggctatcagttanatcacatgatagaaaataatactatgcgactccgtgaagggccattcagcatctccagagacaattccaagaacacgttnatctgacaaatgaacggtgtgagcctgacgacacggtctgtgtatttctgtgacgtaaagtattaagttacgattggtatttgagttggttaacttcgtaggaggggtgtgggctagggtcggggacctaaggggacccttgggacacggttcgttcctccctcgacgtccctcccgaaacccgg

SEQ ID NO: 177562 - DNA, 178 bp, Homo sapiens
  misc_feature: GYAE6OF01AM0CW.33.10.A10.1.454.CMB.1.raw
  modified_base (176)..(178): a, c, t, g, unknown or other
  misc_feature (176)..(178): n is a, c, g, or t
tcagtacacacactcacgaccggtgctcgatttagcgtcgatctcagggtcttccccctggcaccctcctccaagagcacctctgggggcacagcggccctgggctgcctggtcaaggactctggtcaaggactacttccagtgtgtgtactgagcgggctggcaaggcgcatagnnn

SEQ ID NO: 177563 - DNA, 723 bp, Homo sapiens
  misc_feature: GYAE6OF01B1JVS.33.10.A10.1.454.CMB.1.raw
  modified_base (371)..(371): a, c, t, g, unknown or other
  misc_feature (371)..(371): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggagcgtggtccagccgtggggggtccctgagactctcctgtgcagcctctggattcaccttcagttactatggcatgcacgtcggggtccgccaggcctccgagggcgaaggggctggagtggctatcagttatatcacatgaatagaaaataatactatggcgactccggagaagggccattcagcatctacagacgactaacttaccgaaagtaactacgttntactctagactaaagtggaacggtgtagacgtacccgtaggaaccgaaccgacggtcgttaggtttagttacttttccgtaggtacgaaccggtaaaagttattttaacggttaacgtagtttaggttaacttttacgggtaaccgtttttacgggtttaccttcgggttagggggtaggggggtttcgggtacggggtacccgggttaaccggggtaccggggggaccccggttaaacggggggttaacccccgtttgggggtaacccgttaaccggtttccccggtttacccttacccccggttaccgaaccccgggttcccccctaacccccggtaaaacccccggggg

SEQ ID NO: 177564 - DNA, 689 bp, Homo sapiens
  misc_feature: GYAE6OF01BGR15.33.10.A10.1.454.CMB.1.raw
  modified_base (291)..(291): a, c, t, g, unknown or other
  misc_feature (291)..(291): n is a, c, g, or t
  modified_base (359)..(359): a, c, t, g, unknown or other
  misc_feature (359)..(359): n is a, c, g, or t
  modified_base (456)..(456): a, c, t, g, unknown or other
  misc_feature (456)..(456): n is a, c, g, or t
  modified_base (506)..(506): a, c, t, g, unknown or other
  misc_feature (506)..(506): n is a, c, g, or t
  modified_base (543)..(543): a, c, t, g, unknown or other
  misc_feature (543)..(543): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtggggggaggcgtggtccagccgtgggggtccctgagactctcctgtgcagcctctggattccaccttcagttactatggcatcgcacgtggggtccgccaggcctaccgagggcgaaacgggggctggaggttggacctatcagtttanactcaacagtgaataagaaaaattaatactagtgacggtaccttcggtagaacgggtccgtattcgancgatcctaccgaagagaactaataccgaaagtaactacgttgaactgtacgactaaagtcggtaaaggtcgtagacgtaccgtagaacgacgcggtnttacggtgttactttcgtggtacgtaagtaaagttatttaacgtaacgtntttaaggtagttttacggtaccgttaggtttaaccgngggttagggtacgggggttaggtcgggtaacggttaccgggtacggggggtaaccctaccgggggttaaacccgttccgggttactacccggttcccgtaccgttaccccgtaccgacccggtccccgttaacccgaaaccccggg

SEQ ID NO: 177565 - DNA, 729 bp, Homo sapiens
  misc_feature: GYAE6OF01C1II7.33.10.A10.1.454.CMB.1.raw
  modified_base (218)..(218): a, c, t, g, unknown or other
  misc_feature (218)..(218): n is a, c, g, or t
tcagtacacacactcacgaccggtgctcgatttagcgtcgatctcaggggtccctgagactctcctgtgcagcctctggattcaccttcagttactatggcatgcactgggtccgccaggctccaggcgaaggggctggagtggctagtcagttatatcacatgatagaaaataaatactatgcggactccgtgaagggccgattcagcatctcaganaacaatccaaagaactacgttgtactctagacaaaagtcggaacggtgtagaacggacctaggaaccgacgacggtctggttgtttactttcgtggtacgaacgaaaagtatttagtaacgtagtgtagtttacgacgttagggttacttcggtgggtaggggttcggtagggccgacgggttcgggggaccgtaacgggtaacccgttgggtacctacgttccgttcctacccgtacgaccgtacccctacccgtaaccgaaccgggtccccctaacggttccccgggttcccctttcccccgggtacgtacccccgtacccccgttaccccgtaacccgaaacgacccggtacccgtacccggtccggggtaccgggggaccctaaccggaccgggtccccgggtacccggttcgggccgttaccggccggttacgaacggtaacggtaccttacgtcgtacggtgttacgtcgtagtcggacggtccggtcgaggccgagggctaacg

SEQ ID NO: 177566 - DNA, 618 bp, Homo sapiens
  misc_feature: GYAE6OF01DJ88C.33.10.A10.1.454.CMB.1.raw
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
tcagtacacacactcacgaccggtgctcgatttagcgtcgatctcagggtcttcgtggctcacgtccaccaccacgcatgtgacctcagggggtccgggagatcatgagggtgtccagtgtcaggtgcatctggtggagtcgtggggggaggcgtggtccagccgtggggggtccctgagactctcctgtgcagcctctggattcaccttcagttactatggcatgcacgtgggtcccgccgaggcctccgaggcgaagggggctgggaggtggctatcagttatatcacatgaataagaaaaataaatactagtgacggactccgtaggaacgggcctatcagcatctaccgaganacaattaccaaagactagtntaatcgtagactaaagtgaacggttgagacgtacgtagaaccgacgaacggtcttggttatttatttcgtggtagaacgtaaagtactttaagtacgtaattaggttattttgtacgttgtttactggttgggtaggggttgtcggggaccgtagggtccggggaaccggaaccggggttacccggttggtacgtacgtccgttaccctcccgactacccgcccgtaccccgaaacccggg

SEQ ID NO: 177567 - DNA, 781 bp, Homo sapiens
  misc_feature: GYAE6OF01A4DY9.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagcctggggggtccctgagactctcctgtgcagcctctggattcaccttcagttactatggcatgcacgtgggtccgcaggctccgaggcgaaggggctggagtggctatctagttatactcaactatgaatagaaaaataatactagtcgacggtactcggtaggaacgggcctattcgagctagtcctaccgaagaacgtaactaactttacccgaaaacgtaacgtaaccggtttgtaacttccgtagaacctaaaagttcgggtaaacgggttgtaggaacgtaccccgtaggaaccccgaacgtacccggggttcttaggttacgtttaaccttttcgtagggtacgtaaccgggtaaaagttacttttaaaggtttaaccggtatttagggtttaaacgtttttacgggtaaccggtttttacggggttttaacccgttcgggttaggggggttaacgggggggtttcgttaacggggggacccggttaacgggggttcccggggggaaccccggttaacgggggtaaccccccgtttagggggtacccctacgggtttcccgttaaccccgtcccgttaaccgccccggtcccccgttaaccccggaaaccccggg

SEQ ID NO: 177568 - DNA, 555 bp, Homo sapiens
  misc_feature: GYAE6OF01CJ0FP.33.10.A10.1.454.CMB.1.raw
  modified_base (232)..(232): a, c, t, g, unknown or other
  misc_feature (232)..(232): n is a, c, g, or t
  modified_base (349)..(349): a, c, t, g, unknown or other
  misc_feature (349)..(349): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatcacatgatagaaaataatactatgcggactccgngaaggccattcagcatctccagagacaattccaaagactacgttgtatctagcaaagtgaacggtgtagagacctgacgacgacggctggttgttactttcgtgtcgacgaaaagtnttaattacgatgtatttgacttggttactcgtggtagggtgtcgggcgacgtcgggaccgacgggaacccgtggtcacgtcgtcctctcacgcctaccgaccgacgggccctagtccggttcccttccccgtcgaccctccctcctccgaacgcgcctaccgtcgnggggccncgcggcccgcccgtggctgccgtggcctaacgg

SEQ ID NO: 177569 - DNA, 758 bp, Homo sapiens
  misc_feature: GYAE6OF01CPBAG.33.10.A10.1.454.CMB.1.raw
  modified_base (160)..(160): a, c, t, g, unknown or other
  misc_feature (160)..(160): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggacttcaccttcagttactatggcatgcacgtcgggtccnccaggcctccgaggcgaagggggtctagggagtggactatcgtagttatactacatagtagaataagtaaaaaattaatactaagtcggaccggtactccggtaggaacgggtcctaattcagtacctagtcctaccgaaggtaacaacctaacgtaccaaaaggtacctacgtttagtaactcgtagaccgtaaaagttcggaacggtgtaagaccgtaaccgtggaaccgactaccggtgtagttagttacgtttcgaggtacggtaaacgtaaagttactttaaggtaacgtagttagtttaacgttcgtacggttaggttacttgggtagggtaggggttggtacgggtacggtaacgggtccgggtaccggtaacgggtaaccgtggtaccgtacgttccgtaccctacccgtacgtacccgtccctaccgaaccgtaaccggcctaccggttccccgttccccgtacccctccggtacccctacccctacccgtaactaaccggcctaccggtacccgtcgggagggtacccaccggtacggtccccgggacggttcggtacccgtccggtaccgtaggtacccgtaaccgg

SEQ ID NO: 177570 - DNA, 651 bp, Homo sapiens
  misc_feature: GYAE6OF01BL52R.33.10.A10.1.454.CMB.1.raw
  modified_base (349)..(349): a, c, t, g, unknown or other
  misc_feature (349)..(349): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattccaccttcagttactatggcatgcacgtgggtccgccaggctccgaggcgaaggggctgggagtggctatctagttatatcacatgaatagaaaaataatactagtgacggactccggtaggaacgggcctatcagcatctacaganaacaacttaccaaagaactacgtttagtactctagaactaaagtacggtaaacggttgtacggaacgaccgtacggaaccggaacgtacgggctttaggttagttacttttcgaggtacgaacgtaaagttactttaataacggtattagtaagttttacgaacgttttggtttaactgggttagggtagggggttgtacgggtaccggtacgggttcgggggacccgtaagggggtaaccccttggggtaccctaggttcccgttcctacccgtacgaccggtcccctacccgaacccggg

SEQ ID NO: 177571 - DNA, 204 bp, Homo sapiens
  misc_feature: GYAE6OF01EEJW8.33.10.A10.1.454.CMB.1.raw
  modified_base (202)..(204): a, c, t, g, unknown or other
  misc_feature (202)..(204): n is a, c, g, or t
tcagtacacacactcacgaccggtgctcgatttagcgtcgatctcaggggtccgggagatcatgagggtgtccttgggttttgggggaagaggaagactgaccggtcccccaggagttcaggtgctgggcacagcggccctgggctgcctggtcaaggctacttccagtgtgtgtactgagcgggctggcaaggcgcatagnnn

SEQ ID NO: 177572 - DNA, 636 bp, Homo sapiens
  misc_feature: GYAE6OF01BFWH7.33.10.A10.1.454.CMB.1.raw
  modified_base (235)..(235): a, c, t, g, unknown or other
  misc_feature (235)..(235): n is a, c, g, or t
  modified_base (275)..(275): a, c, t, g, unknown or other
  misc_feature (275)..(275): n is a, c, g, or t
  modified_base (536)..(536): a, c, t, g, unknown or other
  misc_feature (536)..(536): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctcctgtgcagcctctggattcaccttcagttactatggcatgcacgtgggtccncaggctcgaggcgaaggggctggagtggctatctagttanatcacatgatagaaaataatactatcgacgactcgtaggaacggccgtattcgagctacgtctaccgagacgaactaactaccaaagaactacgtttagtactacgtgaacaaagtcggtaacggtgtaggtacgaaccgtcggaacgaaccgtacggtattggttacgttactttcgttaggtacgaacggtaaagtatttacgtacgtagttacgttacgtttagtacgtttggttaccttacgggtggtaagggggtntacgggtacggtacggtaccggggaccgtaagggacccggttggtacccgttacgttccgtccgtaccgttaccgacggtccccgttcccgaaacccggg

SEQ ID NO: 177573 - DNA, 640 bp, Homo sapiens
  misc_feature: GYAE6OF01BSENT.33.10.A10.1.454.CMB.1.raw
  modified_base (236)..(236): a, c, t, g, unknown or other
  misc_feature (236)..(236): n is a, c, g, or t
  modified_base (446)..(446): a, c, t, g, unknown or other
  misc_feature (446)..(446): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctcctgtgcagcctctggattcaccttcagttactatggcatgcacgtgggtcccnccaggcctccgaggcgaaggggctgggagtggctatcagttatatcacatgatagaaaaataatactatgacggtactcgtgaacgggccattcagcatctaccgaagacgaactaaatttacccaaaagtaaaccgtacgtttagtaacttctagactaaagtggaacggttgtagaacgtaccgtagaaccgaacgacggtctggttnttatttcgtagtacgaacgtaaagtatttaacttacgattagtaagtttcgtaacgtttaggtttactacggtagggtaggggttggtacgggtccggtaaccgggttcgggggacccgtaacggggtaaccccgttgggtaacctacgttcccgttacgtcccgtacaccggtccccttcccggaaaccccgg

SEQ ID NO: 177574 - DNA, 924 bp, Homo sapiens
  misc_feature: GYAE6OF01CD9PX.33.10.A10.1.454.CMB.1.raw
tcagtacacacactcacgaccggtgctcgatttagcgtcgatctcaggggtccctgagactctcctgtgcagcctctggattcaccttcagttactatggcatgcactgggtccgccaggctccgaggcaaggggctggagtggctatcagttatatcacatgatagaaaataatactatgcggactccgtggaaggccattcagcatctccagagactaattccgaagtactacgttgtactctagactaaaagttcggaaacgggttgtaggaacgtacccgttaggaaccgacgtaccgggtcttggttagtttaacttttccgtggttacggaaccggtaaaaaggttcttttaaagttaccgggtaagtttacggttaaacgttttttcgggaaccgttttacgggttttaaccctcgggttaggggtaaggggggtttgtaccggggtaaccggtaccggggtttacggggggacccctaaacgggggttaacccccttggggttaccctaaggtttccccggttaccctccccgttacgtacccggtaccccgttaccccgtaacccggtaaccccggggtaccccgtaacggtttaccccgggttaccccgtttccccccggttaccggtacccccgtaacccccgttaccccgttacccgaaaccggtacccggtacccgtaacccggttaccgggtaccgggggtaaccaacccgggtaccgggtaccccggggtccccggttaccggggtcccgttaccgggtacccgttaccggggttaacccgtaaaccgggttaaccccgttaaccgttacccggtaacggtttcgggttaccggttcgggtttaaccggtcgggtaaccgggtccggggttaccggtacggggaccggtaacggggtcccggtaaccgg

SEQ ID NO: 177575 - DNA, 1034 bp, Homo sapiens
  misc_feature: GYAE6OF01BT3I7.33.10.A10.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctccgtgcagctctggngtctaccttcctagtacttatgngactgtcacgtcgggtccggccgacggcgtccgacggacggaacggggacggtggtaggtggtcgtacttactacgttattatactaacacgtagtaagtaagtaaaaagttaaaacttaacttaagttacggtaccgggtaaccgttacccggttaacggggtaaacgggggtaacccggtaacggttttaccgaacgtaccgtaacttaccgttaccccgtaacggaaacggtaaaccgtaaacctttaacccggtaaaacgtaaaaccggtaaaccggttttaacggtttaacgttaccgttaacggtaaacctaaaaaccggtttaacggggttaaaccggggttacggggtttaacggtaaaccgggtaaaccccgttacgggtaaacccgggtaaacccgtaaccgggtacgtttaggtttacgggttttaactttttccggttacgggtaacggttaacgggtaaaaacggtttaagtttttaaacggttttaaccgggtaagtttacggttttaaacgtttttagggtttaaacccggttttaccggggtttttaaccgtttacccgggttaggggggtttaacgggggggttacggggtttaccgggggtacccgggggttaaaccggggttacccgggggggtaacccggggtaaaaccccggggggtttaacccccggggttccgggtttacgggttaaaccccgtttcccggtttaccccgttttaaccccccggttcccgttaaacccgggttcccccccgtttaaccccccgggaaaaccccgggttaaacccccggggg

SEQ ID NO: 177576 - DNA, 586 bp, Homo sapiens
  misc_feature: GYAE6OF01BF1E7.33.10.A10.1.454.CMB.1.raw
  modified_base (437)..(437): a, c, t, g, unknown or other
  misc_feature (437)..(437): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtgggggtccctgagactctcctgtgcagcctctggattcaccttcagttactatggcatgcacgtgggtccgccaggctccaggcgaaggggctggagtggctatcagttatatcacatgatagaaaataatactatgacggactccgtagaaggccgattcagcatctaccagagacaattaccaaagaactacgttagtactctagactaaagtggaacggttgtacgacgtacctaggaaccgacgacgggtcttggttagttattttccgnggttacgaacgtaaagttatttaattacgattgtaattttgactttggttacctggttagggaggggttgtcgggtacgtacggtcggggccctaaggggacccttgggtactagttccgttctcccgtgacgtccctcccgaaaccgg

SEQ ID NO: 177577 - DNA, 209 bp, Homo sapiens
  misc_feature: GYAE6OF01CXYZR.33.10.A10.1.454.CMB.1.raw
  modified_base (203)..(209): a, c, t, g, unknown or other
  misc_feature (203)..(209): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccagtgtgtgtactgagcgggctggcaaggcgcatagnnnnnnn

SEQ ID NO: 177578 - DNA, 697 bp, Homo sapiens
  misc_feature: GYAE6OF01COXIG.33.10.A10.1.454.CMB.1.raw
  modified_base (306)..(306): a, c, t, g, unknown or other
  misc_feature (306)..(306): n is a, c, g, or t
  modified_base (381)..(381): a, c, t, g, unknown or other
  misc_feature (381)..(381): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagccgtggggggtccctgagactctcctgtgcagcctctggattcaccttcagttactatggcatgcacgtcgggtccgccaggcctccgagggcgaaggggctggaggtggctatcgagttatatcacatagatagaaaataatactancgacgactcgtaggaggccatcacgcatcctccaagacgaactaattaccgaaagaactacgttgtaactcgtanactaaagtggaacggtgtacggacgtacctagggacccgaacgtaccgggtacgttggttacgtttacgttttcgtacgggttacggtaaccgggttaaaaagttacgtttttaaacggtttaacggtaagtttagggttaagtttttaccggacgttttacggtttaccgtcgggtttaggggacgggggtttgtcgggaccgggtccgggttacgggggacccgtaaccgggggtaacccgttgggttaaccgaccgtttccggtaccccttaccgtacccgtaacccggtcccccgttaaacccgaacccggg

SEQ ID NO: 177579 - DNA, 222 bp, Homo sapiens
  misc_feature: GYAE6OF01BOPLT.33.10.A10.1.454.CMB.1.raw
  modified_base (222)..(222): a, c, t, g, unknown or other
  misc_feature (222)..(222): n is a, c, g, or t
tcagtacacacactcacgaccggtgctcgatttagcgtcgatctcatggtcttcgtggctcacgtccaccaccacgcatgtgacctcagggtccgggagatcatgagggtgtccttgggtttgggggaagaggaagactgacggtccccccaggagttcaggtgctgggcacgagcggccctgggctgcctggtacaaggactacttccgagtgtgtacgtn

SEQ ID NO: 177580 - DNA, 1009 bp, Homo sapiens
  misc_feature: GYAE6OF01D5AVI.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggagcgtggtccaggccgtgggggtccctgagacctctcctgtgcacgtcctcgtggtacttcctacccttctagttactagtcggctagtcgcctacggtccgggtcccgaccgacggtcctaccggaagggaccgggaaacgggggtccgtagggaggtcggacttacgtacgttaaggtttaactacgtacctaacgtaagttaggtaaagttaaaaggtaaaaaaactttaaaacgttaacgttaaggttaccgggtaacccggggtaacccgtttacccgggttaaggggaaacccggggttaccccttaaagtttaccggaacggtacctaacgttaccccgtaacggaaaacggtaaaccgtaaaacccgttaaaacgtttaaaccccgaaaaaacggttaaacccggttaacggttttaacgttaaccgtttaccgtaaacgtaaaacgttaaaacggttaacgggttaaacgggttacggttaacggtaaccccgtaaccggtaaccgggaaacccgtaaccgggtaaccggtttcgtttaagggttttaacgtttacggtttttccggtaagggttaaccggtaaaacggttaaaacgttttaaggtttaacgtttaacggtaagttttaacggtttaaggtttaaccggttaaccgggttttacggttaacccggttggggttacgggggtagggttaccgggttcgggggaacccggggttaccgggtaaccgggggtaacccggtaaaccggggttcccccggttagggtaccccgttacggttcccccgttacccgtacccggtacccgtacccccggtaaccccgtaaacccccgggtaaaccccgggg

SEQ ID NO: 177581 - DNA, 556 bp, Homo sapiens
  misc_feature: GYAE6OF01A37H1.33.10.A10.1.454.CMB.1.raw
  modified_base (233)..(233): a, c, t, g, unknown or other
  misc_feature (233)..(233): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccncaggctccaggcaaggggctggagtggctatcagtttatatcacatgatagaaaataatactatgacgactccgtgaagggccattcagcatctaccagagacaattccgaaagaactacgttagatcngacaaatgaacggtntgacgacctagaacgacgacggctagtagttatttcgtgtagacgtaaagtctttaagttacgattacgtatttagacttaggttactcgtaggtgggtgtcggcgtacggtggggcccgaaggggtacccctggtacctagttccgtcctccgtaccacgtccccgtacgaacccggg

SEQ ID NO: 177582 - DNA, 709 bp, Homo sapiens
  misc_feature: GYAE6OF01EVG7S.33.10.A10.1.454.CMB.1.raw
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
tcagtacacacactcacgaccggtgctcgatttagcgtcgatctcagggtccctgagactctcctgtgcagcctctggattcaccttcagttactatggcatgcactgggtccgccaggctccaggcgaaggggctggagtggctatcagttatatcacatgatagaaaataatactatgcgactcgngaaggcatnagcatctccaganacaatcaagaactagttgtatctagacaaatggaacggtntagacgacctagacgacgtacggcttgtagttagtttcgtaggtcgacgtaaaagtattaacgttacgtataggttatttcgtacgttggtttaacctcggtagggtaggggtcggtcgggtacggtacgggtcggggacccggtaacgggtaccccgttgggtactacgttcccgtacctcccgtaccgaccgtacccctacccgaacccggtaaccgggtcccctacggttcccgttccccgttcccccgtaccggcccctaccccttcccgtaaccgaaacgtcccgtaaccgtacccgtccgggtcgggaacctaccggaccgggcccgggtccgtcggtcgtccggtaccggttacggtaaccggtaaccgggttaaccttacccgttacgtacggttcggtcggttacgtccggtaggcgggtcggtcgtacgggaccgtaagggcctaacgg

SEQ ID NO: 177583 - DNA, 250 bp, Homo sapiens
  misc_feature: GYAE6OF01CHPTE.33.10.A10.1.454.CMB.1.raw
  modified_base (245)..(250): a, c, t, g, unknown or other
  misc_feature (245)..(250): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccagtgtgtgtactgagcggctggcaaggcgcatagnnnnnn

SEQ ID NO: 177584 - DNA, 652 bp, Homo sapiens
  misc_feature: GYAE6OF01BE1NH.33.10.A10.1.454.CMB.1.raw
  modified_base (475)..(475): a, c, t, g, unknown or other
  misc_feature (475)..(475): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggagcgtggtccaggccgtggggggtccctgagactctcctgtgcagcctctggattccaccttcagttactatggctatcgcacgtcgggtcccgccaggcctccgaggcgaacggggctagggagtcggctatcgtaagttatatcactatgaataagaaaattaaactactatacggaccgtaacgtccggtaggaaacgggtccctattaccagacctacgtcctaaccgaaggaactaaactaaacgtttaccgaaagtaactacggtttgtaactcgtaagaactaaagtcggtaacgtggtagaacgacgtgacgacgacgtntgttattctttcgagtacgaacgtaaagttactttaagtaacgtattacgttaagtttacgtacgtttaggtaacttggtagggtaagggttcgtaggccggtaacgggtaggggaccccgtaagggtaccctggtactacgttccgtcctccgacgtccgaccctccggaaaccgg

SEQ ID NO: 177585 - DNA, 694 bp, Homo sapiens
  misc_feature: GYAE6OF01ENPX7.33.10.A10.1.454.CMB.1.raw
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtggggggagcgtggtccagccgtggggggtccctgagactctcctgtgcagcctctggattcaccttcagttactatggctatgctacgtcgggtcccgcgaggtcctccgaggcgaaggggctgggagtcggctatcagttanatcanatgataagaaaataatactagtcggacgacgtcggtaggaacgggcctagttaccgagtcctatcctaccgaagacgtaacctaacttacccgaaagtaaccgtagtttgtactcgtagacgtaaagtcggaacggttgagaacgactacggacgacgacggtcgttagtgttattcgtagtacgaacgtaagttaattagttactgtacgttagtttagtacgtttacggttacgtcggttaggggaaggggttcgggtacgggtaccggtaacggggttccgggggaaaccccgggttaacggggaaccccggttcgggtaacccgtttacggtttccccggttacccgttaccccggttaccggtaccccggtaccccctaccccgggtaaacccccgggg

SEQ ID NO: 177586 - DNA, 673 bp, Homo sapiens
  misc_feature: GYAE6OF01CQBFQ.33.10.A10.1.454.CMB.1.raw
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcacgtgggtccgccaggctccgaggcgaaggggctggagtggctatcgagttatatcacatagatagaaaataatactatgcgactcgaggaggccattcagcatctacgagacgaactataccaagaactacgttagtactcgtgactaaagtggaacggtggtagacgtaccgtagaaccgacgtacggcttggttgttactttcgtaggtcgaacgtaaaagttatttagtaacgtatagttagtttacggtacgtttaggttaccgttcgtaggggtagggggttgtacgggtacggtacgggtcggggaccgtaacgggtacccgtggtactacgtccgttccaccgtccgactcccctaccgaacccggaccgggtcccttaccggttccccggttcccgttccccgtacgccccgtacccctacccgtaaccgaaccggcgaacccctcggtccgggacgggacccgacggccggtacccgggccgtacgggccctaggtcccggtcggtacgaacccgg

SEQ ID NO: 177587 - DNA, 255 bp, Homo sapiens
  misc_feature: GYAE6OF01COGAI.33.10.A10.1.454.CMB.1.raw
  modified_base (247)..(255): a, c, t, g, unknown or other
  misc_feature (247)..(255): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttggggttttggggggaagagggaagactgacggtccccccaggagttcaggtgctgggcacagcggccctgggctgcctggtcaaggactacttccagtgtgtgtactgagcgggctggcaggcgcatagnnnnnnnnn

SEQ ID NO: 177588 - DNA, 766 bp, Homo sapiens
  misc_feature: GYAE6OF01D3798.33.10.A10.1.454.CMB.1.raw
  modified_base (638)..(638): a, c, t, g, unknown or other
  misc_feature (638)..(638): n is a, c, g, or t
tcagtacacacactcacgaccggtgctcgatttagcgtcgatctcagggtcttcgtggctcacgtccaccaccacgcatgtgacctcgaggggtccgggagatcatggagggtgtccagtgtcaggtgcatcgtggtggagtcgtgggggagcgtggtccaggccggtgggggtccctgagactctccgtgtcgcacgtcctcgtggtacttccaccttcgagtttactagtcggcctagtcgacctacggtcgggtccccgccgacggtccctaccgagggacggaacgggggtcgtagggacgtcggtaccttaagttaccggtaagtttactacttaccgaactagttaggtaaattaaagtaaaaaagttaaacgtacgttaagtcggtaccggtaccgtccgggtaggaaccgggtccttatacgacgacctacgtcccgacgaagacaacgtaactacgaaacgtacgttagttacgtacgtacgtacgaactaagtacgtaacggtgtaacggacgtaaccgacgaaccggtacgtacggtacttgtttacgttacttcgtaggtaacgtaagtaaagtttagtttaacgtaggtagtttacgtaagtttcgtaccgtttacgtttacggngggttaggtaacgggggtctaccggggtaccggtaccgggtaccggggacccgtaacgggttacccgttgacccttacgttcccggttacctaccggaccgtcccgtaccccgtcggaaacccccggg

SEQ ID NO: 177589 - DNA, 608 bp, Homo sapiens
  misc_feature: GYAE6OF01ATBNT.33.10.A10.1.454.CMB.1.raw
  modified_base (157)..(157): a, c, t, g, unknown or other
  misc_feature (157)..(157): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccnccaggctccgaggcaaggggctggagtggctatcagttatatcacatgatagaaaataatactatgcgactcgtgaaggccattcagcatcctccagacgacaattccaaaggtaacacgttgtaatcgtgacaaaatggaacggtgtgacgactgacgacacggcttggtnttactttcngtacgngaaatnttactacgatgtatttcggacttggttactcgtggtagggtggtcggcggacgtcggggaccgacggggtaacccgtggtcgacgtccgttccgtcctccgacgtccctacccgaaccgaaccggtcccctacggttccgttcccgttcccccgtccggccctaccccctccctacccgacgtaccgcccgtaccgtccggtcgggggacctaccgacggcccggccggtcgggccgtcgccgtcggtacgtaaccgg

SEQ ID NO: 177590 - DNA, 852 bp, Homo sapiens
  misc_feature: GYAE6OF01AI3YT.33.10.A10.1.454.CMB.1.raw
tcagtacacacactcacgaccggtgctcgatttagcgtcgatctcagggtcttcgtggctcacgtccaccaccacgcatgtgaccctcgaggggtccgggagatcatgagggtgtccagtgtcaggtgcatcgtggtggagtcgtgggggaggcgtggtccagccgtgggggtccctgagctctcctgtcgcagccctcgtggtacttccacctttcagttactagtggctagtcgcctaccggtccggggtccccgacccgacgggtcccgtacccggaaggggaccggaaaggggggtccgtgggggtaaggtgggtcccttaagttccgtaaaggtttaactacttccaactagttagaaagttaaagaaaaaattaaaactaccttaaggtcggtaccggtaaccgttcccggtagggaaaccggggtcccgtaattccgacgacctacgttaccccgtaccgaaggtaaccgaaaccgttaaactttaaccccgaaaagtaacccgttacgtttacgtaacttacgtacgaactaaagtacggtaacggtgtacgaccgtacgtacggaacgaccgtacggtcgtttaggtagtttacgtttcgtcgggttagaaacgttaaactttaagtttaacgttaacggttaattacggtttaatttaccgggttacggtttaccggtttacgttaccggggttagggttgggggtttcggtccggggtaccgggtaccgggtacccgggggttacccgggtaaccgggttcccggttcggtaccgtacccgttcccgttcccgttacccgtacccgaccggtccccccgtaaaccgggtaaccccccgggg

SEQ ID NO: 177591 - DNA, 207 bp, Homo sapiens
  misc_feature: GYAE6OF01DRX37.33.10.A10.1.454.CMB.1.raw
  modified_base (203)..(207): a, c, t, g, unknown or other
  misc_feature (203)..(207): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctgggcacagccggcctgggctgcctggtcaaggactacttccagtgtgtgtactgagcgggctggcaaggcgcatagnnnnn

SEQ ID NO: 177592 - DNA, 803 bp, Homo sapiens
  misc_feature: GYAE6OF01AMFOW.33.10.A10.1.454.CMB.1.raw
  modified_base (195)..(195): a, c, t, g, unknown or other
  misc_feature (195)..(195): n is a, c, g, or t
tcagtacacacactcacgaccggtgctcgatttagcgtcgatctcagggtcttcgtggctcacgtccaccaccacgcatgtgacctcgaggggtccgggagatcatgagggtgtccagtgtcgaggtgcatcgtggtggagtcgtgggggaggcgtggtccaggccggtgggggtccctgagcctctcctgtgcncgcctcgtggtacttcaccttcagttactagtggcatcgcgtacggtcgggtcccgccgaggcctccggaacgggacgaacggggggtctgggacggtcggaccttagtaccgtaagtttactacgtaccaagtagtagtaagtaaagtaaaaattaacgtacgttaggtcggtaccggtaaccttaccgggtaagggaacgggccgttaatccgacggtacctacgtaccgtaccgaaagaacgtaactaacgttaaccgaaagtaaccgttacggtttattactcgtacgaacgttaaggtacggtaacggtagtacggaaccgtaccgtacggtaaccgtacgtacggtcgttacgttagtttaaccgttcggtaggtaacggttaacggtaaagtttaacgtttaacgttacgttaagtttaacgttagttttacgttacgtttacggtttacggtacgggttacggggttacggggttcggtaccgggtccgggttacgggtccgggggtaacccggtaacgggtaacccgttcgggtaacccgttcgttaccccgttccgttacccgtaccgtcccggtaccccgtacccggtaaccccggg

SEQ ID NO: 177593 - DNA, 599 bp, Homo sapiens
  misc_feature: GYAE6OF01AIO4X.33.10.A10.1.454.CMB.1.raw
  modified_base (314)..(314): a, c, t, g, unknown or other
  misc_feature (314)..(314): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagccgtgggggtccctgagactctcctgtgcagcctctggattcaccttcagttacctatggcatgcacgtgggtcccgccaggcctccgagggcaagggggctgggagtggctatcagtttatatcacatgatagaaaataatactatgcgactcgngaaggccatcagcatctccagagacaattccaagactagttgtatctagacaaagtggaacggtgtagagtaccgtgacgacgacggtctagtgttacttcgtagtagacgtaaagtatttacgttacgtattagtagtttcgtaacgttgggtttaaccttcggtagggtacggggttggtgggtaccgggtaacggtccgggggtacccgaacgggggtaccccttgggttaccacgttccggttacctccccgtacgaccgttccccgtcccgtaacccggg

SEQ ID NO: 177594 - DNA, 655 bp, Homo sapiens
  misc_feature: GYAE6OF01D62GG.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtggggggaggcgtggtccagccgtggggggtccctgagactctcctgtgcagcctctggattccaccttcagttactatggcatgcacgtcgggtcccgccgaggcctccgaggcgaaggggctgggagtggctatcgtagttatatacacatagataagaaaaattaaatactaagtcggaccggtaccgtaccggtaggaacgggccgtattcgagactactcctacgaagacgaactaacttaccaaagtaacctacgttagtactcgtagaactaaagtacggtaacggttgacgaacgtaccgtagaaccgtacgaccggtgttacgttatttatttcgtggtagtaacgtaaagttaatttattaacgattagttatttaggtacgttggttactggtagggtgggttgtcgggacggtacgggtacggggaccgtaacggggtacccttggtacctacggttcccgttcccgtaccgtaccgtacccgtcccgtacccgaaacccgg

SEQ ID NO: 177595 - DNA, 846 bp, Homo sapiens
  misc_feature: GYAE6OF01CY5D3.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggagcgtggtccagccgtggggggtccctggagactctcctgtgcagcctcgtggtacttctaccttctagttacagtggctagtcgccgtacgtcgggtcccgcgacggccgtacgaggacggaacgggggtctagggaggtcggtacttaacgtcgtaagtttactactacactagtaggtaaataagtaaaaataaactacgtaacgtcggaccggtaccgtaccggtaagggaaccgggtcctagtacgacgactaccgttaccgtacgaaggtaaactaaccgtaaaccttaaaccgaaacggtaaaccgttacggtttacgttaacgttaccgtaggaaaccgtaaggttacggtaacgggttacgtaccggaacgtaccggtacggaaccgtaaccggtacggtacgtttaggtttacgttttagtttaccggtaagttaacgggaaccgtttaaaaagtttactttaaacgggttacgttaaggtttagtttaacgttttaccggggttacgttttacggttaccggtttacggggtagggggttaacggggttcgggttacccggggaccgggtaacccggggtttacgggggaaacccccggttaagggggtacccccttgggttaccccgtacggtttcgttacccccgttacccgtagtaaccccgtcccgtaacccgtaaccccgggg

SEQ ID NO: 177596 - DNA, 816 bp, Homo sapiens
  misc_feature: GYAE6OF01C9VW3.33.10.A10.1.454.CMB.1.raw
  modified_base (423)..(423): a, c, t, g, unknown or other
  misc_feature (423)..(423): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactggggtccgccaggcctccgaggcaagggggctgggagtggctatcagttatatcacatgaataagaaaaataaatactagtggccggtaccttccggtaggaacggggccgtattccgagctaatcctaccgaaggtacgaactaacttacccaaaaggtaacctacgttttagtactactaggactaaaagttgggaaaccggttgtagacgtaccgtaggaacgaccacgggtcttggtagtttattttcgtaggtcggaacgtaaaattntttaacgttacgagttgttaagtttcgtacgtttgggttaaccttggttagggtagggggttacggtcggggtaccggtaacgggtcgggggaacccgtaacggggtaacccgtgggtacctacgttcccggtacctcccgttaccgtaccgtcccccgttacccgaacccggtaaaccgggtcccccgttaccggtttcccccgggtttacccttcccccccgggtaccgggttcccccctacccccgttaccctaaccccggtaaccggaccgttccccgtaaccccgttcggggtacccgggggacccacggaacccccggggtcccgggtaccccgggttcgggaccccgttaccgggtcccgggtccggttaagggtaaacccccggg

SEQ ID NO: 177597 - DNA, 738 bp, Homo sapiens
  misc_feature: GYAE6OF01BZP1R.33.10.A10.1.454.CMB.1.raw
  modified_base (240)..(240): a, c, t, g, unknown or other
  misc_feature (240)..(240): n is a, c, g, or t
  modified_base (589)..(589): a, c, t, g, unknown or other
  misc_feature (589)..(589): n is a, c, g, or t
tcagtacacacactcacgaccggtgctcgatttagcgtcgatctcagggtcttcgtggctcacgtccaccaccacgcatgtgacctcagggggtccgggagatcatgagggtgtccagtgtcaggtgcatctggtggagtcgtgggggaggcgtggtccagccgtgggggtccctgagactctcctgtgcagcctctggacttccaccttcagttactagtggcatgcacgtcgggtccncgaggctccgaggcgaaggggctggagtggactatcgtaagttatactcactatagaataagtaaaaattaatactagtcggaccggtacctccggtaggaacgggtccgtatcgagtctactacctaccgaagaacgaacctaacgttaccgaaaacgtaaccgttacggtttagtaactcgtaacgtaactaaagttacgggtaaacgggttgtaacggaccgtaacccggtaggaacccggaaccgtacgggttcttaggtttacgtttactttccgaggtaacgaacgtaaagtttatttaacggtacgagtttacggtagttttggtaaggtttcggtttaacnggggttacggggtaggggttgtacgggacccgggttaacgggttccgggggaacccgtaacgggggttaccccgtgggttaacccgttaccgttaccccggttaccctacccggtaccgtacccgtccccgtaaccccgggaaaccggg

SEQ ID NO: 177598 - DNA, 793 bp, Homo sapiens
  misc_feature: GYAE6OF01DBQU6.33.10.A10.1.454.CMB.1.raw
tcagtacacacactcacgaccggtgctcgatttagcgtcgatctcagggtcttcgtggctcacgtccaccaccacgcatgtgacctcgaggggtccgggagatcatggagggtgtccagtgtcaggtgcatcgtgggtggagtcggtgggggaggcgtggtccagccggtgggggtccctgagactctcctgtgcacgtcctcgtggtacttcctaccttcgtagttactagtcggactagtcgcctacggtcgggtccccgaccgacggtcctccgagggacggaaacgggggtcgtagggaggtcggtaccttaagtacgtaagtttaactaacttcgaactagtaggaaattaaagtaaaaaataattaactagtcggaccggtacgtccggtaaggaacgggacctagttacgagtactaacttcctaccgaaggaactaactaaacgttaaccgaaaagtaaccttacggttacgttaactacgtagaaacctaaagttacgggtaaacgggttggtacgaacggtaccgtacgggaacccgacgtaaccggttgttggttacgtttatttaccggtaggtacggtaaacgttaaaggttagtttaacgttaacgtagtttagtttaacgttttacggtacgtttacggtttacttacgggttgggtaagggttcgggtagggtacccggtagggtccggggtaaccgaaccggggttacccttgggtacctaaccgttccggttaccctcccgtaccgtaaccgcccccgttaaccggaaaccccgg

SEQ ID NO: 177599 - DNA, 750 bp, Homo sapiens
  misc_feature: GYAE6OF01CZIN5.33.10.A10.1.454.CMB.1.raw
  modified_base (114)..(114): a, c, t, g, unknown or other
  misc_feature (114)..(114): n is a, c, g, or t
  modified_base (372)..(372): a, c, t, g, unknown or other
  misc_feature (372)..(372): n is a, c, g, or t
tcagtacacacactcacgaccggtgctcgatttagcgtcgatctcgagggtcttcgtggctcacgtccaccaccacgcatgtgacctcgaggggtccgggagatcatgagggtntccagtgtcaggtgcatctgggtggagtcgtgggggaggcgtggtccagccgtcggggggtccctgagacctctcctgtgcagcctctggattccaccttcagttactagtgctatgcgtacgtcgggtccgccgaggcctcgacggacgaaggggcgtagggaggtgtacttagtacgtaagtttatactcactatagaataagtaaaaacttaatacgtatcggacggtacgtccggaagacgggtactactacgntactacttacaccgaagaacgtaacttaactaaccgaaagtaacctacgtttagttacctacgtataaacgaacgtacgggaacggttgtacggtaaccgtaccgtacgaacggtaccgacggttcgttgttacgtttacgttacgttagtacggtaagtaaacgttatttaagttacgtaagttagttacgttttacgacgttttacggttacgttacggttaggggtaacggggtttcggtacgggtaacccgggttgggtacccggggtaacccggtaacccggggttaacccgtttcgggttaccccgttacgttcccggtttcccgttacccgtaccgttacccggacccccgttaacccggaaacccccggg

SEQ ID NO: 177600 - DNA, 209 bp, Homo sapiens
  misc_feature: GYAE6OF01AQIB5.33.10.A10.1.454.CMB.1.raw
  modified_base (203)..(209): a, c, t, g, unknown or other
  misc_feature (203)..(209): n is a, c, g, or t
tcagtacacacactcacgaccggtgctcgatttagcgtcgatctcaggggtccgggagatcatgagggtgtccttgggttttggggggaagaggaagactgacggtccccccaggagttcaggtgctggcacagcggccctgggctgcctggtcaaggactacttccagtgtgtgtactgagcgggctggcaaggcgcatagnnnnnnn

SEQ ID NO: 177601 - DNA, 719 bp, Homo sapiens
  misc_feature: GYAE6OF01DHYJU.33.10.A10.1.454.CMB.1.raw
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattccaccttcagttactatggcatgcacgtgggtccnccgaggcctccgaggcgaaggggctggagtggctatcagttanatcacatgatagaaaataatactatcggcgtactccggtagaacgggcctattcgagctacttcctaccgaagaacgtaactaaactttaccgaaacgtaacctacggttgttactcgtagaactaaagtcggaaacggttgacggtaacgtacccgtggaaccgtaccgtaacgggtcttaggttacgtttacttttccgtggttacggaacgttaaagttactttaacgttaacggaacgtttaggttaactttttcgggtaacgtttacgggtttaccttacggttagggggtaaggggggtttcgtacggggtaccgttacggggtaccgggggtaacccgtaaccgggggttaccccttggggttaccctaaccgttcccggttccctacccggttccgaaaccccggtcccccgttaacccggaaaccccggg

SEQ ID NO: 177602 - DNA, 251 bp, Homo sapiens; identical to SEQ ID NO: 177557
  misc_feature: GYAE6OF01B5CR6.33.10.A10.1.454.CMB.1.raw
  modified_base (246)..(251): a, c, t, g, unknown or other
  misc_feature (246)..(251): n is a, c, g, or t

SEQ ID NO: 177603 - DNA, 212 bp, Homo sapiens
  misc_feature: GYAE6OF01C19HF.33.10.A10.1.454.CMB.1.raw
  modified_base (204)..(212): a, c, t, g, unknown or other
  misc_feature (204)..(212): n is a, c, g, or t
tcagtacacacactcacgaccggtgctcgatttagcgtcgatctcaggggtccgggagatcatgagggtgtccttgggtttggggggaagaggaagactgacggtccccccaggagttcaggtgcgtgggcacagcggccctgggctgcctggtcaaggactacttccagtgtgtgtactgagcgggctggcaaggcgcatagnnnnnnnnn

SEQ ID NO: 177604 - DNA, 748 bp, Homo sapiens
  misc_feature: GYAE6OF01BD4CC.33.10.A10.1.454.CMB.1.raw
  modified_base (161)..(161): a, c, t, g, unknown or other
  misc_feature (161)..(161): n is a, c, g, or t
  modified_base (219)..(219): a, c, t, g, unknown or other
  misc_feature (219)..(219): n is a, c, g, or t
  modified_base (310)..(310): a, c, t, g, unknown or other
  misc_feature (310)..(310): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactagtggcagtcgcacgtgggtccnccgaggcctccgaggcgaaggggctgggagtggctatcatatgtcttcgtggaggtgngtggtccgcgttcttcgacggcgtacttcgtggtggacgggcctattcgaggcaccgttcgagacgacaaccggaccaaccaacctcccgngcactcctaccgagtagcggaacctaccgtggaccggaacggaccggtaccggaaccgacggtctaaacttagttacgtttaccgtggtcgtacggaactacggtaccttagtaacgacgtaagtacggtcgggttcgggggtacgggtcgtacgggccgtccgggcccggtcgggtcgggtccgggtacgggggtcccgtcgggtcgtaccgttccgttcccgtccgtcgccgtacccgtcccgaaccgaaccgggtcccctaacgggttcccgttaccccgtttccccgggaccgttacccccgtaccttaccccggtacgaacccggtaccgtaccccggtaccggtaccgggtcccgggggtaccgacccggtacccgggtaccgggtcccccggttacgggtcccgtcccggtccggtaccggtaaacccggg

SEQ ID NO: 177605 - DNA, 664 bp, Homo sapiens
  misc_feature: GYAE6OF01BVFBP.33.10.A10.1.454.CMB.1.raw
  modified_base (335)..(335): a, c, t, g, unknown or other
  misc_feature (335)..(335): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattcaccttcagtttactatggcatgcacgtgggtccgtcaggcctccgaggccaaggggctgggagtggctatcagtttatatcacatgatagaaaataatactatcgcgactccggtagaacgggcctattcganctactcacgagaacgactaactacgaaataacgtagttatactcgacgtaaataagtacgggtacggtagtacggaaccgttaccgacggtaacccgacggtacggtgttggtttacgtttaactttcggtaggtacgaaacggttaatttaacgtttacgtaacgtagttagtttacgtttacggttacgtttacggttcgtgggtaaggggtgggttcgggacggtccggtacggggaccgggaaccggtacccgggttaccggttggtaccgtaccggttccgttacccgttcccgacgtccccgtcccgtacccggaaacccggg

SEQ ID NO: 177606 - DNA, 820 bp, Homo sapiens
  misc_feature: GYAE6OF01AV0HH.33.10.A10.1.454.CMB.1.raw
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgctacgtcgggtccgccaggctccgaggcaaggggctggagtggctatcagttatatcacatgatagaaaattaatactatgacggtactccgtaggaacgggccgtattcgagcctaattccaccgaggaacgaactaacttaccaaaagtaaccgtacggtttagtaacttccgtaggtaaccaaaacgttcgggaaacggttgtacggacgtaccgtggaaccgtacgtacggtctggttagttacgtttcgtagtacggtaacgtaaaagttcttttaaacgtacgtaatttggtaaagtttttcggaacgttttacgggtttaacttcggttaggggtaggggttcggttacgggaccggttacggggtaccgggggtaccggtaaccggggtaacccgttgggtccgtaacgtttccgggttaccctcccgttaccgaccggttacccccgtaccccggtaaacccgggaccgggtacccccgttaccgggttacccccggtttcccccgtttacccccggtccggtaccccccttacccccgttacccaacccggaacggtcccgtaccccgttaccgggtccggtacgggggtaccccaacggccccggggtcccggccccggttcgggtcccgtacgggtccccggttggaaacccggtaacccgg

SEQ ID NO: 177607 - DNA, 716 bp, Homo sapiens
  misc_feature: GYAE6OF01BP88Y.33.10.A10.1.454.CMB.1.raw
  modified_base (115)..(115): a, c, t, g, unknown or other
  misc_feature (115)..(115): n is a, c, g, or t
tcagtacacacactcacgaccggtgctcgatttagcgtcgatctcaggggtccctgagactctcctgtgcagcctctggattcaccttcagttactatggcatgcactgggtccnccaggctccaggcaaggggctggagtggctatcagttatatcacatgatagaaaataaatactatgcggactccgtgaagggccattcagcatctccagagactaattccaaagacacgtttgtatctagacaaatgaacggtgtgagacctgacgacacggctgtagttattctgtgacgtaaagtattaattacgatagtatttgacgttgttactcgtggaggggtgtggcgacgtcggggaccagggtaaccccttgggtacctaacgttccgtcctacccgtacgaccgtccctacccgtaacccggaaaccgggtccccgtaacgttcccgggtttcccctttcccccccggtaccgggtaccccctaacccccgttacccctacccgtaaaccggaccgtacccgtaacccgttccgggtacggggggtccctaaccggaccggtacccgggtccccgttcggggtcccgttaccggtacccgttacgggtaccggtaaccggtaaccttacccgtttacccgtaacggttggttacggttacggttaccgtaggtacgggtcgggtacgttacgggacgtaacgggtcgtacg

SEQ ID NO: 177608 - DNA, 204 bp, Homo sapiens
  misc_feature: GYAE6OF01BWUGP.33.10.A10.1.454.CMB.1.raw
  modified_base (201)..(204): a, c, t, g, unknown or other
  misc_feature (201)..(204): n is a, c, g, or t
tcagtacacacactcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 177609 - DNA, 707 bp, Homo sapiens
  misc_feature: GYAE6OF01BASZZ.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcacgtcggggtcccgccaggcctccgagggcgaaggggctggagtggctagtcagttatatcacatgatagaaaaataatactagtgacggactccgtagaacgggccattcagctatcctaccgaagacgaactaactttacccaaaggtaacctacggtttagtaactcgtagaacgtaaaagttcgggtaaagggtcggtaggaacggtaaccctaggaacccggtaaccgacgggttcttaggtttcggtttaaacttttcggtaggtacggaaccggtaaaaagttatttaaacgtttaacggtaatttaaggtacgttttagtaaccgtttagggttttaaccttagggtaggggtaagggggttgtcggggaccggtacggttaccggggggacctaaccggggtaacccgttgggtacccttacgttcccggttaccttccccgtagaacccgtcccccgtacccgaaacccggg

SEQ ID NO: 177610 - DNA, 832 bp, Homo sapiens
  misc_feature: GYAE6OF01ERYJC.33.10.A10.1.454.CMB.1.raw
tcagtacacacactcacgaccggtgctcgatttagcgtcgatctcagggtcttcgtggctcacgtccaccaccacgcatgtgacctcaggggtccctgagctctcctgtgcagcctctggattcaccttcagttactatggcatgcacgtggggtcccgccgaggcctccgaggcgaagggggctggagtcggcttatctagttaatctcacatgataagaaaataaatactagtcgcggtactccggaggaacggccgtattcagacctatcctaccgaagacgaactaacttaaccgaaacgtaaaccgtacggtttagttaactccgtaggaacctaaagtcgggtaaacggtggtagaccggtaacctaggaccgaaccgtacggtcttggttagttaacgttttcgaggttacggtaacgtaaaaggtttacttttaaagtaacggtattaggttaacttttaagggtaaccgttttagggtttaaccttcgggttaggggtaacggggttcgggtagggacgggttaccggggtcggggtaacccgggtaaccgggtaacccggttaccggttacgtaccggttcccgttcccgtaccccgttcgtaaccgttcccccgacccgtaacccgggaccggtacccgttccggtcccggtttacccccgttaccccccggtgtaacccccctaccccggttcccgaacccgtaacgggtaccctacccgttcccggtaccgggtcggggtaccctaaccgggcccgggtaccccggtccccggggttacggccccgttagggtcccggttacggtccggtaaaacccgg

SEQ ID NO: 177611 - DNA, 845 bp, Homo sapiens
  misc_feature: GYAE6OF01AQ9JK.33.10.A10.1.454.CMB.1.raw
tcagtacacacactcacgaccggtgctcgatttagcgtcgatctcagggtcttcgtggctcacgtccaccaccacgcatgtgacctcaggggtccggagatcatgaggtgtccagtgtcaggtgcatctggtggagtcgtgggggaggcgtggtccaggccgtgggggtccctgagactctcctgtgcagcctctggacttctaccttcagttactagtggctagtcgctaccggttcggggtccccgaccgtacggccttacccggaaggggaccggaaacgggggtccgtaggggtaacggttcggggccttaagttaccgtaaggtttaagttacttccaacgtaagtttacggtaagtttaaaacggtaaaaaactttaaaatacccgttaaaggtccggtaaccgggtacccgttcccggggttaaagggaaccgggtaccccggttaattaccgaacgtccctaccgttacccaacccgaaaggtacaaaccttaaacttaccgaaaagtaaccgttagtttacgactttaccgtacgaaactaagttacggtaacggtagtacgaaccggttacgtacggaaacccgaccgtaacgggtcctttaggttagtttaccgtttacgtaggtacgtaagtaaagttactttaaagtacgttataagtttctttaggtaccgttggttaaccgttgggtagggtaggggttcgtagggacccggttaaacgggtccggggtaacccggttaacccggggtaccggttgggttaaccccgtaggtttccccggttacttaccccgggtacgtaccccgtccccgtacccgtaaacccccgggg

SEQ ID NO: 177612 - DNA, 1057 bp, Homo sapiens
  misc_feature: GYAE6OF01C5LYD.33.10.A10.1.454.CMB.1.raw
  modified_base (346)..(346): a, c, t, g, unknown or other
  misc_feature (346)..(346): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcacgtgggtcccgccgaggcctccgaggcgaaggggctgggagtggcttatcgtagttatatccaactatagaattaagaaaaaattaaatacgttagtcggaccggtaccgttccggtaggacggggacctattaccatctaactcctaccgaagaagaacctaacttaccgaaacgtaactcgtttagtactccgtanaactaaaggtggaaacgggttgtaacgaccgtaccgtagggaaacccgtacgtacgggttcttaggtttacgtttacttttcgggtagtaacgggtaaacgtttaaaacgtttagttttaaaccgttaacggttaagttaggttttaaacggtttaccggtttaaccggttttcggggttttaacccgttggggttaaacggggggtttaggggggtttcgggttaaccgggggtaccggggttaacccgggggtttacccgggggggtaaaccccggggtaaacccggggttaaccccgggttttacggggttacccgtttaccggtttaccccggtttccccgtttacccccggtaaccccgttaccccggttaacccccccgttaaccccgggtaaacccccgggtaaaccccgggttaccccccgttaacccgggtttttcccccccgggtttaacccccccgtttcccccccgggttacccccggtacccccctttaaccccccgttacccgttaaacccccggtaaaccgggtaccccgttaaccccgggtaccccggttaccgggggggttacccccggggtaaccggtaccccgggaacccggggttcccccccgggttaccccgggttaccgggggttacccccggtttacccgggttaacccccggggtttccgggtaaaccccggggttaaaaccccggg

SEQ ID NO: 177613 - DNA, 650 bp, Homo sapiens
  misc_feature: GYAE6OF01B1WTJ.33.10.A10.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctntggattcaccttcagttactagtggcatgcacgtcgggtccncgaggctccgaggcgaggggctggagtggctatcgagttanatcacatgatagaaaataatactagtcgacggactccggtagaacgggcctatcagcactctacagacgactaataccaaaggaactagttgtatcgtagaactaatcgggtaacggtgtagaactaccgtcggaaccgacgacggtcttaggttcgttaactttcgtggttacgaagtaaaagttattttaaccgtaacgtagttacggttaattttcgggaaccgttttgggtttaacgtcggttagggggtacggggtttggtaccggggtacgtacggggtccgggggaccggttaacccggggaacccgtttgggtactaggttcccgttaccctcgtacccgtcggtaccccctcggaaccccgg

SEQ ID NO: 177614 - DNA, 678 bp, Homo sapiens
  misc_feature: GYAE6OF01EC7DE.33.10.A10.1.454.CMB.1.raw
  modified_base (282)..(282): a, c, t, g, unknown or other
  misc_feature (282)..(282): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcacgtgggtccgccaggctccgaggcgaaggggctggagtggctatcagttatatcanatgatagaaaataatactatgcggactccggtagaacgggcctattacgagcatcctaccgagaacgaactaacttacccgaaaagtaacctaacggtttagtaacttcgtagtaacctaaaagttcggaacgggttggtacgaacgaccgtaggaaccggacgaacggtcttaggttacgttattttcgaggttacgaacggtaaaacgttattttaacgtaacgtattaggttattttacggtacgttttaggtttaccgtggttaggggtacgggggttggtacgggtaccgggtaccgggttcggggggacccgtaacggggtacccgtttgggcgtaaccgttccggttacccttccccgtacgacccgtcccgtaccccgaaacccgggg

SEQ ID NO: 177615 - DNA, 841 bp, Homo sapiens
  misc_feature: GYAE6OF01CQTA2.33.10.A10.1.454.CMB.1.raw
tcagtacacacactcacgaccggtgctcgatttagcgtcgatctcaggtcttcgtggctcacgtccaccaccacgcatgtgacctcgaggggtccgggagatcatggagggtgtccagtgtcaggtgcatcgtgggtggaggtcggtggggggaggcggtggtccaggtccggtcggggggtccctagacgtaccttccgtccgtggtcgcgacgtccctcgttaggtacttcctaccttactaagtttactagtcggcagtcgaccgtacgtcggggtcccgccgacggccgtaccggagggaccggaaggggtccgtagggaggtcgacgttacgtacgttaagtttataactcctaatagttagtaaattaaaacggtaaaaaaattaagttaacgttaaggtaccggggaacccggttaccgttaccgggtaacgggtaaccggggtacctacgttacgaaccgtctaaccttccgtaaacgaacgtaactaaacgtaaaacgttaaccgaaaacggttaaccgtagtttaccgttaacgtacgttaaacgaaacttaaagggttcgggtaacgggttacgtacggtaaccgttacggacggtaacgtaaaccggtcggttgttacggtttagtttacgttcggtacgtagtaaacgttaagttaatttaacggagttattacggtttagtttaccgttagttacggttaccgttggttacggggtgggttcggtcgggtacggacgggtccggggtaaccgggtaccgggtaccggttcgacccgttcgttaccgttccctaccgtacgtccccgtccccgtaaaccggtacccgg

SEQ ID NO: 177616 - DNA, 724 bp, Homo sapiens
  misc_feature: GYAE6OF01DG4I6.33.10.A10.1.454.CMB.1.raw
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtggggggaggcgtggtccaggccgtggggggtccctgagactctcctgtgcagcctctggattcaccttcagtacgccatgatatgcactgggtcccnccacgggccccaggccgaaggggntggaggtggggtgctagttatagtggtatggagggtaagtaatacgaattactagtcgacaggtaaccgtccggtaggaacggggaccgtattaccaccctaattccgtaccgaagaacgtaactaacttaccgaaacggaaaccacgtctacgtacttacgtacgaacctaaagttcggaacacggtaccctaggtaactaacggaaccggaaccgaacggaaccgggttacttaacgtaagttttaactacgttcgtacggtacggaaaggtagggtaaacgggtttggggaaacggggggttacggttacgggggtaaccgtaaacccggttcgggttacccccttaggggtaccgtacggttacggggacccggtaagggtacccgtccggtaccgaccgttccgacccgtacgaccgtcccctaccgaaccggacccggcccgtacgttccccggg

SEQ ID NO: 177617 - DNA, 748 bp, Homo sapiens
  misc_feature: GYAE6OF01DMY6S.33.10.A10.1.454.CMB.1.raw
  modified_base (291)..(291): a, c, t, g, unknown or other
  misc_feature (291)..(291): n is a, c, g, or t
  modified_base (353)..(353): a, c, t, g, unknown or other
  misc_feature (353)..(353): n is a, c, g, or t
  modified_base (424)..(424): a, c, t, g, unknown or other
  misc_feature (424)..(424): n is a, c, g, or t
  modified_base (547)..(547): a, c, t, g, unknown or other
  misc_feature (547)..(547): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggagcgtggtccagccgtgggggtccctgagctctccgtgtgcagcctcgtggattccaccttcagtttactagtggtatgctacgtgggtcccgccaggcctccgaggcgaaggggctggagtggctattcgtaagttatatcanatgaataagaaaaattaatactagtcggacgtcgttcggtaggaacggtcagtcagcatccncaagacaactaattccaaagtaacctagttcgtactctagaactaaagtcgaaggtgtagacgtaacccgngaaccgtactccgggtcttagggttctttacgttttcgagggtactaaaacgggtaaatttagtttaacgttacggaagtttatttaaggttttacgtaccgttttaacggggtttttaaccncggggtttagggggtacgggggtttagggccgggtaccggggttacccggggtacggggggtaaccccccgggttaaaaggggttaccccccgtttggggtacccccttaaggggttttccccccgttacccgttacccttaaaccccgggtacccccgaaccccccctttccgggaaaaaccccccggggtaaccccggg

SEQ ID NO: 177618 - DNA, 702 bp, Homo sapiens
  misc_feature: GYAE6OF01BGYEQ.33.10.A10.1.454.CMB.1.raw
  modified_base (245)..(245): a, c, t, g, unknown or other
  misc_feature (245)..(245): n is a, c, g, or t
  modified_base (593)..(593): a, c, t, g, unknown or other
  misc_feature (593)..(593): n is a, c, g, or t
tcagtacacacactcacgaccggtgctcgatttagcgtcgatctcagggtcttcgtggctcacgtccaccaccacgcatgtgacctcaggggtccgggagatcatggagggtgtccagtgtcaggtgcatcgtggtggagtcgtgggggaggcgtggtccaggccgtggggggtccctggagactctcctgtgcagcctgtggacttcaccttcagttactatggactatgctacgtcgggtccncgaggcctcgaggcgaaggggcgtagggagtcggtctatacgtaagtttatactacaactagtacgtaataagtaaaaaattaactactaacgtggtaccgtaacgttcccggtaagggaaacgggtcctaacttacgacgtactacttacccgacgaaggaaacgtaacctaacgttaaccggaaaagtaaccgttacggttagtacttcgtaagtaaccgaaagtcgggtaacggttgtacgaacgtaccgtacgacgacgacgtcgtagttacgttagtttcgaggtacgtaacggtaaatatttactaacgtgttaagttcgtttagtaccgttacggtttacngggtagggtccgggtaggtaccgtcgggaccggtaccggggacctaacgggtccgttcgtacctaggttccctcccggacctacggtcccgacccgtcggaaaccccgg

SEQ ID NO: 177619 - DNA, 764 bp, Homo sapiens
  misc_feature: GYAE6OF01EKBYV.33.10.A10.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (408)..(408): a, c, t, g, unknown or other
  misc_feature (408)..(408): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcacgtgggtccgcaggctccgaggcgaaggggctggagtggctanctagttanatcacatgaataagaaaaataatacgtatggaccgtactccggtaggaacgggcctattcacgctactctacagacgaactaacttaccgaaagaacgtacgtttatactcgtagaactaaacgtcggaacggtggtagaacgtacgtacggaacctacggtacgggtcttaggttacgttactttcgtaggtaggaacgtaaaagttntttaaagtacgtattacggtaagtttcggtaacgtttagggttaccgttagggtacggggtaggggttcgggtaccggtacgggtaccggttacgggggaacccgtaaccgggggtaaccgttcgggtaccgtacgttcccggttccttacccgtcgaacccgtcccctacccggaaccccgtacgggacccctaccggttccccggttccccgttacccccgtcgggtccccctaaccccgttcccgaaccgaccgtacccgacccgttaccggtcccggggtaggggaccctaaccggccggggcccgggtacccggtccggtcgtacccgggcgttacgggaccggtaaaccg

SEQ ID NO: 177620 - DNA, 212 bp, Homo sapiens
  misc_feature: GYAE6OF01EXXGV.33.10.A10.1.454.CMB.1.raw
  modified_base (199)..(199): a, c, t, g, unknown or other
  misc_feature (199)..(199): n is a, c, g, or t
  modified_base (204)..(212): a, c, t, g, unknown or other
  misc_feature (204)..(212): n is a, c, g, or t
tcagtacacacactcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccagtgtgtgtactgagcgggctggcaaggcgnatagnnnnnnnnn

SEQ ID NO: 177621 - DNA, 913 bp, Homo sapiens
  misc_feature: GYAE6OF01EQCZN.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatcgtggtggagtcgtgggggaggcgtggtccagccgtggggggtccctgagactctcctgtgcacgcctcgtggtacttcctacctttcagtttactatggctatcgactacgtcgggtccaccgacggtcctccgaggacggaaggggtcgtggtaggtcgactagtcgtaagtttactacgtactacgtaagtacggtaataaaggtaaaaaattaaacgttaaacgttacgtacgggtaccggtaacccgttaccgggtacgggaaacgggtacccgttaagttaccgacggtacctactacccgtaccgtaaggaaccgtaactaacgttaaaccgaaacgtaaccgttaacggtttagtacttccgtaacggaaaccgttaaaggttacgggtaacggttaggtaacgtaaccggtacggtacggtaaacccggtaaccggttaaccggtgttaccggtttagtttaccgttttcggtacggtagttaaacccggtaaagtttaacgtttaacgttacggtaagtttacggttaacgttttacgggttacgtttaacgggtttaccgtttaggggtacggggggtttaaggggtcggggttaaccggggttacccggtaacgggggggttaccccggggtaacggggtttaaaccccggggggtaaaaccccggttttccgggggttacccttaaacgggtttcccccggttttacccgaaccccggtttaacccgtacccccgggttaccccgtacccccgggtaaaaacccccggggg

SEQ ID NO: 177622 - DNA, 763 bp, Homo sapiens
  misc_feature: GYAE6OF01CSXLJ.33.10.A10.1.454.CMB.1.raw
tcagtacacacactcacgaccggtgctcgatttagcgtcgatctcagggtcttcgtggctcacgtccaccaccacgcatgtgacctcgaggggtccgggagatcatggagggtgtccagtgtcaggtgcatcgtggtggagtcgtggggggaggcggtggtccaggccggtcggggggtccctgacgactctcctgtcgcacgcctcgtggtactcaccttctagttactagtgactagtcgacacggttcgggtcccgaccgtacggcctaccggacgggaacggtaacggggtccgtaggggagttcggtacttaacgtcgttaaggtttaataacgtaccaacgtagtagtaaagtaaaaataaaaaattaaacttacgttagacgggtacccggtaccgttaccgggtaaggtaaccgggcctagttaccgagtaccactaccgtaccaacggaacaacgttaaaccttaaccgaaaacgtaacgttacgttaagttactacgtagtaaaccgaaggtcggtaacggtgtacggaacctacgacgaaccgtacgtacggtcgtttgtacgtttagttctaaggtacgtaaggtaaattaacgtttagtaacttagttaagtttacgttacgttacgtttaagttaccgttagggtacgggtggggtacggttcgggacggccggggttcggaccgggttaacgttcccgggtactcgttaacgtccgtcctacccgtataccccgcgtacccgtaccgg

SEQ ID NO: 177623 - DNA, 775 bp, Homo sapiens
  misc_feature: GYAE6OF01D6ZKB.33.10.A10.1.454.CMB.1.raw
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgccagtgggtccgcaggctccaggcgaaggggctggagtggctatcagttatatcacatgaataagtaaaataatactatgacgtactccgtaggaacggccgtattacgagtcatcctacagagaactaacttaccgaaagtacctacgtttgtaatcctagaactaagttagggaacggtggtagacgtaaccgtaggacggtacgacggtattggttattacgtttcgtaggttacgaacgtaaaagttagtttaacgtaacgtagttaggttaattttacggaacgttttaggttaccgtggttagggtacggggttaggtacgggtacggtacggggtacggggtaccgaaccggggtaaccgttcggtaccgttagtttaccccggtcttacccgtaccgtaccgtacccctaacccgtaaccggtaaccggtaccccgtacggtttcccccgggtttacccttcccccggttacgtcccccgtaccccttacccgtaacccgtaacggaccgtcccgtaacccggttccggggtaccgggcctaacccgggaccgggtccccggttaccccgggtcgggtacccgtaccgggttacccggtacgggttaaaccgtaaaccggg

SEQ ID NO: 177624 - DNA, 727 bp, Homo sapiens
  misc_feature: GYAE6OF01ET8S0.33.10.A10.1.454.CMB.1.raw
  modified_base (126)..(126): a, c, t, g, unknown or other
  misc_feature (126)..(126): n is a, c, g, or t
  modified_base (698)..(698): a, c, t, g, unknown or other
  misc_feature (698)..(698): n is a, c, g, or t
  modified_base (711)..(711): a, c, t, g, unknown or other
  misc_feature (711)..(711): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtncatctggtggagtcgtgggggaggcgtggtccaggccgtggggggtccctgacgtactctcctgtcgcacgtcctctggtacttccgaccttcgagtttacctagtggcctagttcgactaccgtcggggtacccgccgtacgggtcctacccgagggtaccggtaagggggtccgttaggggtaggtcggtacctagtacctaagtttaactacttaccaacgtaataggtaacttaaaggtaaaaacttaaaacgttaaccgtaagttacgggaccggtaacccgttaccgggtaacggtaaccgggtaccttacgttacgacggtacctacttacccgtaccgaagtaacctaacctaaacttaccgaaacgtacgtacgttagtacgtctaagaacctaagtacggtaacggtgtacgtaacgtacgtacgacgtaccgacggtattagtacgttactttgacggtacgaacgttaaagtacgttagtactagttagtacttagtcgttggttactggtaggtcgggtgtgggtccgacggtcgggaccgtacggtaccgtgaccgtntccgtctcgtacnccgtccgaccgacccg

SEQ ID NO: 177625 - DNA, 763 bp, Homo sapiens
  misc_feature: GYAE6OF01CN9Z3.33.10.A10.1.454.CMB.1.raw
  modified_base (151)..(151): a, c, t, g, unknown or other
  misc_feature (151)..(151): n is a, c, g, or t
  modified_base (250)..(250): a, c, t, g, unknown or other
  misc_feature (250)..(250): n is a, c, g, or t
tcagtacacacactcacgaccggtgctcgatttagcgtcgatctcagggtcttcgtggctcacgtccaccaccacgcatgtgacctcgaggggtccgggagatcatgagggtgtccagtgtcaggtgcatcgtgggtggagtcgtgggggnggcgtggtccagccgtggggggtccctgagctctcctgtgcagcctcgtggtacttccaccttctagtttactatggctatcgcctacgtcgggtcccnccgacggtcctccggaggacggacggggtcgtgggtaggtcgacttattacgtaagtttatactacacgtaagtagtaattaaagtaaaaaattaacttaacgtagtccggtaccggtaccgtcgggtaagggaccgggtactacttacgacgctaccgtcctaaccgaaggtaacaaactaacgttaaccaaaggtaaccgttacgtttagtacttacgtacgtaaacgtaaaggtggtaaaccggttgtaaccggaacgtaccggtaaggaacccgtccgtaagggttcttaggttctttacgtttcgagttaacgaaacgtttaagttaacttttaaggtactagtttacgtacggtttagttacccggtttggtaacgttgggttaggggtcggggtacgtccggggtacgtcggggtaccgggtaaccgggaacccggtttggtccggtaacttccggttcccgttcctacccgtagtacccccgtccgtaacccggtaaccccgggg

SEQ ID NO: 177626 - DNA, 879 bp, Homo sapiens
  misc_feature: GYAE6OF01C5GUA.33.10.A10.1.454.CMB.1.raw
  modified_base (842)..(842): a, c, t, g, unknown or other
  misc_feature (842)..(842): n is a, c, g, or t
  modified_base (855)..(855): a, c, t, g, unknown or other
  misc_feature (855)..(855): n is a, c, g, or t
tcagtacacacactcacgaccggtgctcgatttagcgtcgatctcagggtcttcgtggctcacgtccaccaccacgcatgtgacctcgagggggtccgggagatcatggagggtgtccaggtgtcagggtgctatcgtgggtggagtcggtggggggaggcggtggtccaggccggtggggggtccctgagacctctccgtgtgcacgcctcgtggtacttctaccttctagttactagtcggactagtcggaccgtacggtccggggtaccccgaccggtaacgggcccgtaccgggaacggggaccgggtaaacgggggtcgttaggggtagggtcggtacttaacggtacgttaaggtttaactagttaccgaactagttacggtaaagttaaaagtaaaaaattaacttaacgttaggtaccgggaccggttaaccgtaccggtaagggtaaccgggtacgttattaccggacgtacctacgttacccgacgtaaacggtaacaaccgttaaacctaaacccgaaaggttaaccgtaggtttaacgtactaccgttaaggaaacgtaaagggttacgggtacggtacgtagaaccggtacgtaacggaccgtaacggccgttagtacggtttagtttcttacggtacgagtaaacgggttaagtttaacgtttaacgttaaggtaacggtttagttaagttttaaccggtacgggtttacgttaaccggttggggtaaggggtaggggttccgggtaggggaccgggttacgggccgggggtaaccccggtaacggggttacccgtcggttaaccgtccgttaccgttcccgtaaccncccgggtaacccnccccgggtaaccgtaaaccccggg

SEQ ID NO: 177627 - DNA, 217 bp, Homo sapiens
  misc_feature: GYAE6OF01AVOSS.33.10.A10.1.454.CMB.1.raw
  modified_base (203)..(217): a, c, t, g, unknown or other
  misc_feature (203)..(217): n is a, c, g, or t
tcagtacacacactcacgaccggtgctcgatttagcgtcgatctcagggtccgggagatcatgagggtgtccttgggttttgggggaagaggaagactgacggtccccccaggagttcaggtgctgggcacaggcggccctgggctgcctggtcaaggactacttcagtgtgtgtactgagcggctggacaaggcgacatagnnnnnnnnnnnnnnn

SEQ ID NO: 177628 - DNA, 898 bp, Homo sapiens
  misc_feature: GYAE6OF01CGUEJ.33.10.A10.1.454.CMB.1.raw
  modified_base (165)..(165): a, c, t, g, unknown or other
  misc_feature (165)..(165): n is a, c, g, or t
tcagtacacacactcacgaccggtgctcgatttagcgtcgatctcagggtcttcgtggctcacgtccaccaccacgcatgtgacctcgaggggtccctgagacctctcctgtgcagcctctggattccaccttcagttactagtggcatgcgacgtcgggtcccnccgaggcctacgaggacgaagggggctgggagtcggactagtcgtaagttatactaccactagtagaataagtaaaaactaaatacgtagtcggtaccggtacgtccggtacggaacggtccgtagttacgacgtactacgtacctacgaaggtacgtaacgtaactaaccgaaacgtaaccgtagttacgtactacgacgtaacgtaagtacggtacggtgtacggacgtaccgtacgacgtacggtacgtcgttagttacgttacgttcgtaggtacggtaacgtaaagttagttaacgtacgtagttagtttaacgtttacgttaacgtttacggttacgttacgggttaggggttacggggtcgggttaccggggtaccgggtaccgggtaccggggtaaccgggtaacccgggttaccggttacggtaccgttaccggttacccggttaccccgttacccggtaacccggtaccccgtacccgtaaaccccggtaacccgggtaaccccgggttccccgttaccccgggtttccccgttcccccggtttacccccggtaccccggtaccccttaccccgtaaccccgtaccggtaacccgacccggtaccccggtcccgggttcccggggtacccgggaacccggtacccgggaccccggtaccccgggttccgggtacccggttcccggtacccggttaccgggtaaccgggttaccggtaacccgg

SEQ ID NO: 177629 - DNA, 774 bp, Homo sapiens
  misc_feature: GYAE6OF01DNZ7B.33.10.A10.1.454.CMB.1.raw
tcagtacacacactcacgaccggtgctcgatttagcgtcgatctcagggtcttcgtggctcacgtccaccaccacgcatgtgacctcaggggtccggagatcatgagggtgtccagtgtcaggtgcatcgtgggtggagtcgtggggggaggcgtgggtccaggccggtcggggggtccctggagtacctctctgtcgcacgtcctgtaggtacttcctaccttacgtaggtttactacgtggtctagtcggaccgtacggttccggggtaccccgccggtacggtcctacccggacggggacggaaacgggggtcgttaggggaggtcgggtaccttagttaccgtaagtttaatacttcaactagttaagtaacgtaaagtaaaaagttaaactagtacgtacggtaccggtaaccgttccggaaggggaaccggtacgtatcggagtactacgtcctacgaaggtaaccactaacttaaccgaacggtaaccttagttgtaacgtcgtaacgtaactaaaggtacggtaggtaggtacgtaacgactacggaaccgaccggtacgtacgttgttagttactttcggtagtacgaaagtaagtacgtttaacgttaaggtactttaagtacgtttagggtacgtttacggttaccgttagggtgggttaaggggtccggttagggaccgggttacgggtaccgggaccggtaccggtacggtccggtcgtaccgtccgtacccgtactccgtacgccccgtagtaaccccgg

SEQ ID NO: 177630 - DNA, 769 bp, Homo sapiens
  misc_feature: GYAE6OF01AC8SN.33.10.A10.1.454.CMB.1.raw
  modified_base (518)..(518): a, c, t, g, unknown or other
  misc_feature (518)..(518): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctcctgtgcagcctctggattccaccttcagttactagtggcatgcacgtcgggtccgccgaggcctccgaggcgaaggggtctgggagtggactatctagtttactatcaactatagaataagaaaaataatactagtacggacggtaccgtaccggtagggaacgggtacctagttaccgagctactcctacccgaaggaacgaactaacgtttaccgaaacgaacgttacgtttagtactacgtagaactaaagtacgggtaaggtcgtaggtaaccgaccgtacgggaacccgaccggtaccggttcgtttacggtttagtttacgttttacgngggttacgtaaacggtaaaggtttaacttttaaacgttacggtaatttaggttacgttttacggtaacggtttacggtttaaccgttcgggttaggggttacgggggttcgtacggggtaccggtccggggtacccgggggtacccgaaacccggggggttacccgttaggggtaccccttaccggttcccggttccccgttaccccgtcccggtaacccggttccccccgtaacccggtaacccccgggg

SEQ ID NO: 177631 - DNA, 921 bp, Homo sapiens
  misc_feature: GYAE6OF01C0KS2.33.10.A10.1.454.CMB.1.raw
  modified_base (196)..(196): a, c, t, g, unknown or other
  misc_feature (196)..(196): n is a, c, g, or t
tcagtacacacactcacgaccggtgctcgatttagcgtcgatctcagggtcttcgtggctcacgtccaccaccacgcatgtgacctcgaggggtccgggagatcatgagggtgtccagtgtcaggtgcatcgtgggtggagtcgtgggggaggcgtggtccgagccgtcgggggtccctgagactctcctgtgacngcctgtggacttccaccttgtagtttactatggcagttcggctacggtcgggtcccgaccgtacgggcctccggagggacggtaacgggggtccgttaggggtaacggtcggtaaccgttagttaccgttaaaggtttaactaacttaccgtaaccgtaagttagtaaacgtttaaaacgtaaaaaattaaacgtaaccgttacgtacgggtacccgggttaaccggttacccgggttaaggggaaaccggggtaccctaacgttaccggaactaccgtaaccgttaccgtacccgaaacggaacggttaaactaaaacccgtttaaccgaaacggtaaaccgtaacgtttaggttaacttacggtaacgtaacgtaaacgggttgggtaaccggggtaacgttaggaaaccggtaaccgtaccggaacgtaacccggtacgttaccggttagtttaccgttaagttttcgggtaacgtaggttaccggtaaaagtttaacgtttaagtacgttaagttacggtttaattttaacggtaacggtttcggttttaacgtcggggttagggttacggggttacgggtaccgggttaccgggttacggggaacccggggtaccggggttaacccgggttaaccggttcggtacccggttttaacgtcccgggtttaccgttaccccgtacggtaaccccgtacccccggttaacccctaaacccgggg

SEQ ID NO: 177632 - DNA, 872 bp, Homo sapiens
  misc_feature: GYAE6OF01CLTM3.33.10.A10.1.454.CMB.1.raw
tcagtacacacactcacgaccggtgctcgatttagcgtcgatctcaggtcttcgtggctcacgtccaccaccacgcatgtgacctcatgggtccggagatcatggaggtgtccagtgtcaggtgcatctggtggagtcgtgggggaggcgtggtccgagccggtgggggtccctgagacctctccgtgtgcacgtcctcgtggtacttcctacccgtttactagttactagtggactagttcgaccgtacgtccggggtcccgacccgacgggccctacccggagggaccggtaacggggtcgtaggggtacggtcgggtaccttaagtaccgttaagtttaatacgtacctaacgtagttaaggtaaattaaaaggtaaaaacttaaaagttaacgtacgtacggggtacccgtaaccggtttaccggaacgggtaaaccgggtcctaacgttaccgacgtacgtacttcccgtaacgaaggtaactaacgtaactaaccgaaacgtaaccgtagtttataacgttacgtacgaactaaggtaggtaccggttagagtaaccgtaccgtagaaccgggacgtaccggtgttagttacgtttaccgtttcgtagggttacctaaacgttaaagtttacgtttacgttaaacgtgttaaccggtttagttttacgggtaccgttttaacggttaccgttagggtaacggggggttccggggttggtaaacccgggggtcccgggttaaaccgggggttccggggtacccgggttaaacccccggggttaaaccgggttcggttaacttacccccggttcggtttaacccccttccgtaccccccggttaaccgccccccggtaaacccccggg

SEQ ID NO: 177633 - DNA, 713 bp, Homo sapiens
  misc_feature: GYAE6OF01AMD53.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggagcgtggtccagccgtgggggtccctgagactctcctgtgcagcctctggacttcaccttcagttactagtcggcagtcgccacgtcgggtcccgccgaggtcctccgaggtacgaaggggctggagtggacttatcgtagttactatcaactagtagtaataagtaaaaattaataacgttagtcggtaccggtacgtaccggtagggaacgggcctagttacagacctactccgtaccgagaacgaactaacgtacccaaacggtacctacgtttacgtactacgtacgacgtaagtacgggtaacgtggagtaccgacgtacggaacccgtacggacggtacgtttagtacggtttcttcgtaggtagaaccggtaaattatttaacgttacgagtttacggttatttaccggtgtttaccgttacgttcgggtaggggttaggggtcggtccgggtacggtacgggtacccgggggaccgttacccggggtaccggttcggtaccgttacttcccggtaccctaccggttacccgccccgtacccgaccgtaacccccgggg

SEQ ID NO: 177634 - DNA, 770 bp, Homo sapiens
  misc_feature: GYAE6OF01DRYOU.33.10.A10.1.454.CMB.1.raw
  modified_base (549)..(549): a, c, t, g, unknown or other
  misc_feature (549)..(549): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccaggccgtggggggtccctgagactctcctgtgcagcctctggattcaccttcaagtttactagtggctagtcgcctacgtcgggtcccgaccaggtcctccgagggccgaagggggcgttgggaacggttgggccttaattccgtaagtttataacgtcaactagttagaaataacgtaaaaaattaaattaaccgtaagttcggacccgtaacgttcccggttaagggaacgggaccctaattacgacggacctacgtcctaacgaaggaacgtaaacctaaacgttaccgaaaacgtaaccgtacgttgtaactaccgtagactaaaggtacggtaacggtaggtagacgtacgtacgggaacctaacgacggtcgttaggttagtttntttccgaggtacgtaacggtaaagtttaagtttaacgttaaggtaacgtttagttaagttttacggacggttttaacggtttaccgttagggttaggggtaggggttcgggttacgggaccggtacgggttaccgggggaaccctaaccgggggttaaccccttggtaaaccgtgttacccccgtcttaccgccgaccgtcccgtaaccggtaaacccggg

SEQ ID NO: 177635 - DNA, 848 bp, Homo sapiens
  misc_feature: GYAE6OF01A88UM.33.10.A10.1.454.CMB.1.raw
  modified_base (286)..(286): a, c, t, g, unknown or other
  misc_feature (286)..(286): n is a, c, g, or t
  modified_base (805)..(805): a, c, t, g, unknown or other
  misc_feature (805)..(805): n is a, c, g, or t
  modified_base (817)..(817): a, c, t, g, unknown or other
  misc_feature (817)..(817): n is a, c, g, or t
tcagtacacacactcacgaccggtgctcgatttagcgtcgatctcagggtcttcgtggctcaccgtccaccaccacgcatgtgaccctgagggggtccgggagactcagtggagggtgtaccgagtggtcaggtgtccagtcgtgggtgggtacggtcggtacgggggggacggtccgggttggtcccgacgggtcccgggttcgggggggttaccccctaggaacggtacccttccgtccgtaggtcgaccgccgtcctcgtggtacctctacctactaacgttnttacgcgtctagtcgtacctcggtcgggtccccgcgtacgtccgccggagggtaccgggaggtcggtagggtaccgttcggacgttcgtacgtaaagttcagtaccaagatacgtaagtaaaacgtaaaactacgtaacacggtcggtacgtacccggttacgaaggggaccgtacccgtcgttaacgacgtccgtaaccgtactaccgggtaaacaaacgttaaactccgtaaaacccgtaaacgttaaccgtaggttaacacttaccggtaagtaaaccggtagtacggggtacgtaggtacggtaccacggtaccgacgtaaccgggtacgttagttacggttacgttacccgttaaggcgggtttaaaccgaagtttaacgtttaacgttaaagtttacggtaagttccgttaggttacccgggtttagttcgggttaacgttacgggtggggaaccgtttgggcgtaccgggtaaccggggcggtccgtaaacccgggcggttacgttcccggnttacccggtccnccgtaacccgcccttacggcccgtacccggg

SEQ ID NO: 177636 - DNA, 205 bp, Homo sapiens
  misc_feature: GYAE6OF02GM49S.33.10.A10.1.454.CMB.1.raw
  modified_base (202)..(205): a, c, t, g, unknown or other
  misc_feature (202)..(205): n is a, c, g, or t
tcagtacacacactcacgaccggtgctcgatttagcgtcgatctcagggtccgggagatcatgagggtgtccttgggttttgggggaagaggaagactgacggtcccccaggagttcaggtgcgtggcacagcggccgtgggctgcctggtcaaggactacttccagtgtgtgtactgagcgggctggacaaggcgcatagnnnn

SEQ ID NO: 177637 - DNA, 217 bp, Homo sapiens
  misc_feature: GYAE6OF02IOR7P.33.10.A10.1.454.CMB.1.raw
  modified_base (201)..(217): a, c, t, g, unknown or other
  misc_feature (201)..(217): n is a, c, g, or t
tcagtacacacactcacgaccggtgctcgatttagcgtcgatctcaggggtccgggagatcatgaggtgtccttgggtttggggaagaggaagactgacggtcccccaggagttcaggtgctgggcacagcggccctgggctgcctggtcaaggactacttccagttgtgtgtactgagcgggctggcaaggcgcataggnnnnnnnnnnnnnnnnn

SEQ ID NO: 177638 - DNA, 211 bp, Homo sapiens
  misc_feature: GYAE6OF02GV6LV.33.10.A10.1.454.CMB.1.raw
  modified_base (197)..(211): a, c, t, g, unknown or other
  misc_feature (197)..(211): n is a, c, g, or t
tcagtacacacactcacgaccggtgctcgatttagcgtcgatctcagggtccggagatcatgaggtgtccttgggttttggggaagaggaagactgacggtcccccaggagttcaggtgctggcacagcggccctgggctgcctggtcaaggactacttccgagtgtgtgtactgagcggctggcaaggcgcatagnnnnnnnnnnnnnnn

SEQ ID NO: 177639 - DNA, 246 bp, Homo sapiens
  misc_feature: GYAE6OF02F52BX.33.10.A10.1.454.CMB.1.raw
  modified_base (243)..(246): a, c, t, g, unknown or other
  misc_feature (243)..(246): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 177640 - DNA, 209 bp, Homo sapiens
  misc_feature: GYAE6OF02IZBYX.33.10.A10.1.454.CMB.1.raw
  modified_base (201)..(209): a, c, t, g, unknown or other
  misc_feature (201)..(209): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggctacttccagtgtgtgtactgagcgggctggcaaggcgcatagnnnnnnnnn

SEQ ID NO: 177641 - DNA, 204 bp, Homo sapiens
  misc_feature: GYAE6OF02I1K8K.33.10.A10.1.454.CMB.1.raw
  modified_base (202)..(204): a, c, t, g, unknown or other
  misc_feature (202)..(204): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 177642 - DNA, 567 bp, Homo sapiens
  misc_feature: GYAE6OF02JCZU5.33.10.A10.1.454.CMB.1.raw
  modified_base (232)..(232): a, c, t, g, unknown or other
  misc_feature (232)..(232): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagcctggggggtccctgagactctcctgtgcagcctctggattcaccttcagttactatggcatgcactgggtccnccaggctccaggcaaggggctggagtggctatcagttatatcacatgatagaaaataatactatgcgactccgtagaaggccattcagcatctaccagagacaattccaaagactacgttgtactctagacaaagtgaaccggttgtacgaagacctaggaccgacgacgggtcttggtacgttactttcgtaggtacgacgtaaagtattagttacgatgtattgacttggttactcgtaggagggtgtacgggcgtacggtcggggcccaagggtaccccttgggtacctagttcccggttctacccgtcgacgtcccgtacccgtaacccgg

SEQ ID NO: 177643 - DNA, 247 bp, Homo sapiens
  misc_feature: GYAE6OF02FX2MM.33.10.A10.1.454.CMB.1.raw
  modified_base (243)..(247): a, c, t, g, unknown or other
  misc_feature (243)..(247): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 177644 - DNA, 206 bp, Homo sapiens
  misc_feature: GYAE6OF02GTZIB.33.10.A10.1.454.CMB.1.raw
  modified_base (201)..(206): a, c, t, g, unknown or other
  misc_feature (201)..(206): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggctacttccagtgtgtgtactgagcgggctggcaaggcgcatagnnnnnn

SEQ ID NO: 177645 - DNA, 247 bp, Homo sapiens
  misc_feature: GYAE6OF02GTFW8.33.10.A10.1.454.CMB.1.raw
  modified_base (243)..(247): a, c, t, g, unknown or other
  misc_feature (243)..(247): n is a, c, g, or t
tcagtacacacactcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 177646 - DNA, 204 bp, Homo sapiens; identical to SEQ ID NO: 177512
  misc_feature: GYAE6OF02HI7YO.33.10.A10.1.454.CMB.1.raw
  modified_base (201)..(204): a, c, t, g, unknown or other
  misc_feature (201)..(204): n is a, c, g, or t

SEQ ID NO: 177647 - DNA, 557 bp, Homo sapiens
  misc_feature: GYAE6OF02JFJ2O.33.10.A10.1.454.CMB.1.raw
  modified_base (423)..(423): a, c, t, g, unknown or other
  misc_feature (423)..(423): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcactgggtccgccaggctccaggcaaggggctggagtggctatcagttatatcacatgatagaaaataatactatgcggactccgtagaaggccatcagcatctccagagacaattccaaagaacacgttgtatctagacaaatggaacggtgtagagacctgacgacacggcttgtgttatttctgttgacgaaagtnttaattacgattgtatttgacttggttactcgtggtaggggtgtaggtcgacggtcggggccaacggggaacccttgggtacctaagttcccggttaccttacccgtcgtaacggtccccttacccgaacccgg

SEQ ID NO: 177648 - DNA, 206 bp, Homo sapiens
  misc_feature: GYAE6OF02GS9PI.33.10.A10.1.454.CMB.1.raw
  modified_base (202)..(206): a, c, t, g, unknown or other
  misc_feature (202)..(206): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 177649 - DNA, 212 bp, Homo sapiens
  misc_feature: GYAE6OF02G6F3I.33.10.A10.1.454.CMB.1.raw
  modified_base (201)..(212): a, c, t, g, unknown or other
  misc_feature (201)..(212): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccagtgtgtgtactgagcggctggcaaggcgcatagnnnnnnnnnnnn

SEQ ID NO: 177650 - DNA, 554 bp, Homo sapiens
  misc_feature: GYAE6OF02ITROR.33.10.A10.1.454.CMB.1.raw
  modified_base (273)..(273): a, c, t, g, unknown or other
  misc_feature (273)..(273): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (415)..(415): a, c, t, g, unknown or other
  misc_feature (415)..(415): n is a, c, g, or t
  modified_base (464)..(464): a, c, t, g, unknown or other
  misc_feature (464)..(464): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccgaggcaaggggctggagtggctatcagttanatcacatgatagaaaataatactatgcgactcgtagaggccatcagcatctcaganacaatcaagacacgttntatctgacaaatgaacggtgtagacgacctgacgacgacggctgtattactttctgtacgacgaaagtnttaagttacgattgtattttcgacttaggtttactgtagggaggggttntgggacgtacggtcgggggacccaacggggtaacccttgggacctagttcccgttccttacccgtcgaacggtcccctacccgaacccgg

SEQ ID NO: 177651 - DNA, 217 bp, Homo sapiens
  misc_feature: GYAE6OF02FO1QD.33.10.A10.1.454.CMB.1.raw
  modified_base (203)..(217): a, c, t, g, unknown or other
  misc_feature (203)..(217): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccagtgtgtgtactgagcgggctggcaaggcgcatagnnnnnnnnnnnnnnn

SEQ ID NO: 177652 - DNA, 552 bp, Homo sapiens
  misc_feature: GYAE6OF02G0BIC.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcgaaggggctggagtggctatcagttatatcacatgatagaaaataaatactatgcggactccgtgaagggccgattcagcatctcagagacaattccaaagaacacgttagtatctgacaaatgaacggtgtgagacctgacgacacggctgtgttatttcgtgtgacgtaaagtatttagttacgattagtatttgacttggttactcgtaggtaggggttgtcgggcgtacggtcgggggacccaacggggtaacccctgggtaccagttccgtccttccgtcgacgtccctacccgaacccgg

SEQ ID NO: 177653 - DNA, 657 bp, Homo sapiens
  misc_feature: GYAE6OF02H19HT.33.10.A10.1.454.CMB.1.raw
  modified_base (465)..(465): a, c, t, g, unknown or other
  misc_feature (465)..(465): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagacgtggggggtccctgagactctcctgtgcagcctctggattcaccttcagttactatggcatgcacgtcggggtcccgccagggctcccagggcaaggggctggagtggctatcagttatatcacatgatagaaaataaatactatgcggactccgtaggaaggccgattcagcatctccagacgacaacttaccaaagtaactcgttatatctagactaaagtaggtaaacggtgtagaacgtaccgtaggaaccgaacgacgggtactggttattactttcgtaggtagacggtaaaaagtntttaaattacggaattagtagttttaggacgtttagggtttaccttacgggtaggtaagggggttgtagggaccggtaccgggttacggggggacccgtaaacggggttaccccgtacggggttaccgtacgtttcccggtcccgtttccccgttacccgaaccggttccccctacccggtaaaccccgggg

SEQ ID NO: 177654 - DNA, 542 bp, Homo sapiens
  misc_feature: GYAE6OF02INECQ.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgatgaaaataatactatgcggactcgtagaaggccgattcagcatctccagagacaattccaagaacacgttgtactctagacaaatgaacggtgtagagacctgacgacgacggtctgtgttatttcgtgtagacgaaagtatttaagtacgattagtatttagacttggttacttcgtaggaggggtgtggcgacggtcggggacctacgggaacccgttggtacgtagtccgtctcccgtgacgtaccctccgaacccgg

SEQ ID NO: 177655 - DNA, 246 bp, Homo sapiens
  misc_feature: GYAE6OF02G9BHG.33.10.A10.1.454.CMB.1.raw
  modified_base (244)..(246): a, c, t, g, unknown or other
  misc_feature (244)..(246): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccagtgtgtgtactgagcgggctggcaaggcgcatagnnn

SEQ ID NO: 177656 - DNA, 204 bp, Homo sapiens
  misc_feature: GYAE6OF02GHGSD.33.10.A10.1.454.CMB.1.raw
  modified_base (203)..(204): a, c, t, g, unknown or other
  misc_feature (203)..(204): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccagtgtgtgtactgagcgggctggcaaggcgcatagnn

SEQ ID NO: 177657 - DNA, 258 bp, Homo sapiens
  misc_feature: GYAE6OF02JIQ91.33.10.A10.1.454.CMB.1.raw
  modified_base (244)..(258): a, c, t, g, unknown or other
  misc_feature (244)..(258): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggtttggggggaagaggaagactgacggtcccccaggagttcaggtgctgggcacagcggccctgggctgcctggtcaaggactacttccagtgtgtgtactgagcgggctggcaaggcgcatagnnnnnnnnnnnnnnn

SEQ ID NO: 177658 - DNA, 247 bp, Homo sapiens
  misc_feature: GYAE6OF02FJ1YF.33.10.A10.1.454.CMB.1.raw
  modified_base (244)..(247): a, c, t, g, unknown or other
  misc_feature (244)..(247): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 177659 - DNA, 544 bp, Homo sapiens
  misc_feature: GYAE6OF02I954M.33.10.A10.1.454.CMB.1.raw
  modified_base (325)..(325): a, c, t, g, unknown or other
  misc_feature (325)..(325): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatcacatgatgaaaataaatactatgcggactccgtgaaggccattcatcatctccagagacaattccaagaacacgttgtatctgcaaatgaacggtgtgagacctgacgacacggctgtgtatttcngtgacgaaagtattatacgatgtatttgacttggttactcgtgtagggtgtggcgacgtgggccgagggaccgtggtcatcgtctcctcgacgcctccaccgaacgggcccacgtccgtccttccccgtcggcctaccctcctaccaacgacgccaccgtccgtcggggcaccgacgccggtcccgtcgggccgtcggcccgttacggtaccgtaacgg

SEQ ID NO: 177660 - DNA, 523 bp, Homo sapiens
  misc_feature: GYAE6OF02H3FKA.33.10.A10.1.454.CMB.1.raw
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (449)..(449): a, c, t, g, unknown or other
  misc_feature (449)..(449): n is a, c, g, or t
  modified_base (500)..(500): a, c, t, g, unknown or other
  misc_feature (500)..(500): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgatagaaaataatactatgcgactccgtgaaggccatcagcatctcaganacattccaagaacncgttatatctagactaaatgaacggtgtagacgacctgacgacacggctgtagttatttcgtgtgacgtaaagtattattacgataggtatttgaacttggttacngtaggtagggtgtggcgacgtggggccagggtaccctggtccagttcgtcnccgtcacgtccctaccgaaccgg

SEQ ID NO: 177661 - DNA, 624 bp, Homo sapiens
  misc_feature: GYAE6OF02F88DP.33.10.A10.1.454.CMB.1.raw
  modified_base (244)..(244): a, c, t, g, unknown or other
  misc_feature (244)..(244): n is a, c, g, or t
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
tcagtacacacactcacgaccggtgctcgatttagcgtcgatctcagggttcgttcgtggctcacggtcccaccaccacgcatgtgacctcaggggtccgggagatcatgagggtgtccagtgtcaggtgccagtctggtggagtctgggggaggcgtgggtccagccgtggggggtcccctgagactctcctgtcgcagcctctggattcaccttcagttactatggcatgcacgtgggtccnccaggctccaggcaaggggctggagtggctatcagtanatcacatgatgaaataatactangacgactcgagacggccattcagtcatcgtccagacgacgaattcccaagacctacgtntactctgactaagtgaacggtgtacgacgaccgtggaaccgtacgacgtcgtagttacgttacttttcgaggttacgaacggtaaagtagtttagtttaaccgatttaggtattttacggaactttggggtttaactccggtagggtaacgggggtcgtacggggaccgtaacggttcggggggacccaaccgggggttaacccctgggtacctacgttcccggttctcccgttcgaccgttccccctacccaacccggg

SEQ ID NO: 177662 - DNA, 675 bp, Homo sapiens
  misc_feature: GYAE6OF02ITCAJ.33.10.A10.1.454.CMB.1.raw
  modified_base (436)..(436): a, c, t, g, unknown or other
  misc_feature (436)..(436): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagccctcgtggtattccgtccttactacgtttactagtcggactatcgacctacggttcggggtcccgaccgaggccctccgaggacggaacggggtcgtaggggaggtggacttactacgtaagttatatacacagttgtaataagtaaaaattaaaatacttagtcggacggtacctcggtaaggaacgggccgtattcgagtcacttcctacgaagacgaactaacttaccaaagaacgtagttntactctacgaactaaagtcggtaacggtgtacgaacgtaccgtcggaaccgacgacggtcttaggtagttactttcgtgtcggaaataaagttattagtacgtattagttatttacgacgtttacgttacgttcgtagggtagggttgtcgggacgttacgggcggggtaccgaaccgggtaccgtggtaccgtacgttccgtccttacccgtcgaccgttaccctacccgaacccggg

SEQ ID NO: 177663 - DNA, 246 bp, Homo sapiens
  misc_feature: GYAE6OF02FW51U.33.10.A10.1.454.CMB.1.raw
  modified_base (244)..(246): a, c, t, g, unknown or other
  misc_feature (244)..(246): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 177664 - DNA, 565 bp, Homo sapiens
  misc_feature: GYAE6OF02HBPJI.33.10.A10.1.454.CMB.1.raw
  modified_base (337)..(337): a, c, t, g, unknown or other
  misc_feature (337)..(337): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatcacatgatgaaaataaatactatgcggactccgtgaagggccgattcagcatctccagagaacaacttccaaagaacacgttgtatctgacaaagtggaacggtgtagagacctgaccgacacggctgtgtactttcgngtgacgtaaatattatacgatgtatttgacttggtactcgtggtagggtgtggtcgacgtcgggcgacgggtacctggtcagtcgtctcctcacgtcctccgaccgacggccctacgtccgttccttccccgtcgcctaccccgtcctaccgaacgtacgacctaccgtcggtcggggacaccgacgcccggtcccgtcgggtcctcggtccgtaggtaccgtaacgg

SEQ ID NO: 177665 - DNA, 548 bp, Homo sapiens
  misc_feature: GYAE6OF02GO6X0.33.10.A10.1.454.CMB.1.raw
  modified_base (233)..(233): a, c, t, g, unknown or other
  misc_feature (233)..(233): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (464)..(464): a, c, t, g, unknown or other
  misc_feature (464)..(464): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccnccaggctccaggcaaggggctggagtggctatcagttatatcacatgatagaaaataatactatgcgactccgtagaagggcgattcagcatctccagagacaattccaagaacacgttgtatctgacaaatgaacggtgtagagactgacgacacggctgtntatttctgtgacgtaaagtntttaagtacgattgtagtttgacgttggtttactcgtaggtaggggtntgggcgtacggtggggacccgaaggggtacccctgggtaccacgttccggttcctacccgttcgacgtccctaccgaaccccgg

SEQ ID NO: 177666 - DNA, 246 bp, Homo sapiens
  misc_feature: GYAE6OF02FGGLW.33.10.A10.1.454.CMB.1.raw
  modified_base (243)..(246): a, c, t, g, unknown or other
  misc_feature (243)..(246): n is a, c, g, or t
tcagtacacacactcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 177667 - DNA, 681 bp, Homo sapiens
  misc_feature: GYAE6OF02II7R9.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatactcactatagataagtaaaaattaaatactagtcggacgtaccgtacggtaggaacgggccttaattacgagactactcctaccgaagaacgaactaactttaccgaaagtaaaccgtacgtttagtaacttacgtacgaaactaagtaggtaacggttgagaaccgtacgtacgacgaacgacggtcgttaggttatttacgtttcgtaggtacgaacgttaaagttaacttaagttacgtattaggtttaatttacgtacgtttacggtttaccttgggttagggtggggttacgtacgggtaccggttaacgggtcccgggtaaccggtacccgggtaaccgttcgggtacctacggtttcccgtccgttaccgtaccgaccgtccccgtacccggtaacccggg

SEQ ID NO: 177668 - DNA, 214 bp, Homo sapiens
  misc_feature: GYAE6OF02HVPMA.33.10.A10.1.454.CMB.1.raw
  modified_base (203)..(214): a, c, t, g, unknown or other
  misc_feature (203)..(214): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaaggactacttccagtgtgtgtactgagcgggctggcaaggcgcatagnnnnnnnnnnnn

SEQ ID NO: 177669 - DNA, 544 bp, Homo sapiens
  misc_feature: GYAE6OF02IDLUK.33.10.A10.1.454.CMB.1.raw
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (462)..(462): a, c, t, g, unknown or other
  misc_feature (462)..(462): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgatgaaaataatactatgcgactccgtgaagggccattcagcatctccagacgacaattccaaagaactacgttgtaactctagactaaatgaacggtgtagagtacctgaacgacacggctgtnttacttctgtgacgtaaagtnttattacgattgtatttgacttgggttaactgtaggngggttagtggcgtacggtggggccaacggggtaccctgggtactagttccggtcctacccgtcacgtccctcccgaacccgg

SEQ ID NO: 177670 - DNA, 205 bp, Homo sapiens
  misc_feature: GYAE6OF02HDOTW.33.10.A10.1.454.CMB.1.raw
  modified_base (200)..(205): a, c, t, g, unknown or other
  misc_feature (200)..(205): n is a, c, g, or t
tcagtacacacactcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccagtgtgttactgagcgggctggcaaggcgcatagnnnnnn

SEQ ID NO: 177671 - DNA, 621 bp, Homo sapiens
  misc_feature: GYAE6OF02G2PZ3.33.10.A10.1.454.CMB.1.raw
  modified_base (334)..(334): a, c, t, g, unknown or other
  misc_feature (334)..(334): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgaatagaaaataatactatgcggactccgtagaacgggcattcagcatctcaganacaattcccaaagacagttagtactctggacaaagtcgaacggtgtacgacgacctggaaccacgtacggtcgtgttgttatttcgtgtacgacgtaaagtatttaagttacggtattacggtaagtttttcgaacgtttcgggtttaaccttcggttagggttaacgggggttggttacgggaccggttacggtacggggggaccctaaacggggggtaaccccttggggtacctaaggttcccggttccttacccgacggtaccgtcccgtacccctaacccggg

SEQ ID NO: 177672 - DNA, 625 bp, Homo sapiens
  misc_feature: GYAE6OF02IJD8Z.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcacgtcgggtcccgccaggctccgaggcgaaggggctggagtggctatcagttatatcacatgataagaaaaattaaatactagtgacggtactccggtaggaacgggccgtattcagcatcctaccgagacaactaattaccaaagaactagttagtatctagaactaaagtaggaacgggttgtacgacgtacctaggaaccgaaccgacggtcttggttagtttactttcgtaggtacggaacgtaaagttatttaacgttaacgattaggttactttaggactttaggttaccttggtagggtaggggttgtgggcgtacgggtcggggacctaacgggtaccctgggtacctacggttccgtacctcccgtacgaccgtccccgtaccgaacccgg

SEQ ID NO: 177673 - DNA, 656 bp, Homo sapiens
  misc_feature: GYAE6OF02I75M2.33.10.A10.1.454.CMB.1.raw
  modified_base (276)..(276): a, c, t, g, unknown or other
  misc_feature (276)..(276): n is a, c, g, or t
  modified_base (327)..(328): a, c, t, g, unknown or other
  misc_feature (327)..(328): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (483)..(483): a, c, t, g, unknown or other
  misc_feature (483)..(483): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctcctgtgcagcctctggattcaccttcagttactatgcatgcacgtcgggtccgccaggcctccaggcgaaggggctggagtggctatcagttanatcacatgatagaaaataatactatgcggactccgtagaacggcgattcannactctacaagagaacaacttaccaaaagaactacgttagtattactagaacaaagttggaaacgggtgtaaggaacgtacccgtagaacgtaaccgacggtnttaggtacgtttntttaccgtgtacggtaaacgtaaaagttaacgtttttaanaaccggtagttagtaacgtttttggaacgttttacggtttaccgtcggttaggtacgggggttagtaggggaccgtaaccgggttaccgggggcccgtaaaacggggtacccgttggtaccgtacgttcccgttacctcccgttaggacccttaccccgtacccaacccgggg

SEQ ID NO: 177674 - DNA, 597 bp, Homo sapiens
  misc_feature: GYAE6OF02GCNS6.33.10.A10.1.454.CMB.1.raw
tcagtacacacactcacgaccggtgctcgatttagcgtcgatctcaggggtccctgagactctcctgtgcagcctctggattcaccttcagttactatggcatgcactgggtccgccaggctccaggcaaggggctggagtggctatcagttatatcacatgatagaaaataatactatgcggactccgtgaagggccgattcagcatctccagagacaattccaagaacacgttgtatctgcaaatgaaacggtgtgagacctgacgacacggctgtgtatttctgtgacgaaagtattattacgatgtatttgacttggttactcgtggaggggtgtggcgacgtggggaccaggggtaaccctgggtcacgttcgtctcctcacgccctccaccgaacgggcccacgtccggtcccttcccccgtcggccctaccccttccctacccgaacgtcgccaccgtccggtcggggccacgacggcccggcccgtcgggccgtcggccgtcgggtacgaacggtaccttaccttccgtaggttcgtggttccggttacgtcggacggtccggggtcgtcgggacgtacgggccgtacg

SEQ ID NO: 177675 - DNA, 732 bp, Homo sapiens
  misc_feature: GYAE6OF02JD0JK.33.10.A10.1.454.CMB.1.raw
  modified_base (285)..(285): a, c, t, g, unknown or other
  misc_feature (285)..(285): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtgggggtccctgagactctcctgtgcagcctctggattcaccttcagttactatggcatgcacgtcgggtcccgccgaggcctccgaggcgaaggggctgggaggtggactatcgtaagttanataccacagtgaataagtaaaataaaagtactaatggaccggactccggtaaggaacgggccgtattaccgagcctagtccctaccgaagtacgaactaaactttaccgaaaagtacctaacgttataacttaccgtagtaacgtaaaacgtacggtaaacggtaggttaacgaacgtaaccgtacggaacggaaccgtaacggcctttaggtagtttaacttttcgtaggtttacggaaacgtaaaagttcgtttaaacgtttacgaagtttacggttaagttttcgaaccgttttacggggttaacttcgggtaagggttacggggttcggtacgggacggttacgggtaccggggtacccgtaaaccggggtaccccttggggttaactacggttaccccggtcttccccgacgtaccgttacccccgtaccgtaaaccccggg

SEQ ID NO: 177676 - DNA, 577 bp, Homo sapiens
  misc_feature: GYAE6OF02GXRJ7.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattcaccttcagttactatggcatgcacgtgggtccgccaggcctccaggcgaaggggctggagtggctatcagttatatcacatgatagaaaataatactatgacgactcgtagacggcatcagcatctacagacgacaatcaagaactagttagtatctgacaaagtcgaacgtgtgaacgtacctaggaaccgacgacggtctggtagttactttcgtgtacgacgtaaagtatttaagttaacgattagtatttacgacgtttaggttacctcgtagggtaaggggttgtgggccggtaacggtcgggggaacccaaggggtaccccgtgggtacctaggttccgttactcctccgacgtccctaccgaacccgg

SEQ ID NO: 177677 - DNA, 591 bp, Homo sapiens
  misc_feature: GYAE6OF02FOYUS.33.10.A10.1.454.CMB.1.raw
  modified_base (234)..(234): a, c, t, g, unknown or other
  misc_feature (234)..(234): n is a, c, g, or t
  modified_base (506)..(506): a, c, t, g, unknown or other
  misc_feature (506)..(506): n is a, c, g, or t
tcagtacacacactcacgaccggtgctcgatttagcgtcgatctcagggtcttcgtggctcacgtccaccaccacgcatgtgacctcaggggtccggagatcatgagggtgtccagtgtcaggtgcatctggtggagtctgggggaggcgtggtccagcctggggggtccctgacgactcgtcctgtgcagcctctcggattcaccttcagttactatggcatgcactggtccncaggctccaggctaagggctggagtggctatcagttatatcgactagtgagtagaaaataagtactatgacggtactcggtagaacgggtccgaaaattcgagtcatctacagagactaacttaccgaagtaactacgttagtactctagacaagtgaacggtgtagacgtacgtcgacgacgacggtcgtgtacgttagtttcgtgttacgacggtaatattagttaacgtataggtatttagtacgttaggttactcgtggtaggggttntagggtacgtacggtgggtaccgtacgggtacccgtggtacgtacgtccgtcgttaccgtcgtaccgtcccgtaccgtaacccgg

SEQ ID NO: 177678 - DNA, 778 bp, Homo sapiens
  misc_feature: GYAE6OF02H05I1.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccaggccgtggggggtccctgagactctcctgtgcagcctctggattcaccttcagttactatggcatgcacgtcgggtccgccaggctccgaggcgaaggggctgggagtcggctagtcgtaagttatatcaacatagaataagaaaaattaaatactagtcggaccggtacctccggtaggaacgggccgtaattccgagctactcctaccgaaggtaacgaacctaactttaccgaaaacggtaaacctacgtttagtaacttaccgtagtaaacgtaaaggttacgggtaacgggttgtacggaaaccggtaccctaacgggaacccgaaaccggtaccgggtctttacgggttagtttaacttttccggtagggtacggtaaaccggttaaaaggttactttaaacggttaacgtagtttacgtttaacgttttacggttaacgtttacgggtttaccgttggggttagggggtagggggtttacgtacggggtaccgggttacggggtacccggggggtaacccggtaaaccggggttaccccggttagggttacccgtaacggttccccggttccttaccgtacccgtaacccgtcccccgtacccgtaaaccgg

SEQ ID NO: 177679 - DNA, 677 bp, Homo sapiens
  misc_feature: GYAE6OF02H910T.33.10.A10.1.454.CMB.1.raw
  modified_base (240)..(240): a, c, t, g, unknown or other
  misc_feature (240)..(240): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattccaccttcagttactatggcatgcacgtcggggtcccnccaggcctccgaggcgaaggggctgggagtggctatcaagttatatcactatgaagtaagaaaaattaaatactagtgaccggactccgtagaagggcctattcagcatccacctagacaactaattaccaaagaactacgttagtatcgtagactaaagtggtaacgggtgtagacgtaactaggaccgtaacgacggtacttggtagtttacttcgttagacggaacgtaaaagtatttacgtaacgtagttacgtagttttcgacgtttacggttaaccgttacggtggggttaaggggtcggttacgggccggtaaccgggtcgggggtaacccgtaaacgggggttaacccccgtttggggtaaccctaaggtttccccggttcccgtttaccccgtacgtaaccggtcccccccttaacgaaacccccggg

SEQ ID NO: 177680 - DNA, 201 bp, Homo sapiens
  misc_feature: GYAE6OF02IYAYO.33.10.A10.1.454.CMB.1.raw
  modified_base (193)..(201): a, c, t, g, unknown or other
  misc_feature (193)..(201): n is a, c, g, or t
tcagtacacacactcacgaccggtgctcgatttagcgtcgatctcagggtccggagatcatgaggtgtccttgggtttggggaagaggaagactgacggtccccaggagttcaggtgctggcacagcggccctggctgcctggtcaaggactacttccagtgtggtactgagcgggctggcaaggcgcatagnnnnnnnnn

SEQ ID NO: 177681 - DNA, 209 bp, Homo sapiens
  misc_feature: GYAE6OF02FSF13.33.10.A10.1.454.CMB.1.raw
  modified_base (202)..(209): a, c, t, g, unknown or other
  misc_feature (202)..(209): n is a, c, g, or t
tcagtacacacactcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccagtgtgtgtactgagcgggctggcaaggcgcatagnnnnnnnn

SEQ ID NO: 177682 - DNA, 204 bp, Homo sapiens; identical to SEQ ID NO: 177656
  misc_feature: GYAE6OF02FQDLY.33.10.A10.1.454.CMB.1.raw
  modified_base (203)..(204): a, c, t, g, unknown or other
  misc_feature (203)..(204): n is a, c, g, or t

SEQ ID NO: 177683 - DNA, 605 bp, Homo sapiens
  misc_feature: GYAE6OF02IFH5N.33.10.A10.1.454.CMB.1.raw
  modified_base (414)..(414): a, c, t, g, unknown or other
  misc_feature (414)..(414): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcacgtcgggtccgccaggcctccaggcaaggggctggagtggctatcagttatatcacatgatagaaaataatactatcgacggacctccggtagaaacgggcctaattccagcatcctccaagagaacctaaattaccaaaggtaactacggtttagtacttctaggactaaagtcggaaacggttggtanaacgcctagaccgacgacgggcttgtgttatttctggtagacgtaaaagtatttaacgtacgattacgtagttttacgagtttcggtttaactcggtagggtaggggtgtcgggcgtaacggtcgggggacctaacggggtaacccttggtacacgttcgtacctccgactaccggtccctacccaaccgg

SEQ ID NO: 177684 - DNA, 699 bp, Homo sapiens
  misc_feature: GYAE6OF02G302C.33.10.A10.1.454.CMB.1.raw
  modified_base (313)..(313): a, c, t, g, unknown or other
  misc_feature (313)..(313): n is a, c, g, or t
  modified_base (508)..(508): a, c, t, g, unknown or other
  misc_feature (508)..(508): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagtagctatgacatgcacgtggtccgaccgaggcctccgaggacgaagggactgggagtgggtgctagttgttacgaaagtgaataggaaactaagaacactangcaagtacctcgtagaacgggcctagttccgaccgttcaccgagaacgaactaacttaccaaaagtaaccttacgtttgttaactgaactaaagtacgaactagtaccgtaggaacgtacgacgtaggaacggtaacgtacgggtcttaggttaacggttaactttacggtggggtaacggggtaggggttaacncggtaaggtgggacttaagggtttactagggtacgtaaccggtggggacccgtaaccgggtacctcgggtaccctaccgttcgtaacccgttacggaccgttaccccgtaccgaaaccggtacccgggcccttaaccgggttccccgtttaccccgtacccccgtaggtacccccgtaacccccgtacccg

SEQ ID NO: 177685 - DNA, 692 bp, Homo sapiens
  misc_feature: GYAE6OF02I9ZIJ.33.10.A10.1.454.CMB.1.raw
  modified_base (233)..(233): a, c, t, g, unknown or other
  misc_feature (233)..(233): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattcaccttcagttctatggcatgcactgggtccnccaggctcgaggcgaagggctggagtggctatcgagttatatcacatgatagaaaataatactagtagacggaactccggtaggaacgggcctattaccgagctacttaccgacccgtaagtaacgtaacctaaacgtttacccgaaaagtaaacgttaaccggtttacgtaactttaccgtaacgtactaaaaacgtcggtaaacgggttacgttaggaacggtaacccgttacggaaccgtaacgtaaccgggtcctaggttgttaacgtttccgtaggtcgaacgtaagttaattaagttacgaagttgttagtttacgagttacggtttaatcggttagggtagggtacgggttcggtcgggttaacggcggggtaccggtaacgggtaacccgttggtaccgtaccgtttaccggtccgtacccgtagtacccggtaccctacccgtaacccgg

SEQ ID NO: 177686 - DNA, 680 bp, Homo sapiens
  misc_feature: GYAE6OF02I3ICM.33.10.A10.1.454.CMB.1.raw
  modified_base (308)..(308): a, c, t, g, unknown or other
  misc_feature (308)..(308): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctgggtggagtctggggggaggcgtggtccagccgtggggggtccctgagactctcctgtgcagcctctggattcaccttcagttactatggcatgcacgtgggtcccgccaggcctccgaggcgaaggggctgggagtggctatcagttatatcacatgaatagaaaaataatactanggcgactcggtagaagggcccattcgagccatcctaccaagacgaactaacttaccaaaagaaccttagttataacttccgtagaactaaagtcgggtaacggttgtacgaacgtaccgtacggaaccggtacgaccgggtacttggttagttacttttcggtaggttacggaaaccggtaaaagttaatttagttaaccgtaagtttaacggttagttttaacgggtaccgttttaggtttaaccgttacgggttagggtaaggggttcgggtacgggtaccggtacgggtccgggggaccgtaccggggtaaccgtcggtacgtacgttccggtcctacccgtacgtaccgtcccctacccgaacccggg

SEQ ID NO: 177687 - DNA, 706 bp, Homo sapiens
  misc_feature: GYAE6OF02HXL3H.33.10.A10.1.454.CMB.1.raw
  modified_base (283)..(283): a, c, t, g, unknown or other
  misc_feature (283)..(283): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagtttactatggcatgcactgggtccgcaggctccaggcaaggggctggagtggctatcagttatatcacatgatagaaaataatactatgcggactcgtgaacggccattcagcatctcagagactaattccaagaactacgttgtaactntgacaaatggaacggttgtagaacgtacctgaccgaacgacggtcttggtatagtttccgtgtagacgtaaagtatttaagttacgattcgtattttacggactttgggtttactcgttagggtaggggtggttgggcggtacggtcggggtaccgtaacggggtacccgttgggtactacgtaccgtttcctccgtccgtacgtccctacccgtaacgaaccgggtaccctacggttcccggttccccgttacccccgtccggtaccccgtaccccgttccccgtaaccgaaccggtaccgtacccgtacccggttaccgggttaccgggggtacccgaacccggttaaccggtccccggggtaccccggttccggggtccgttacccgggtaccggttaccgggtaccgttaaacccgggg

SEQ ID NO: 177688 - DNA, 679 bp, Homo sapiens
  misc_feature: GYAE6OF02H0T65.33.10.A10.1.454.CMB.1.raw
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctggggggagcgtggtccagccgtggggggtccctgagactctcctgtgcagcctctggattcaccttcagttactatggcatgcacgtcgggtccgccgaggctccgagggacgaaggggctgggagtggctatcaagtttatactcaactatacgaataagaaaaattaaatactagtcggacggtactccggtaggaacggccgtaattcgacgtcactacctaccgagacgtaactaacttaaccgaaagtaactacgttataactcgtanactaaagtggaacggtntacgacgtaccgtaggacgaacgacggtctagttagttactttcggagtacgaacgtaaagttacgtttaacgtacgtaatacggttactttcggtaaccgtttgggttttaacctgggaggggttaacgggttcggtacgggaccgtcggggtaacggggacccgtaacggggtaaccccttgggtaaccctcgttacccggttcccaccgttaccggacccgttaccccgacccgtaaacccgggg

SEQ ID NO: 177689 - DNA, 250 bp, Homo sapiens
  misc_feature: GYAE6OF02HWUSG.33.10.A10.1.454.CMB.1.raw
  modified_base (246)..(250): a, c, t, g, unknown or other
  misc_feature (246)..(250): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccagtgtgtgtactgagcgggctggcaaggcgcatagnnnnn

SEQ ID NO: 177690 - DNA, 530 bp, Homo sapiens
  misc_feature: GYAE6OF02FTPBB.33.10.A10.1.454.CMB.1.raw
  modified_base (339)..(339): a, c, t, g, unknown or other
  misc_feature (339)..(339): n is a, c, g, or t
  modified_base (429)..(429): a, c, t, g, unknown or other
  misc_feature (429)..(429): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaagggctggagtggctatcagttatatcacatgatagaaaataaatactatgcggactccgtgaaggccattcagcatctcagagacaattccaagaacacgttgtatctgacaaatgaacggtgtgagaccgtgacgacgacggctgtgtatttctgtgacgaaagtntttaattacgattgatttgacgttggttactcgtgtaggggtgtggcgtacgtgggccgtacgggacccgtggtcgtattcgtctcctcncgcctccaccgacggccacgtccgtcctccccgtcgccnccctccncacncgccnccgtcgngggcncgacgccggcccgtggcctcgccgtgacgtacgg

SEQ ID NO: 177691 - DNA, 208 bp, Homo sapiens
  misc_feature: GYAE6OF02FLSIF.33.10.A10.1.454.CMB.1.raw
  modified_base (204)..(208): a, c, t, g, unknown or other
  misc_feature (204)..(208): n is a, c, g, or t
tcagtacacacactcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccagtgtgtgtactgagcgggctggcaaggcgcatagnnnnn

SEQ ID NO: 177692 - DNA, 669 bp, Homo sapiens
  misc_feature: GYAE6OF02IUSK5.33.10.A10.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagcctggggggtccctgacgactctcctgtgcagcctctggattcgaccttnagttactatggctatgcactcgggtccnccaggctccgaggcgagggctggagtggctatcgagttatancacatgataagaaataatactatgcgtactcgtgaagggccatcagcatcacagacgacaacttacgaagtaaacacgtttaagacttacgtacgacgaaaagtcggaacggttcgtagaaccgtactacggaaccgtacgaacgggtctaggttacgtttacgtttacgtaggttacgtacggtaaaagtacttaacgtttacggattaacggtactttaggtaccggttacggtttaccgttcggttaggtaacggggggttatcgggtacgtaacgggttcggggtaaaccccgggtaacggaacccgggtttaggtacccgttaaggtccccgggtttaactttccccggaggttaacccgggtcccccttaaccggtaaccccggg

SEQ ID NO: 177693 - DNA, 637 bp, Homo sapiens
  misc_feature: GYAE6OF02GIPLQ.33.10.A10.1.454.CMB.1.raw
  modified_base (475)..(475): a, c, t, g, unknown or other
  misc_feature (475)..(475): n is a, c, g, or t
  modified_base (535)..(535): a, c, t, g, unknown or other
  misc_feature (535)..(535): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcacgtgggtcccgccaggcctccgaggcgaaggggctggagtggctatcagttatatcactatagatagaaaataatactatgcgtactcgtagaacggccgtattcagctatcctacagacgaactaacttaccaaagtaactacgtttagtactcgtagactaaagtcggaacgggttgtaggaacgtaccgtaggaaccgaaccgacggtcttggttagtttactttcgtggttaacgacgtaaaagttnttttaacgtaacgtattaggttatttaggtacgttggttacttcggtagggtaggggttntcgggtcgtacgggtcggggaaccgtaaccgggtacccgtggttacctacggtcccgtttccgttaccgtaccggtaccgtaccccgtacccgtaacccggg

SEQ ID NO: 177694 - DNA, 672 bp, Homo sapiens
  misc_feature: GYAE6OF02HZUFQ.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcacgtcgggtcccgccaggcctccgaggcgaagggggctgggagtggctaatcgtagttatatcacatgataagaaaattaaatactagtcgcggacctccggtaggaacgggctattcgagcatctcagacactaataccaaagactacgttatatctagactaaagtgaacggtgtagacgaccgtgaacgaccgtacggtcttaggttagttactttcgtaggttacgaaacggtaaagttatttaacgtttaagtagtttagtacgttttacgtacggtttacggtttaacttcggtaggggtaacgggggttcgggttacgggtaccggtacgggtacggggggaaccccgttaacggggtaaccccgttgggtacctaacggtttcccgttacccgttccccggtaccccgggtaccctaccccggtaaccggtaacccggg

SEQ ID NO: 177695 - DNA, 209 bp, Homo sapiens
  misc_feature: GYAE6OF02FLL1M.33.10.A10.1.454.CMB.1.raw
  modified_base (204)..(209): a, c, t, g, unknown or other
  misc_feature (204)..(209): n is a, c, g, or t
tcagtacacacactcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccagtgtgtgtactgagcgggctggcaaggcgcatagnnnnnn

SEQ ID NO: 177696 - DNA, 676 bp, Homo sapiens
  misc_feature: GYAE6OF02HGRBE.33.10.A10.1.454.CMB.1.raw
  modified_base (275)..(275): a, c, t, g, unknown or other
  misc_feature (275)..(275): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgcaggctccaggcaaggggctggagtggctatcagttatatcacatgatagaaaataatactatgcgtactcgtagaacggcatcagcatccacagagacaattccaaagactacgttntatctgacaaagtggaacggtgtagacgtacctggaaccgacgacggtcttaggttattacgttttcgtggtacgaacggtaaaagttatttaacgttacggtaattgtaacgttttacggtaacgtttagggtttaccttcggttaggggtacggggttggtcgggtaccggtacgggtcggggaccgtacggggtacccgttggtactacgttccgtacctcccgtacgaccgtccctaccgaacccggaaccgggtccctacggttccccggttaccccgttcccccgtccggtccctaccccgtcccgtaccgaacgccgtaccgtcccgttcgggtccgggaccaaccggtccggcccggtccggtcggccgtcgtccggttcggaccgtaaccgg

SEQ ID NO: 177697 - DNA, 212 bp, Homo sapiens
  misc_feature: GYAE6OF02H0UDT.33.10.A10.1.454.CMB.1.raw
  modified_base (205)..(212): a, c, t, g, unknown or other
  misc_feature (205)..(212): n is a, c, g, or t
tcagtacacacactcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccagtgtgtgtactggagcgggctggcaaggcgcatagnnnnnnnn

SEQ ID NO: 177698 - DNA, 615 bp, Homo sapiens
  misc_feature: GYAE6OF02FY371.33.10.A10.1.454.CMB.1.raw
  modified_base (430)..(430): a, c, t, g, unknown or other
  misc_feature (430)..(430): n is a, c, g, or t
  modified_base (466)..(466): a, c, t, g, unknown or other
  misc_feature (466)..(466): n is a, c, g, or t
tcagtacacacactcacgaccggtgctcgatttagcgtcgatctcagggtcttcgtggctcacgtccaccaccacacatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcacgtgggtcccgccaggcctccgaggccgaaggggcctggagtggctagtctagttatatacacatgaatagaaaattaatactagtgcgtactccggagaacgggccattcagcatcctacagacactaacttaccaaagaactacgttgtactcgtagaactaaagtggtaacggtgacggacgacctaggaacgaccacgggtnttggtattacgtttcgaggttcgaaacgtaaagttntttaacgttagattaggtatttggacttggttactcggtagggtagggtgtcggacgtcgggtacggggaacccggtaacgggtaaccccgttgggtacctacggttccgttacccgtccgtactacccggtcccctaccggaacccgg

SEQ ID NO: 177699 - DNA, 554 bp, Homo sapiens
  misc_feature: GYAE6OF02GF35W.33.10.A10.1.454.CMB.1.raw
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagcctggggggtccctgagactctcctgtgcagcctctggattcaccttcagttactatggcatgcacgtgggtccgccaggcctccaggcaaggggctggagtggctatcagttatatcacatgatagaaaataatactatgacggactccggtagaacgggccattcagcatcncagagacataccaagactacgttntatctagacaagtcgaacggtgagacgcctagacacgacggctgtagttatttcgtgtgacgtaagtatttagtacgtagtgtatttgacgttggtttactcgtggtaagggttgtcgggtacgacggtcggggacctaacggggtacccgtggtacgtacgttcgtcctaccgtcgtccgtccctaccgtaacccgg

SEQ ID NO: 177700 - DNA, 730 bp, Homo sapiens
  misc_feature: GYAE6OF02GPORQ.33.10.A10.1.454.CMB.1.raw
  modified_base (233)..(233): a, c, t, g, unknown or other
  misc_feature (233)..(233): n is a, c, g, or t
  modified_base (296)..(296): a, c, t, g, unknown or other
  misc_feature (296)..(296): n is a, c, g, or t
  modified_base (374)..(374): a, c, t, g, unknown or other
  misc_feature (374)..(374): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctgggggtccctgagactctcctgtgcagcctctggattcaccttcagttactatggcatgcacgtgggtccncaggctcaggcagggctggagtggctatcagttatatccatatgataagaaaataaatcgtanggaccggacttccggagaacgggtcattcgagactatccacgaagagtactaaactttccgaaagtaactacggtttntactcgtacgaacctaaagttgggaaaccggttgtacggtacggaaccgtaccgggtaaaccgtacgtaaccgggttccttaggttacggtttacttttaccggtggttaaggaaacccgttaaagggttactttttaacgtaacggtacgtttaacgggttaagtttttaacgtaccggtttcggtttaaccgtttcggttaacgggggtaagggggtttcggttaacggggtcccggtaacggggtttacggggaacccctaaccggggggtaacccctttggggttaaccctcggtttacccgttcccggtacccttaccgggaacccttcccggtaacccctaaccccgggg

SEQ ID NO: 177701 - DNA, 652 bp, Homo sapiens
  misc_feature: GYAE6OF02FL1G5.33.10.A10.1.454.CMB.1.raw
  modified_base (157)..(157): a, c, t, g, unknown or other
  misc_feature (157)..(157): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccnccaggctccaggcaaggggctggagtggctatcagttatatcacatgatagaaaataatactatgcggactcgtagaacgggccattcagcatctcagagactaattaccaagaacacgttgtactctagactaaatcggaacggtgtggagacctcgacgacgacggctgtgttactttntgtnacgtaaagtacttatacggtatgtatttgacgttgtttaactcgttggtaggggttgtggtacgtacggtcgggaccgacgggtaccgtcggtacgacgttcgtacttcccgtcgaccgtcccttaccgaaccgtaaccggggtacccctacggttccccgggttccctttacccccgttacggtccctaccccgttacccttacccgtaaacgtccgtacccgtaccgtccggtacggggaccaaccggttacggcccggttcccggtcgggttccgtccggtacccgtacgggttaccgtaaaccggg

SEQ ID NO: 177702 - DNA, 677 bp, Homo sapiens
  misc_feature: GYAE6OF02GT256.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcaacctctggattcaccttcagttactatggcatgcactgggtccgcaggctccaggcaagggggctggagtggctatcagttatatcacatgatagaaaataaatactatgcggactccgtagaagggccattcgagcactctccagagacaacttccaagaactacgttagtactcgtagacctaaagtagtaaccggttggttacggacgtaacccgtggaaacccgtaacgaccgggtaccttaggttcgttattttccgtaggttagacgtaaagtatttaacgtttacgaagtttggtaaagttttacggtaacgttagggtttaaccttcgttaggggtaacggggggtttgtacggggtccggtaaccggttcgggggggaacccgtaacggggggttaaaccccttcggggttaacctacggtttcccggttacctttcccgtaccaccggtccccttacccgaaccccggtaaccccggg

SEQ ID NO: 177703 - DNA, 563 bp, Homo sapiens
  misc_feature: GYAE6OF02GT0VW.33.10.A10.1.454.CMB.1.raw
  modified_base (405)..(405): a, c, t, g, unknown or other
  misc_feature (405)..(405): n is a, c, g, or t
  modified_base (472)..(472): a, c, t, g, unknown or other
  misc_feature (472)..(472): n is a, c, g, or t
  modified_base (548)..(548): a, c, t, g, unknown or other
  misc_feature (548)..(548): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattcaccttcagttactatggcatgcacgtgggtcccgccaggctccaggcgaaggggctggagtggctatctagttatatcacagtgaatagaaaaataatactagtgcgtactccgtaggaacgggccattcagcatctaccaagacgaactaactttaccaaagtaactacgtttagtactcgtagacaaagtcggaacgggtntacgaagtacctaggaccgacgacggtcttgtagtttacttcgtggtagacgtaaatctttatacgntagtatttgattgttactgtggtagggtgtggcgacggtcgggaccgaggtaccctggtctagtcgtctccgtacncgtccctacacccgg

SEQ ID NO: 177704 - DNA, 644 bp, Homo sapiens
  misc_feature: GYAE6OF02G4D0E.33.10.A10.1.454.CMB.1.raw
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
tcagtacacacactcacgaccggtgctcgatttagcgtcgatctcagggtcttcgtggctcacgtccaccaccacgcatgtgacctcaggggtccgggagatcatggagggtgtccagtgtcaggtgcatctggtggagtcgtgggggaggcgtggtccagccgtggggggtccctgagactctcctgtgcagcctctggattccaccttcagttactatggcatcgcacgtcgggtccgccgaggcctccgaggcgaaggggcgtggagtggctatcagttatatcanatagataagaaaataaatactangacggactcgtaggacggctactnacgcactctacaganaactaattacaaagtaactacgttatatactagactaagtacggaacggtgtacgaacggacctagaaccgaacgacggtcttggttattaacgtttgacgtagaaccgtaaataacgtttaagtacgtaagttagttacttttacggaacgttttacggtttaacttcgggtaagggttgggggttacgtaggggtaccgttacgggtacgggggacccggtaacgggtaaccccgtggtaccgtacgttcccgtacctcccgttaccgaccgtccccgtacccgaacccgg

SEQ ID NO: 177705 - DNA, 642 bp, Homo sapiens
  misc_feature: GYAE6OF02F1MD8.33.10.A10.1.454.CMB.1.raw
  modified_base (448)..(448): a, c, t, g, unknown or other
  misc_feature (448)..(448): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatgcacgtgggtccgccaggcctccgaggcgaaggggctggagtggctatcagttatatcactatgatagaaaaataatactatggacggactcgtaggaacgggcctattcagcactccaccagacgaacaattaccgaaaagtaacctacgttagtaactctagacaaagtcggaaacggttgtagaacgaccgtgaacgacgacgggtcttagtgtttactttcgnggtagtaacgaaattatttaagttaacgattaggttattttcggaacgttttcgggtttaacctcggttggggtagggggttcgtcggggtaccgacgggtcgggggacccgtaacggggttaaccccttgggttaccctacgtttcccggttccttacccgtacgaccgttcccccgtacccgtaaccccggg

SEQ ID NO: 177706 - DNA, 632 bp, Homo sapiens
  misc_feature: GYAE6OF02GKFZT.33.10.A10.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (367)..(367): a, c, t, g, unknown or other
  misc_feature (367)..(367): n is a, c, g, or t
  modified_base (440)..(440): a, c, t, g, unknown or other
  misc_feature (440)..(440): n is a, c, g, or t
  modified_base (610)..(610): a, c, t, g, unknown or other
  misc_feature (610)..(610): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattcaccttnagttactatggcatgcacgtgggtccnccaggcctcaggcaaggggctggagtggctatcagttatactcacatgatagaaaataatactaatgcggtactaccgtggaacgggccattcagcatctccgagacgactaacttccaaagtaacacgttntacttacagtactaaataggaacggtgtacgagtacctggaccgacgacggtacttggtagtttactttccgnggttacgaaccggtaaagttacgtttaagttaaccgtaggttagttaacgttttacggtaactttcgggtttaacttacggtgggttaagggggttcgtacgggccgtacgggtcggggtacgaaccgggtaaccccgtggttaccgtacgtccgttaccgtccgtaccncggtacccctaccgtaacccgg

SEQ ID NO: 177707 - DNA, 678 bp, Homo sapiens
  misc_feature: GYAE6OF02GQTPR.33.10.A10.1.454.CMB.1.raw
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttactatggcatcgcacgtcggggtccgccgaggcctccgagggcgaaggggctaggagtggctatcagttatatcactatgatagaaaataatatagcggacgtactcggtaggacggccgtatcagcactccacgagacgaacaacttaccgaaagtaaccgtacgtttgtactcgtacgactaaagtcggaacggttgagacgtacctaggaaccgcgtaccggtnttaggtnttacgtttcggagtacggaaacgttaaaagttactttaacgttacgtaagtttacgttaagttttacggacgtttacgggtttaacgtcggttagggggtaaggggtttcggtacggccgggttaaccgggtcggggggtaacccgaaccgggggttaaccctcgggttaccttacggtcccggtttaccctacccgtaccggtacccgtaccccgtacccgggtaacccggg

SEQ ID NO: 177708 - DNA, 575 bp, Homo sapiens
  misc_feature: GYAE6OF02FQ20P.33.10.A10.1.454.CMB.1.raw
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (463)..(463): a, c, t, g, unknown or other
  misc_feature (463)..(463): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattccaccttcagttactatggcatgcacgtgggtccgcaggctccgaggcgaaggggctgggagtggactagtctagttatatcgacatgaatagaaaaataatactatgcgactcgngaaggccatnancatcacgaganactaactacaaacgaactacgttgtaactcgtagtaacaaagttagggtacggtagtaggaacgtaccgtaggaaccgacgacggtcttagtcgttattcgtagtgacgaaatattagttanagtagttattgtagttcgttagtgtagggtagggtggtgacggtacggtcggggaccgtacgggtacccgtgtccgtacgttcgtacgtccacgtccgcctacccgaaccgg

SEQ ID NO: 177709 - DNA, 716 bp, Homo sapiens
  misc_feature: GYAE6OF02ILY0L.33.10.A10.1.454.CMB.1.raw
  modified_base (169)..(169): a, c, t, g, unknown or other
  misc_feature (169)..(169): n is a, c, g, or t
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
  modified_base (530)..(530): a, c, t, g, unknown or other
  misc_feature (530)..(530): n is a, c, g, or t
tcagtacacacactcacgaccggtgctcgatttagcgtcgatctcagggtccgttcgtggctcacgtccacccaccacgcagtgtgacctcaggggtccctggagactctcctgtgcagcctctggacttcaccctttcagttactagtggctagtgcactgggtaccnccaggctccaggcaaggggctggagtggctatcagttatatcacntgatagaaaataatactagtcgacggtactccggtaggaacgggcctattcagctagttcctaccagacgaacctaattccaaagtaacctaccgtttanacttcgtaggactaaagtggtaacggtgtagacgtaccctagaaccgaccgtacggtcgttgtacgtttactttcgaggtacgaaccgtaaaggtctttaacgttacggtattacgttactttacgtacggtttagtttaccgtggttaggggttagggttggcggtacgtcgggtaccgggaccgaacggtccgtgtactacgttccgtcctccncgcctaccctaccgaaccggacccgtaccttaccggttcccgttacccctttccccgaccgtacccctacccgtaccctaccgaagcccgtaccgtacccgggtcgggtaccgggaccctaccgggtacccggtccccgggtccggttccggtaccggtccggtccgttaccgggaacccgtacgg

SEQ ID NO: 177710 - DNA, 849 bp, Homo sapiens
  misc_feature: GYAE6OF02HTBG9.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgaggtgtccagtgtcaggtgcatctggtggagtcgtgggggaggcgtggtccagccgtgggggtccctgagactctcctgtgcagcctctggacttcaccttctagttactagtcggctatcgacctacgtcgggtcccgaccgacggtcctaccgagggacggaacgggggtccttaggggaacggttgggacttaacgtaccgtaagttttaagtaactccgtaactaagtacggtaattaaaaggtaaaaaacttaaaacgttaactaagttcgggaccggtaaccgttaccgggtagggaaaccggggtaccgtaacgtttaccgaacgtaccgtaacttccctaccgtaaacggaacgtaaaccctaaacgtttaaacccgaaaaacggtaaaccgtttaacgggtttacttaacgttacgtacgaaacctaaaggttacgggtaaacgggttggtaaggtacccgaacccgtacggaacccggaaacgtcgggtcgttaggttagtttaccgtttcgtaggtaaccgtaacgtaaaagttacctttaaaggttacgtaagtttacgttaagtttaccggttaacgtttacggtttaccgttggtagggggttaggggttatccggggtacggtaacggggtcccggggtaacccgggtaccggggtacccgttaggttacctaccgggtttccgtccctttacccgtaccggccgttcccccgaacccggaacccggg

SEQ ID NO: 177711 - DNA, 583 bp, Homo sapiens
  misc_feature: GYAE6OF02GQPPU.33.10.A10.1.454.CMB.1.raw
  modified_base (413)..(413): a, c, t, g, unknown or other
  misc_feature (413)..(413): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagcctggggggtccctgagactctcctgtgcagcctctggattcaccttcagttactatggctatgcacgtcgggtccgccgaggcctccaggcaaggggctgggagtggctaatcagttatatcacatgatagaaaataatactatgacgactcgtagaacggcattcagcatcacagagacaattaccaaagaaacctacgtttatactctagactaaagtggaacggtgacgaagacctaggacacgacgtntacgtgttatttcgtagtgactaaagtatttataacgattgtagttttacgacgttaggtttactcggtggttaaggggtgttagggaccgtacgggtacggggtacccaacggggtaacccttggacgttaatcccgttcgtccctagaccgtcccctaccgaaaccgg

SEQ ID NO: 177712 - DNA, 209 bp, Homo sapiens
  misc_feature: GYAE6OF02GF0OG.33.10.A10.1.454.CMB.1.raw
  modified_base (202)..(209): a, c, t, g, unknown or other
  misc_feature (202)..(209): n is a, c, g, or t
tcagtacacacactcacgaccggtgctcgatttagcgtcgatctcaggggtccgggagatcatgagggtgtccttgggttttgggggaagaggaagactgacggtccccccaggagttcaggtgctggcacagcggccctgggctgcctggtcaaggactacttccagtgtgtgtactgagcgggctggcaaggcgcatagnnnnnnnn

SEQ ID NO: 177713 - DNA, 667 bp, Homo sapiens
  misc_feature: GYAE6OF02JI2RW.33.10.A10.1.454.CMB.1.raw
  modified_base (232)..(232): a, c, t, g, unknown or other
  misc_feature (232)..(232): n is a, c, g, or t
  modified_base (389)..(389): a, c, t, g, unknown or other
  misc_feature (389)..(389): n is a, c, g, or t
  modified_base (418)..(418): a, c, t, g, unknown or other
  misc_feature (418)..(418): n is a, c, g, or t
tcagtacacacactcacgaccggtgctcgatttagcgtcgatctcagggtcttcgtggctcacgtccaccaccacgcatgtgacctcaggggtccgggagatcatgaggtgtccagtgtcaggtgcatctggtggagtctgggggaggcgtggtccagcctgggggtccctgagactctcctgtgcagcctctggattcaccttcagttactatggcatgcacgtgggtccnccaggctccaggcaaggggctggagtggctatcgagttatatcacatgactagaaaataatactagtgcggtactccgtaggaagggcctattcagcatctccagagaccaattccgaaagactacgttgtatcttagactaaagtcgaaacgggtntagaacgtaccgtcgaaacacgtacggtnttacggttagttactttcgtacgtacgtacgaaagttactttaacggttaacgtaacgttagttaacgtttttacgaccgtttacgggtttttaacctaggttaagggtacgggggttgttaaccgggacgggttaacggtacccgggggtaacgtaaccggggtaacccgttgggtaccttaacggttcccggttacgttacccccgtaccgggtaacccttccccggttaacccgtaacccccgggg

SEQ ID NO: 177714 - DNA, 696 bp, Homo sapiens
  misc_feature: GYAE6OF02HGGZU.33.10.A10.1.454.CMB.1.raw
  modified_base (190)..(190): a, c, t, g, unknown or other
  misc_feature (190)..(190): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagcctggggggtccctgagactctcctgtgcngcctctggtattcaccttcagtttactagtggcatgacacgtcgggtccgccgaggtcctaccgaggcgaaggggctggagtggctatcgtagttatatcacagtgatagaaaataatactagtgacgtactacggtagaacggccgtattacgagctactctacgaagacgactaacttaccgaaacgaactacgttacgtactcgtacgaactaagtaggtaacggtggtacgtaacggaccgtaggaaccgacgtacggtcttcggttagttacgtttcgttaggttacgtaaacggtaaacgttaagttttaacgtttaacgaagtttgggtttaaatttagggttaaccgtttacgggttttaaccgtttagggttacgggttacgggggttggttaccggggtcgggtaaccgggtcgggggaacccgttaaccggggtaccgttacggtcgtacgtttccggttccctaccgtacgtacccgtccctaacccgacccgg

SEQ ID NO: 177715 - DNA, 696 bp, Homo sapiens
  misc_feature: GYAE6OF02GPH54.33.10.A10.1.454.CMB.1.raw
  modified_base (236)..(236): a, c, t, g, unknown or other
  misc_feature (236)..(236): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggagcgtggtccagccgtggggggtccctgagactctcctgtgcagcctctggattcaccttcagttactatggcagtgcacgtcgggtccnccgaggcctccgaggcgaaggggctggagtcggctatctagttatatcacatgatagaaaataatacagtcgacgactcgtaggacgggctattcagcactcctacagacaactactaccgaagactacgttagtactctacgactaaagtggaacggtgtacggacgaaccgtcggtaaccgacgaacgggtcctaggttcgttaacgttttcggtacgttacggtaaaccggtaaatttacgttttaaagttaacgtgtttaggttaacgtttacggttaacggtttaccggtttaaccgttcggttaggggtaagggggtttcgggtaacgggtccggtaacggggtttccgggggaacccgggtaacgggttaccccggttagggtacccgttaacgtttccggtacccttccccggtaccggtacccgttacccccgtacccggtaaaccccggg

SEQ ID NO: 177716 - DNA, 665 bp, Homo sapiens
  misc_feature: GYAE6OF02F3KS1.33.10.A10.1.454.CMB.1.raw
  modified_base (196)..(196): a, c, t, g, unknown or other
  misc_feature (196)..(196): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcacccttcagttactatggcatgcactgggtccgccaggctccaggcaaggggctggagtgctatcagttanatcacatggatgaaaataactactatcgcggtactccggtgaaacgggccgtattccagcatcctccagagtacaattaccaagaaccactttgtatccgtntacgaaaatggtaaaccggtgtaggaacgacctggaccgtaacncggtctggtcttatttcnggtnaccgaaagtacttattaaccggattggtaatttacgacgtttcggttaccttacgtcggtaaggggtcggttacggacgtaccggtacgggacccggaacgggtaccccgtacggtactacgttccgtcttaccgtcgacgtcccgtacccgaccgtaacgggccctacgtccggttacccttccccgttccgaccctacccgtacctaccgaacgtacgaccgacccgttcggacgggccctaaccgtcggtacccggtacccgtcgggtccgtacgccccgttacggtacgtaacccgg

SEQ ID NO: 177717 - DNA, 771 bp, Homo sapiens
  misc_feature: GYAE6OF02JT6JB.33.10.A10.1.454.CMB.1.raw
  modified_base (277)..(277): a, c, t, g, unknown or other
  misc_feature (277)..(277): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctcctgtgcagcctctggattcaccttcagttactagtggcagtcgctacgtcgggtccgccgacggctccgaggacgaaggggctggaggtggctntctagttatataccatatgaataagaaaattaatactaagtggaccggcttaccggtaggaacgggtcctaattcgagtcctactccgtaccgaagtagaaactaaccgttacgaaacgtaaccgttacgttagtactacttagaactaagtacggtaacggtgtacgaacgtaccgtacgaaacgtaccgtacgggtacgttgttaacgtttagttacgtggttaacgtaaacgtaaaggttacttttaaacggtaacgttagttaacgttagttttacggtaaccgtttcggggttttaacccgttaggggttaggggttaaaccgggggttcgttaacccgggggacggggtttacccggggttaaccggggggtaaacccgggttaaccgggggtaaacccgggttcggtttaaacccgggtccggtttaccccgttacgttcccggtacccggttaccccggacccgtttaaccccggaaaccccgggg

SEQ ID NO: 177718 - DNA, 775 bp, Homo sapiens
  misc_feature: GYAE6OF02H8AMT.33.10.A10.1.454.CMB.1.raw
  modified_base (239)..(239): a, c, t, g, unknown or other
  misc_feature (239)..(239): n is a, c, g, or t
  modified_base (295)..(295): a, c, t, g, unknown or other
  misc_feature (295)..(295): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggtattcaaccttcagttactatggcatgcacgtgggtcccncaggcctccgaggacggaacggggtcgtagggacgtggtactatcgaagtttatanacgactatggaataagtaaaaattaaatacgtagtcggaccggtaccttccggtaagggaaccggccgtacttacgacgtcgtaccgtttaccaccgggtaagaacgtaaaccttaacttaaccccggaaaagtaaaccgttacggttagttaaccttccgttaacgaaccttaaaacggttacgggaacggttacggttacggtaaaccgttccggtaacgggtaaccgtaacggtccggttaccgtttagtttacggttttaactttccggtttagggtaacgttaaaccggtaaagttaacgtttttaagtacgggtttaagtttaaggtttacgtttacggtttaaccggtttccggtttacgtttcgggtaggggttacggggttagggtcggtacggtacgggttcgggaccggtaacccgggttcgtacggtctacgtccttcctcgtaccgccgttacccgaccgtaaccgg

SEQ ID NO: 177719 - DNA, 643 bp, Homo sapiens
  misc_feature: GYAE6OF02GLQWK.33.10.A10.1.454.CMB.1.raw
  modified_base (233)..(233): a, c, t, g, unknown or other
  misc_feature (233)..(233): n is a, c, g, or t
  modified_base (340)..(340): a, c, t, g, unknown or other
  misc_feature (340)..(340): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagcctggggggtccctgagactctcctgtgcagcctctggattcaccttcagttacatggcatgcacgtgggtccncaggctccgaggcgaaggggctggagtcggctatcagttatatcacatgatagaaaataatactagtgcggtactccgtagaacgggcctatcagcactctcgaganactaatccaagactacgttgtactcgtgacaaagtcggaacggttgtacggacgtaccgtaggaacccggtacgtacgggtcttggtacgtttaacgtttccgtaggttacgtaacggtaaaagttacgttttaagttaaccggtaagttcggttaacgttttggtaaccgtttggtttaaccgtcggtaggggttacgggggttgtacgggacggtacggggtcggggaccgtaacggggtaccctgggtcctaacggttccctcgttaccctacggaccgttccccgtaccgtaacccggg

SEQ ID NO: 177720 - DNA, 683 bp, Homo sapiens
  misc_feature: GYAE6OF02GP4TL.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcacgtgggtcccgccgaggcctccgaggcgaaggggctggagtggctatcgagttatatcacatgatagaaaataaatactatcggcggtactccgtaggaacgggcctattcagcactctccagaacgactaacttacaaacgtaactacgttatattctgaactaaagtcggtaacgggtgtacgaacgtacccgtacggaaccgaccgtacgggtcttggttcgtttaacgttttcggtaggtacggaaccgtaaaagttattttaacgttaacgtaagttgttaacgttttacgaaccgttttagggtttacctaggtttggggtaacgggggtttgtacgggtaccggtaacggggtccgggggtacccgaaaccgggggttacccttgggtaccgttaccggttccgttaccctcccggttaccgacccgttcccctaacccggtaacccggg

SEQ ID NO: 177721 - DNA, 714 bp, Homo sapiens
  misc_feature: GYAE6OF02G5L4X.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcagtgggggtgtccagtgtcaggtgcatctggtggagtcgtgggggaggcgtggtccacgccgtgggggtcccgtgagactctccgtgtgcagccgcgtggtatccaggcttcaggtcgaactaactacaggtgggccgtggacgtcccgagacggtcgtccggaagggggacgggggcgtcgggtaggtcggtagtttcgtaagttactaagttaacgttaagttacgttcgtcgtcctacccgagaccgtcgtacgtagaagtatgacgtagtacgtcgttggagtaggtacggaccgtacgtactaccgtctacgtagacgaacaccgtacggaacacgtctaacctaccgttactttacgttcgacgtagaacgttacgaaacggtacctaccgtaggaacggtcggaccggaacggaacggccggtcgtacgttactttagttaccggttggtacggggttaaggtacggttaagggttagggttacggttttcggtaaccgtccgggtaacgggtcggaaccgggtacgtacggtacgccggtacgtccgtcccgacgtgaccccgttacgaccccgtaacgggtcccgtacgttcccgtaccccg

SEQ ID NO: 177722 - DNA, 797 bp, Homo sapiens
  misc_feature: GYAE6OF02ICNR4.33.10.A10.1.454.CMB.1.raw
tcagtacacacactcacgaccggtgctcgatttagcgtcgatctcagggtcttcgtggctcacgtccaccaccacgcatgtgacctcgaggggtccgggagatcatggagggtgtccagtgtcaggtgcatctggtggagtcgtgggggagcgtggtccagccggtcgggggtcctgagactctcctggtgcacgtcctgtggtacttccgaccctttctaggtttaactagtcggactagtcgactacgtcgggtcccgcgacggcctccgacggacggaacgggtcgtacggaggtcggtactacgtacgtaagtttatactacaactagtacgtaattaaagtaaaaacttaaacgtactacggtccggtaacggtaccgtaccgggtaagggaaccggtacgtactacgacgtactacgtaccacgtaggtaaactaactaaccttaaaccgaaacgtaaaccgttacggttaactacgttcgtaaacggaactaacggtaacggtacggtacggtacggaaacgtaccgtaacggaacgtaccgtcggtagttaggtttacgtttacggtttccggttaaggtccgggtaaagtaaagtttacttaaacgttacgttagttacggtttattacgggttacttcggttacgttcgggtaacgggtcgggttacgtcgggtacggtacggggtaccgggaaaccggttaaccggggaccgttaggttaccggtcgttacccgttaccgtacccgttaccgtaacccgggtacccccgtacccggtaaacccggg

SEQ ID NO: 177723 - DNA, 769 bp, Homo sapiens
  misc_feature: GYAE6OF02HOXLS.33.10.A10.1.454.CMB.1.raw
  modified_base (281)..(281): a, c, t, g, unknown or other
  misc_feature (281)..(281): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcacgtgggtccgccaggctaccgaggacgaaggggctggagtggactatcgagttanatcactatgaataagaaaaattaatactatcggacggtactaccggtaggaacgggtaccgtattacgaaggtacctacgtacctacccgaaggaacgtaacctaaacgtttacccgaaaaggaaccttacggtttagtaactcttaacggaactaaaacggttcgggaaacgggtttggacggtaaaacgtccccgttaaggaaaccgtaccggtaaccgggtcgtttacgggttagtttaaactttccggttaggacggttaaaccgaaaaggtttactttaaggttaccgagtttaagttacgtttacggtacgtttaacgggtttacctaccgggttagggtaacggggggttgttaaccgggccgggtaacgggttccgggggggtaaccccaacgggggttaaaccccttggggtaacccttaaggttcccgtccgttaaccccggtcgaaacccgggtcccccttaacccggaaacccggg

SEQ ID NO: 177724 - DNA, 267 bp, Homo sapiens
  misc_feature: GYAE6OF02GFIKU.33.10.A10.1.454.CMB.1.raw
  modified_base (246)..(267): a, c, t, g, unknown or other
  misc_feature (246)..(267): n is a, c, g, or t
tcagtacacacactcacgaccggtgctcgatttagcgtcgatctcagggtcttcgtggctcacgtccaccaccacgcatgtgacctcaggggtccgggagatcatgagggtgtccttggggttttggggggaagaggaagactgacggtcccccaggagttcaggtgctgggcacagcggccctgggctgcctggtcaaggactacttccagtgtgtgtactgagcgggctggcaaggcgcatagnnnnnnnnnnnnnnnnnnnnnn

SEQ ID NO: 177725 - DNA, 784 bp, Homo sapiens
  misc_feature: GYAE6OF02GF4W6.33.10.A10.1.454.CMB.1.raw
tcagtacacacactcacgaccggtgctcgatttagcgtcgatctcagggtcgttcgtggctcacgtccaccaccacgcatgtgacctcaggggtccgggagatcatgagggtgtccagtgtcaggtgcatctggtggagtcgtgggggaggtcgtggtccagccgtggggggtccctgagctctcctgtgcagcctctggattcacttcattacagtggcatcggactacgtcgggtccgaccagggtcctcgaggacggaaacgggggtctagggacgggtcggtacgtaactacgtaacggtttaataacttacgaacgttatagtaataaggtaaaaaattaaaactactttaacggtcggtaaccggttaccgttacccgggtagggaaacgggttccccgttaaagttaccaacggtacctacgtacgttaccgaaaggaacgtaactaaacggtacccctaaaaaggtaccgttaacgttttagtacttaccgtataaccgtaaatcgggtaaccggtaagttacggaaacgtaccggttacgaaacgaccgtacggcttaggtagtttacgttcgttagtacgaaccgtaaagtactttaagtaacgttatagttacgttagtaacggtttacgttacgttacggtacgggttaggggttcgggacggttacgttaacgggaccggggaaccggttaacggggaacccccgttggtaccgttacggttaccctcccggttaacgtccgttaaccgtaccccgttaccggaacccggg

SEQ ID NO: 177726 - DNA, 1044 bp, Homo sapiens
  misc_feature: GYAE6OF02HMF1M.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccaggccgtggggggtcccctggagactctcctgtgcagcctctggattcaccttcagttactatggcatgcacgtcgggtccgccaggcctccgacggacgaaagggggtccttagggacggtacgggtactaagtcgtaagtttaattacttacgaacctaagttggtaagtaaacgtaaaaaacttaaaaacgtttaactaagttacggaccgggtaacccttcccgggttaagggaaaccgggggtacccgtaagtttacccgaaacggtacctacgttacccgtcccgaaaggtaacgaaaccgttaaaacctttaacccgaaaaacggtaaacccgttaaccgggtttttaagttaacgtttaacgtacggtaaaaccgttaaaacgggtttaaacgggtaaaccgggtttggttaaaccgggtaacccggttaaccccgggtaccgggttaaacccgtaaaaccgggacccggggttaacccttttacgggttttaacgggtttaaacccgttttttacgggttaacggggttaccggtttaaaaacggtaaaacgggttttaaacggttttttaaaacggttttaaaccgggtaaaggtttaacggtttaacgttttttttacgggtaaaccggggtttttaaccgttttttaaccgggttaaccgggttttagggggtaaaccggggggggtttaacgttccgggggttacccgggttaaagggggtttccccgggggggaaacccgggtaacccggggggttaaccccccgtttaggggttaacccgtttacgggtttaccccgtttacccggttaccccctttaaccccggggaacccttttaccccccgggttaaacccgtaaacccccccggggg

SEQ ID NO: 177727 - DNA, 749 bp, Homo sapiens
  misc_feature: GYAE6OF02GQL78.33.10.A10.1.454.CMB.1.raw
  modified_base (157)..(157): a, c, t, g, unknown or other
  misc_feature (157)..(157): n is a, c, g, or t
  modified_base (197)..(197): a, c, t, g, unknown or other
  misc_feature (197)..(197): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccncaggctcgaggcaaggggctggagtggctatcagttatancacatgatagaaaataatactatcggacgtactcgtaggaacgggcctattcagtcatctaccagagactaacttaccaaagtactacggttatactcgagtaacaaaggtacgggtaacgtgtaacggacgtaccgtcggaaccgacggtaccggtacgttagttacgtttacgttttccgtaggttaccggaaacggttaaaagttacgttttaactttaaacgggtatttacggttaagtttttacgggaccgttttacgggttttaaccggtcggttagggggttacggggggttggttacgggtcgggtaacggggtccggggtacccgtaacgggggtaacccgtcgggtaccttcggtcccgttccgtcccttggaccctcccgtaccgtaacccggtaccgggtccctacggttccccgttacccgttccccgtcgttaccccaccccttcccgacacggtaccctccggtaccgtcggggtaccgggacctccgggacccgggtccggcccggtggtccgtaccgcgggttacgaccgtaacg

SEQ ID NO: 177728 - DNA, 715 bp, Homo sapiens
  misc_feature: GYAE6OF02GXSW3.33.10.A10.1.454.CMB.1.raw
  modified_base (237)..(237): a, c, t, g, unknown or other
  misc_feature (237)..(237): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggagcgtggtccagccgtgggggtccctgagactctcctgtgcagcctctggtacttcaccttcagttactatggcatgcacgtcgggtccncgaggcctccgaggcgaaggggctggagtggctatcgtagttatatcactagtgataagaaaataataactagtcgcgtactccgtaggaacggcgtatcgagtcactctacagtataactaacttaccaaagtaacgtacgtttagtacttcgtacggaactaaaggttcgtaacgggtgtacggtaaccgtaacccggttcggaaaccgtaaccggtaccgggtagtttacggtttacggtttaacgttttacggtgggttaacgtaaaccgggtaaaagttacgtttaaacgttacgtaagtttagtttagtttttacggtaaccgttttaggtttaccgttacggttagggtaagggggttcgtacgggtaccggtacgggtaccggggtaacccgtaccggggttaacccgtgggttaccgcggttcccgttccctaccgtacccgtaccgtaccccgtaccgtaaacccggg

SEQ ID NO: 177729 - DNA, 712 bp, Homo sapiens
  misc_feature: GYAE6OF02GCI64.33.10.A10.1.454.CMB.1.raw
tcagtacacacactcacgaccggtgctcgatttagcgtcgatctcagggtcttcgtggctcacgtccaccaccacgcatgtgaccctcaggggtccgggagatcatgagggtgtccagtgtcaggtgcatctggtggagtctgggggaggcgtggtccagcctggggggtccctgagactctcctgtgcagcctctggattcaccttcagttactatggcatgcactgggtccgccaggcctccgaggcgaaggggctggagtggctatcagttatatcacatgatagaaaataaatactatgacggtactccgtaggaaacgggtccgagtttacgacgtaccacgtccttacccgaacggacgaactaaaactttacccaaaacgaaacctaaccggtttagttaacttacctaggtacctaaaacgttgggtaaaccgggttaggtacgtaagaacccgttacggaaccggaaccgaacggggttccttaggttacggtttaagttttaccgtcggtttaggaacgtaaacgttatttaacgttaacgtacgtagtttatttcgtaacgtttaggttaacttcgttagggaggggttacggtgggtacggtaccggtcggggggtaaccgaaccggggtaaccccgttggttaccgtacgttccggttcccttacccgtacacccggtacccgtacccctaaacccggg

SEQ ID NO: 177730 - DNA, 206 bp, Homo sapiens; identical to SEQ ID NO: 177648
  misc_feature: GYAE6OF02JXU0X.33.10.A10.1.454.CMB.1.raw
  modified_base (202)..(206): a, c, t, g, unknown or other
  misc_feature (202)..(206): n is a, c, g, or t

SEQ ID NO: 177731 - DNA, 700 bp, Homo sapiens
  misc_feature: GYAE6OF02IJA95.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtgggggtccctgagactctcctgtgcagcctctggattcaccttcgagttactagtggctagtgcacgtcgggtcccgccgaggcctccgaggacgaaggggcgtgggaggtggctagtcgtagttatactcacagttagaagtaagtaaaaataaattactaagtcggacggtaccgtaccggtaggaaacgggccgtattccgaagtacctactccgtaccgaagacgtaactacgttaaccgaaagtaaccgttacgtttatacgtacgtagtaaacgtaacgtaggtaacggtgtaacgaacgtaccgtagaacggtaccgtcgggtacgtttagttacgtttactttaccgtaggaaggtaacgtaaaagtttagttagttaacggtagtttagttacgtttacggtacgtttagttacctgggtagggtcgggtgtccggacgggtaccggtcggggaacccgtaacggtccggttacggacgttaccgttcgtccccttagacccggtaccgacccgtacccgaaccggg

SEQ ID NO: 177732 - DNA, 699 bp, Homo sapiens
  misc_feature: GYAE6OF02FSZF7.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattccaccttcagttactattggcatgcactgggtccgccacggctaccaggcgaacggggctggagtggctagtcgagttatatcactagtagataagaaaaattaaatacttatcggaccggtacctccggtaggaacgggtccgtattacgagacatcctacgagaacgactaacttaccgaaagtaaaccgtacgtttagtaacttcgacgtactaaacgtagaacgggttggtacgaagaacccgtaggaaccgaacgtacgggtcttacggttagttatttcgtacggttacgtaacgtaaagttattttaacgttaacgtagttacgttagttttaagtccggtttaggtttacgttcggttagggtaaggggttggtacgggtaccggtaccgggttacggggaccccggtaaggggtaaccccgtagggttaccgtaacggttcccggtttctacccgttaccggtacctaccccgtaccccgtaaccccgg

SEQ ID NO: 177733 - DNA, 791 bp, Homo sapiens
  misc_feature: GYAE6OF02IZDT5.33.10.A10.1.454.CMB.1.raw
  modified_base (694)..(694): a, c, t, g, unknown or other
  misc_feature (694)..(694): n is a, c, g, or t
tcagtacacacactcacgaccggtgctcgatttagcgtcgatctcagggtcttcgtggctcacgtccaccaccacgcatgtgacctcaggggtccggagatcatgagggtgtccagtgtcaggtgcatctgggtggagtcgtgggggaggcgtggtccagccgtggggggtccctgagactctcctgtgcagcctcgtggattccaccttcagttactagtggcattcgctacgtcgggtcccgaccgaggtcctccgaggacgaacggggtcgtagggacgtgggtacttactacgtaaggtttaactacgttccgaactagttacggaaagttaaacgtaaaaaattaaaacgttaccgttaaggttaccggtaaccgggttacccgttacccggggttaagggaaaccggggtacccgtaaccgtttacgaacgggtaccctaacgtttccccgtaaccgtaaggaaccggtaaacctaaaccgtttaacccgaaaaaggtaacccgttacggtttaaggttaacttaccggttagtaacgtaaagttacgggtaaaccggttggtacgtaaccgtaccgtaacggaccgtaaccgtacggtcgttggttaagttactttacggtgtacggaacgttaaattcgtttaagacgttagttaggtatttcggtactttgtaaccttggtaggngggttactagggtccagggttaccgggaccgtacgggtaacccgttggtacctagttcccgttcgtcccgtcgaccgttccccgtaccgtaacccgg

SEQ ID NO: 177734 - DNA, 674 bp, Homo sapiens
  misc_feature: GYAE6OF02HRXWA.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccaggccgtggggggtccctgagactctcctgtgcagcctcgtggattcaccttcagttactatggctatgctacgtcgggtcccgccaggcctccgaggcgaaggggctggaggtggctagtcgtagttatactcacatgataacgaaaaattaacgtactagtcggaccggtacctccggtaggaacgggcgtacttacgagacattccgtaccgaagaacgaacctaacgtttacccgaaaacgtaaccgttacggtttacgtactccgtagaactaaaggttcggtaacgggttggtacggtaaccgtaccggtacggaacgtaccgacgggtcttaggttagttacgtttcgtagtacggaagtaaagttctttaagtagtacttaggttagttacgtacgtttagttaccgttcgggtagggtagggttcgacgggtcgtaacgggtcgggaccgtaccgggtacctggtacctcgttaccgtcccacgtacgaccgtcccgtaccgaccgg

SEQ ID NO: 177735 - DNA, 801 bp, Homo sapiens
  misc_feature: GYAE6OF02GCQVD.33.10.A10.1.454.CMB.1.raw
tcagtacacacactcacgaccggtgctcgatttagcgtcgatctcgtagggtcttcgtggctcacgtccaccaccacgcatgtgacctcagggtccgggagatcagtgaggtgtccagtgtcaggtgcgatcgtggtggagtcgtggggagcgtggtccaggccgtgggggtccctggacgactctcctgtcgcagcctcgtgacttccgaccttcgagttactagtgctagtcgtcgtacggtcgggtaccgccgaggcctaccgaacggtacgaaaggggtcgtaggtagtcggctagtacgtaacgttatacgtacactagtacgaagtaagtaaaaacttaactacgtaagtcggaaccggtaccgttacggtaacgggaaccgggtaccgtacgtaccgaacgtacctacgttaccgaccggtaagtaacgaaccgttaaacgtaacccgaaaagttaaaccgttacgtttacgtaaccgttaccgtagtaaaccgtaagtacggtaacgtgtaacgaccgtacgtacgaaccgacgacggttctagggttactttacgtttcgacggtaacggttaaaccgtaaagtttaccgtttaagtaaccgttattaacggtttacgtttaacgttaaccggtttacggttacttacgggtcggggttaagggttacggaccggttacggacgggttaccgggggaaccctaaacgggtttccccgtagggtttacccacggtttaccccgtaccggttacccaaccgtacccggttacccccgtacggtaaacccccggg

SEQ ID NO: 177736 - DNA, 655 bp, Homo sapiens
  misc_feature: GYAE6OF02FX687.33.10.A10.1.454.CMB.1.raw
  modified_base (457)..(457): a, c, t, g, unknown or other
  misc_feature (457)..(457): n is a, c, g, or t
  modified_base (485)..(485): a, c, t, g, unknown or other
  misc_feature (485)..(485): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtcgtgggggaggcgtggtccagccgtggggggtccctgagactctcctgtgcagcctctggattcaccttcagttactatggcatgcacgtcgggtccgccgaggcctccgaggcgaaggggctggagtggctatctagttatactcacatgaataagaaaataatactagtgcggacgtcgtaggacggtccgtattcgagcactctacgagacgactaactaccaaagtactacgttagtactctagactaaagtaggtaacggtgtacggaacgtaccgtaggaaccgacgtacggtcttggtagtttactttcgngtacgaacgtaaatagtttagtaacgtnttagtattttcgaacgtttggttaaccgtcggttaggggtaggggttcgtcgggtaccggtacggggtaccgggggaaccccgtaacggggtaccccgttagggtaacccgttacgttcccggttaccttaccccggtacgacccggttccccctaaccggaaccccggg

SEQ ID NO: 177737 - DNA, 685 bp, Homo sapiens
  misc_feature: GYAE6OF02IGW7O.33.10.A10.1.454.CMB.1.raw
  modified_base (494)..(494): a, c, t, g, unknown or other
  misc_feature (494)..(494): n is a, c, g, or t
  modified_base (520)..(520): a, c, t, g, unknown or other
  misc_feature (520)..(520): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatcgtggtggagtcgtgggggaggcgtggtccagccgtgggggtccctgagctctcctgtgcagcctctggattccaccttcagttactatggcatcgctacgtcgggtcccgccaggctccgaggcgaaggggcgtggacgtggacttaagtcgtagttatatacgtacagtagtaagtaaagtaaaaattaactacgttaagtcggaccgtaccgtaccggtaggaaacggggtcctaattccgagtctactccgtacgaagacgtaactaacttacccgaaagtaaccgtacgttagttaactcgtacgaacgtaaagtcggtaagtgttagaaccgacgtagacgaccgtcggtattcggttntagtttagcgtaggtaactaaagttntaaacgttacggaatttagttatttacggtacttacggtttacgtcggttagggaacggggttgtttaacgggccgttaacgggttcccggggaaccgtaacgggttaccgtccggttatacgggttcccttacgtcccctaacggctccccgtaacgacccggg

SEQ ID NO: 177738 - DNA, 861 bp, Homo sapiens
  misc_feature: GYAE6OF02IRTUU.33.10.A10.1.454.CMB.1.raw
tcagtacacacactcacgaccggtgctcgatttagcgtcgatctcagggtcttcgtggctcacgtccaccaccacgcatgtgacctcgaggggtccgggagatcatgagggtgtccagtgtcaggtgcatctggtggagtcgtgggggaggcggtggtccaggccggtcgggggtcccgtgagactctcctgtgcacgcctcgtggtattcctaccttctagttactagtggcattttttttttgcgtacggtcgggtcccgtaccgacggtccgtccgacggaccggaaggggtcggtagggtacggtggtccgtagtacgtaagtttaagttactacctacgtaacgtagtaagtaaagtaaaaaagttaaaaacttaacttaagtacggtacggtaaccgttaccggtaacggtaacgggtaccgtaacgttacgacgacctactaccgtaccgtaacggtaacgtaacctaaaccttaaccgtaaaacgtaaaccgtaacggttacgttaacgttaccgtacgtaacgtaaacgtagggtaaaacccgggttgtaacgggtaacccgtaaccgtacggaaaacccgtaaccgggtacggttactttagggtttactttacgtttccggaggtaacggtaaacctaaaaggtttacttaacgttaacgtgttaacggttactttacggaccgttttacggtttaaccgtggttaaaggggtggggttaccgtacggggtacccggtaacggggtcccgggggtaacccgggaacccgggtttaaccggtcggttaacctacggttcccgtacccgttacccggaccttacccggtacccccgtaacccgtaaccgggg

SEQ ID NO: 177739 - DNA, 770 bp, Homo sapiens
  misc_feature: GYAE6OF02I2JG5.33.10.A10.1.454.CMB.1.raw
  modified_base (207)..(207): a, c, t, g, unknown or other
  misc_feature (207)..(207): n is a, c, g, or t
tcagtacacacactcacgaccggtgctcgatttagcgtcgatctcagggtcttcgtggctcacgtccaccaccacgcatgtgacctcaggggtccggagatcatgagggtgtccagtgtcaggtgcatctggtggagtcgtgggggaggcgtggtccagccgtgggggtccctgagacgtctctgtgcagcctctggattcaccttnagttactatggcagtcgctacgtcgggtcccgccacggctccgaggacgaaggggtcgtgggaggtcggctatacgtagttatatcgactagtagataagtaaaaattaataactagacggtcggtaccgtacggtaggaacggtccgtacttacgagactactcctaccgagaactaactacgttaacccgaaagtaaacctacgttagttactcgtacaaccgtaagtaggtaaacccgggttgtacgtaaccggtaccccgtaggaaacccggtaccgaccgggttcgttacggtttaacgtttaccttttgacggttacggaaactaaaaggtttatttaacgttacggtagtttaaggtttacctttaggtaacccggtttacggttttaactaccggggttaggggacgggggttttagggaccggggttacggtacccgggggtttaccgggggaaccggtaacccgggttaccggtaaggttccccggttaacggtttcccgttacccttccccgaccgggtacccgttacccccctaacccgggtaaccccggg

SEQ ID NO: 177740 - DNA, 624 bp, Homo sapiens
  misc_feature: GYAE6OF02IC5MW.33.10.A10.1.454.CMB.1.raw
  modified_base (267)..(267): a, c, t, g, unknown or other
  misc_feature (267)..(267): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
tcagtacacacactcacgaccggtgctcgatttagcgtcgatctcagggtcttcgtggctcacgtccaccaccacgcatgtgacctcagggtccgggagatcatgagggtgtccagtgtcaggtgcatctggtggagtctggggagcgtggtccagcctgggggtcctgagactctcctgtgcagcctctggattccaccgttcagttacctatcggcatgcactggtccgcaggctccgagcaagggctggagtgctatcagttanatcgcatcgatcgaaaatatacatgcgactccgtgaaggcctaatcagtcatcnccgtancgacattcaagtacacgttntatctgactaaatcggaagtggtnaaacggtcccagtacgtaccaggggtcctaggtcgttatttacngggttcacggttaaaaacgngtttttaccgaaacggtctttacgggtaatttccgggtaaactttgggttaaaccttcggtttagggaacgggggttacttttaggggaccctaacgggtttccgggggaccttaagggggtaacccccttgggtaccgaacggttttcgtacccgtccgtaacgtacgggcccctttaacccggacgg

SEQ ID NO: 177741 - DNA, 961 bp, Homo sapiens
  misc_feature: GYAE6OF02ICUXE.33.10.A10.1.454.CMB.1.raw
  modified_base (126)..(126): a, c, t, g, unknown or other
  misc_feature (126)..(126): n is a, c, g, or t
  modified_base (249)..(249): a, c, t, g, unknown or other
  misc_feature (249)..(249): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtncatcgtggtggagtcgtgggggaggcgtggtccaggccgtggggggtccctgagactctcctgtgcagtcctctggattccacctttacgagttacctatgggtcatcgctacgtcgggtccnccgaggcctccgaagggccgaaggggtcctagggacgtgggcctaagtctacgttaatcgtacaacagttgaataaaacgtaaaaattaaaacgtacgtagtacggtaaccggtaccgttaccgggtaacggaaacggggtaccgttaacttaaccggacggtaaccgtaccgttacccgtaaccgtaacgtaaccggtaaactaaccgttttaaacccggaaaaacggtaaacccgttttaaccggttaagtttaacgttacccgtacgtaaaccgtaaaacgggtttaggggtaaaccggggttttcgggtaaccggttaaaacggtccccggttaaacgggtaaccggtaacccggggtaaccgggttcgggtttaacggtttttaacccggttttaagttttccccgggggttaaggttacccgggtaaacggtttaaaaacgggttttacttttaaaaccgggtttacgtaaacgggtttacggtttaaacggtttttcggtacccgggtttttaaggggttaaacccttccggggttagggttaacggggggttcgggttacggggtacccgggtaacgggggttccgggtacccgggttaaacccggggggtacccgtttcggggaacccttttaccgggttccgtttacccccggttaccgttaccccggaacccgttacccgggtacccgtaaacccccgggg

SEQ ID NO: 177742 - DNA, 217 bp, Homo sapiens
  misc_feature: GYAE6OF02G0V4D.33.10.A10.1.454.CMB.1.raw
  modified_base (203)..(217): a, c, t, g, unknown or other
  misc_feature (203)..(217): n is a, c, g, or t
tcagtacacacactcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggctacttccagtgtgtgtactgagcgggctggcaaggcgcatagnnnnnnnnnnnnnnn

SEQ ID NO: 177743 - DNA, 886 bp, Homo sapiens
  misc_feature: GYAE6OF02FLMP5.33.10.A10.1.454.CMB.1.raw
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcagttatatacacatgtaatagaaaaattaaactactagtggacggtaccttaccggtaggaaacggggcccgtagtttaccaggtccaattcccgttaccgaaggtaacgtaacctaaacgtttaacccgaaaacggtaaaacctaacggtttaagttaacttaccgtacggtaacctaaaagtacggtaaacgggttgtaacgggaacgtaacccgtacggaaccggtaaccgacggtacgtaggttacgttaacgttttacgtagggtacggtaaccggtaaaaaaggttactttaaagttaaaccgtaatttaagggttaactttttacggacccggttttaagggtttacccttaggttaaggggtacggggggttacggtaggggtccgggtaacggtcgggggaacccgttaccgggggtaacccgtggggtacctacgttaccggtaccgttacccgtaccgacggtcccctaccggaaccgaaaccggggtaccctacggttaccgggttccccttacccccggttacggaccccgtaacccccttccggtaaccctaacgggtccgaacccgtaacccgttcccggggtaccgggggtaccccgtaaccggtaacccgggtccccgggtacccggttccgggggtacccttcccgggtaccccggtttacggaaccggtaacccggg

SEQ ID NO: 177744 - DNA, 868 bp, Homo sapiens
  misc_feature: GYAE6OF02JUEZX.33.10.A10.1.454.CMB.1.raw
tcagtacacacactcacgaccggtgctcgatttagcgtcgatctcagggtcttcgtggctcacgtccaccaccacgcatgtgacctcaggggtccgggagatcatggagggtgtccagtgtcaggtgcatctggtggagtcgtgggggaggcgtggtccagccgtggggggtccctgagactctcctgtgcacgcctcgtgattctaccttcgagtttacagtcggctatcgcacgttcggggtacccgaccgacggccgtaccgagggaccggaacgggggtcgttgggaggtcgggtacctttaagtaaaggtttactaacgtactaaccgtagtaagtaacgtaaaacgtaaaaataaacttaacgttagtagggacccggtaaccgttaccgggtaagggaaaccgggttactaaccgtttacggaagtcccgttaagttacccggtaccgaacggtaaacgtaaacccttaaaccggtttaaaccgaaaacgtaaccggttaacgtttaggttaaccctacggtacgtaaaacgtaaaacggttgggttaaacccgggttagtaccggtaacggtaacccgtacggaaacccggaaccggttccgggtttattaccggggtttaactttacggtttaacggttcggttaaacgggttaaaccggttaaaagtttaaggtttaactttaaccgggttaagttacgtttagtttacggttacgtttacggtttacggttacggtagggttacggggtagtacgggtcggaccggttcgggaaccggtaccggggttaacgtcggtaacgtacgttcccgttaccgacccgtaggaccccgtaccgtaccgggacccgtaaccggg

SEQ ID NO: 177745 - DNA, 687 bp, Homo sapiens
  misc_feature: GYAE6OF02FKZCM.33.10.A10.1.454.CMB.1.raw
  modified_base (133)..(133): a, c, t, g, unknown or other
  misc_feature (133)..(133): n is a, c, g, or t
  modified_base (210)..(210): a, c, t, g, unknown or other
  misc_feature (210)..(210): n is a, c, g, or t
tcagtacacacactcacgaccggtgctcgatttagcgtcgatctcgagggtcttcgtggctcacgtccaccaccacgcatgtgacctcgaggggtccctgagactctcctgtgcagcctctggattcaccttnagttactatggcatgcacgtgggtccgccgaggcctccgaggacgaaggggctgggagtcggctatctagttatacncacatgatagtaaaataatctagtgcgactcgtaggacggccgtattcgagacacttcaccgaagacgaactaaacgttccaaagaaccgttacggttacgttactacgttcgaactaaagtacggaaccggtgtaggaaccaccgtacggaacgtaccgacgggtcttaggttagttactttaccgtggtacgtaacgttaaaacgtatttacgttaacgagttacgttaagtttcgacgtttcgggtttaactcggtagggtacgggttggtacgggtacgtacgggtcggggaccggtaaccgggtaccccgtagtaacgttccgttactccgtacgtccgaaccgtcccgaaccgacggtcccacgttcccgtacccgttcccgtccgacctcccacgtacgaccgactccgaccgtcggcggtacacggccgtccgtcgccggtgtccgaccggttgaaccggtcgtaaccg

SEQ ID NO: 177746 - DNA, 777 bp, Homo sapiens
  misc_feature: GYAE6OF02F4LHC.33.10.A10.1.454.CMB.1.raw
  modified_base (115)..(115): a, c, t, g, unknown or other
  misc_feature (115)..(115): n is a, c, g, or t
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
tcagtacacacactcacgaccggtgctcgatttagcgtcgatctcaggggtccctgagactctcctgtgcagcctctggattcaccttcagttactatggcatgcactgggtccnccaggctccaggcaagggctggagtggctatcagttatatcacatgatagaaaataactctangacgactcgngaacggcattcagnatcncanagacatcaagaactacgttnatctagactaaaatcgaacggtgtacgagaaccctgaacgactaccggntacggtagtttactttcgtaggtcgaacggtaaaagtacgttttaacttacgggaatttaggaagtttttcgaacgtttacgggttaactacggttaggaagggggttcgtacgggaccgggttaacgtttcgggggaacccgtttaacgggggaaaccccttggggtaacctaacgtccgttaccctacccgtagtaccgtacccgtaacccgtaaccgtaaccgggtacccgtaacgtacccggttaccgtttcccccggtaacccggtacccgtaccccgttacccgtaacccgtaaacggaaccgaccgtacccgtaccggtacgggggacctaacggtaccggccgggtacccgtacggggtacccgtcggtaccggttaaccggttaaccgaaccgggtaacccttaaccggttaccgtaacggttacggttacggttaaccgtaacggtacggtaggtaccgggtcgtacgggtaccggacggtcgaaccgg

SEQ ID NO: 177747 - DNA, 689 bp, Homo sapiens
  misc_feature: GYAE6OF02G34RX.33.10.A10.1.454.CMB.1.raw
  modified_base (287)..(287): a, c, t, g, unknown or other
  misc_feature (287)..(287): n is a, c, g, or t
tcagtacacacactcacgaccggtgctcgatttagcgtcgatctcagggtcttcgtggctcacgtccaccaccacgcatgtgacctcaggggtccctgagactctcctgtgcagcctctggattcaccttcagttactatggcatgcactgggtccgccaggctccaggcaaggggctggagtggctatcgagttatatcactatgatagaaaataatactatcgacgtactccggtagacgggcctattcagcatcctacagagactacttaccaagactacgttntatctagactaagtggaacggtgtacgacgacctaggacacgacggtctgtgttactttcgtggtacggaactaagttatttaacgtacgtaattggttatttacgagtttcggtttaacgtcgtagggtaggggttggtacggtacggtaccgggtacggggaccgaacgggtacccgtggtccgtaacggttcgtcctccgtacgaccgtccctaccgtaaccggaccggtaccctacggttccgttaccccgttcccgtccggtaccccttaccctacccgtaccgtaccggtccgtacccgttacccggtccgggtaccggggaccaaccgggtaccggccccgggttcccgtaccggggttccgtaccggtccggtttaccgggtacctaacccggg

SEQ ID NO: 177748 - DNA, 811 bp, Homo sapiens
  misc_feature: GYAE6OF02IC9YA.33.10.A10.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
tcagtacacacactcacgaccggtgctcgattttagcgtcgatctcagggtcttcgtggctcacgtccaccaccacgcatgtgacctcaggggtccgggagatcatgagggtgtccagtgtcaggtgcatctggtggagtcgtggggggagcgtggtccagccgtggggggtccctgacgctcctcctgtgcagcctctggacttcaccttcaagttactagtggactatncacgtcgggaccncgacggctccgaggacgaggggctgggagtcggactatacgtagtttatactcaactagtagaattaaaagtaaaaacgttaaacttaacgtagtacggtaccggtaaccgttacgggtaacgggaacgggtaccgttaattaccggaacgacgtactacccgtaccgaacggaacgtaaactaaccttaacccgaaaagtaaaccgttggttactattcgaactaaacgtaacggtacggtaacggttacggtacggaaaccgtaccggaacgtaccggaaaccgggtacgttacgttggtttaacgtttacggtttacggtaggttacgggtaaacgttaaaccgtttatttaaaaccgttaacgttagtttaaggtttacgtttacgttaccggttttaacggttaaccggtttcggttaagggggtagggttttacgggccgggttacgggtaacccggggtttaggggacccgggttaaccgggtaccggttccgggttacgtccgtttacccgggtccttaccccggtagtaccccgtaccccgttacccggaaccccggg

SEQ ID NO: 177749 - DNA, 716 bp, Homo sapiens
  misc_feature: GYAE6OF02GNAH2.33.10.A10.1.454.CMB.1.raw
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
tcagtacacacactcacgaccggtgctcgatttagcgtcgatctcagggtcttcgtggctcacgtccaccaccacgcatgtgacctcaggggtccgggagatcatgagggtgtccagtgtcaggtgcatctggtggagtctgggggaggcgtggtccagccgtggggggtccctgagactctcctgtgcagcctctggattcaccttcagttactatggcatgcactgggccnccaggcctcaggcgaagggctggagtggctatcagttanattcacatcgatagaaaataatactatgaccgactcgtagaacggcgtattcagcactctaccgagagtaacaacttcgaaacgtactacgttagtatacgtgaactaaagtcggaacggttcgtagaacgtaccgtacggaactaccgacgggtccttaggttactttacgtttccgtaggtacggtaacgtaaaagttccgttttaaaatttccggtaaagtttacggtttaacgttttacggtaccggttttacgggtttaaccttacgggttaaggggttaggggggttacccgttacgggggtaccgttaccgggggttaccggggggtaaccccgtaaacgggggttaaacccccggttggttaccccggttaacgtttccccggttaccgtttccggtaaaccccgccgtttaccccccggacgttaaacccccggg

SEQ ID NO: 177750 - DNA, 1044 bp, Homo sapiens
  misc_feature: GYAE6OF02GXEBS.33.10.A10.1.454.CMB.1.raw
tcagtacacacactcacgaccggtgctcgatttagcgtcgatctcagggtcttcgtggctcacgtccaccaccacgcatgtgacctcgaggggtccgggagatcagtgagggtgtcctagtgtcaggtgctatcgtggtaggtagtcgggtaggggacggtcggtcggtaccgacggtccgggtcgggggttccctagaccgtactccgtccgtggtgtccaccgtccgtgtaggtacttacctaccttacgtagttacgtagtgaccagtaccgcgtaacggtccggacctccgtagtcccgtacggaggaacgggtacgggtacgtggacggtcgacttacgttagtagttaatacgtacaagttattaagaagttaaaacgttaaaaatacgttaacgtacgggtaccgtaacccggttaccggttacggtaacgggtaacccggttacgttaaaccggtacgtacccggtaccgtacttaccccgaacggtaaacgggtaaaccttaaccgtaaaacccggtttaaaaccgtaaaccggtaaacggttttaccgtttaacttaaccgttaaccgttaaacggtaaacgtaaaccggggttaaccggtaacgggttaacgggtaacccggtaaccggtaaccggtaagggtaacccgtaaaccggtccgggttccggtttacggttacggtttaacgtttcggttaaccgtacggttaaccgttaaagtttaaccgggttttaacgttaacgtttacgttaggttttaccgtttaacccgggttttaggtttaccgggtttaacggtttacggggttggggttaaaccggggtttcgggtaacccgggggttacgggggttaacccgggttacccgggggggtaaacccgggttaaacccggggttacccggggttaaccccggtttaacggtttaaccccggttttccccggtttacccccgggttttaaacccggttaaccccccggggtttaaaccccccggtacccccggttaaaacccccccgggtaacccggggg

SEQ ID NO: 177751 - DNA, 674 bp, Homo sapiens
  misc_feature: GYAE6OF02HUTK8.33.10.A10.1.454.CMB.1.raw
  modified_base (147)..(147): a, c, t, g, unknown or other
  misc_feature (147)..(147): n is a, c, g, or t
  modified_base (156)..(156): a, c, t, g, unknown or other
  misc_feature (156)..(156): n is a, c, g, or t
  modified_base (368)..(368): a, c, t, g, unknown or other
  misc_feature (368)..(368): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (597)..(597): a, c, t, g, unknown or other
  misc_feature (597)..(597): n is a, c, g, or t
tcagtacacacactcacgaccggtgctcgatttagcgtcgatctcagggtcttcgtggctcacgttcaccaccacgcatgtgacctcaggggtccctgagactctcctgtgcagcctctggattcaccttcagttactatgcatgcngtgggtccncgacggtctcccaggacgaaggggctggaggtcggctatactagttatatacacataggataagtaaaaattaactaactatacgccggtacttccggtaggaacggtcgtattccagactatccacgagacgactaacgtaccaataaccgacgttactataccgtagtaacgtaaagtacggtacggttaggtacggtaacgtacccgtntaacggtaaccgagtacgttaggtaactttaacttttcggtaagtacgtaacgtaaagttattaactaacgttatacgttagtttacaccggtttaagtttcccgttagtagggtacgggtgtacgggacgtacgggtcgggacggtaacggaccgtcggtactacgtacgtccttccncnctccaacacgaccgactacgtccgtcccgtcccgtctacccgtacccnccgttacaaccgtacgacctccgtacggtcggtacgaacgacggcccgcggtcggcgcggtccgtagtaccgtaacg

SEQ ID NO: 177752 - DNA, 685 bp, Homo sapiens
  misc_feature: GYAE6OF02GWKYZ.33.10.A10.1.454.CMB.1.raw
tcagtacacacactcacgaccggtgctcgatttagcgtcgatctcagggtcttcgtggctcacgtccaccaccacgcatgtgacctcgaggggtccggagatcatgagggtgtccagtgtcaggtgcatctggtggagtcgtgggggaggcgtggtccagccgtgggggtccctgagactctcctgtgcagcctcgtggattccaccttcagttactagtgcagtgctacgtcgggtccgccgaggcctaccgacggacgaaggggctagggacggtggccttatcgtaagttactacgtacactagtacgaagtaagtaaaaattaagtaacgttaagtacggacggtaacccttcgggtaagggaacgggtccgttaagttcgaacgcctaacttcccgtacgaagaactaaacgtaacctttaaccgaaaacgtaaaccgttaacgtttacgaattacgtaacgtaacgtaaacgtacgggtaacggtggtacgaacgtacgaacggacgtaccgcggtattcggtacttgttgcgtaacgagtaaacgttattactagtagtcttagttacgtcgttacgttcgtagtaggggtggtgtcgggtacgagggtcgggacgtaaccggtcgtacgtctaacgttcgtacccgtcgttacccgacgtcccgtaaccgtacccgg

SEQ ID NO: 177753 - DNA, 354 bp, Homo sapiens
  misc_feature: GYAE6OF01CVLIP.37.76.G10.1.454.CMB.1.raw
  modified_base (349)..(354): a, c, t, g, unknown or other
  misc_feature (349)..(354): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtacgagagaacagacttggggccagggaaccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnn

SEQ ID NO: 177754 - DNA, 381 bp, Homo sapiens
  misc_feature: GYAE6OF01BMTA9.37.76.G10.1.454.CMB.1.raw
  modified_base (376)..(381): a, c, t, g, unknown or other
  misc_feature (376)..(381): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctcctccaagagcacctctgggggcacagcggccctgggctgcctggtcaaggctacttccatctacactactgagcgggctggcaaggcgcatagnnnnnn

SEQ ID NO: 177755 - DNA, 381 bp, Homo sapiens
  misc_feature: GYAE6OF01AHNEZ.37.76.G10.1.454.CMB.1.raw
  modified_base (374)..(381): a, c, t, g, unknown or other
  misc_feature (374)..(381): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctcctccaagagcacctctggggcacagcggccctgggctgcctggtcaaggctacttccatctacactactgagcgggctggcaggcgcatagnnnnnnnn

SEQ ID NO: 177756 - DNA, 379 bp, Homo sapiens
  misc_feature: GYAE6OF01EJGVD.37.76.G10.1.454.CMB.1.raw
  modified_base (374)..(379): a, c, t, g, unknown or other
  misc_feature (374)..(379): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatactttgatatttgggccaaggcacaatggtcagcgtctcttcagcctccaccaagggcccatcggtcttcccctggcaccctcctccaagagcacctcgtgggggcacagcggcctggctgcctggtcaaggactacttccatctacactactgagcgggctggcaaggcgcatagnnnnnn

SEQ ID NO: 177757 - DNA, 380 bp, Homo sapiens
  misc_feature: GYAE6OF01EJZD6.37.76.G10.1.454.CMB.1.raw
  modified_base (374)..(380): a, c, t, g, unknown or other
  misc_feature (374)..(380): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctcctccaagagcacctctgggggcacagcggcctgggctgcctggtcaggactactccatctacactactgagcgggctggcaaggcgcatagnnnnnnn

SEQ ID NO: 177758 - DNA, 382 bp, Homo sapiens
  misc_feature: GYAE6OF01A0YPX.37.76.G10.1.454.CMB.1.raw
  modified_base (377)..(382): a, c, t, g, unknown or other
  misc_feature (377)..(382): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctcctccaagagcacctctgggggcacagcggccctgggctgcctggtcaaggactacttccatctacactactgagcgggctggcaaggcgcatagnnnnnn

SEQ ID NO: 177759 - DNA, 384 bp, Homo sapiens
  misc_feature: GYAE6OF01BZ4CJ.37.76.G10.1.454.CMB.1.raw
  modified_base (377)..(384): a, c, t, g, unknown or other
  misc_feature (377)..(384): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaattacttttgatatttggggaccaaggtacaatggtcagcgtctcttcagcctccaccaaggcccatcggtcttcccctggccaccctcctccaagacgcacctcgtggggcacagcggcctgggctgcctggcaaggactacttccatctacactactgagcggctggcaaggcgcatagnnnnnnnn

SEQ ID NO: 177760 - DNA, 384 bp, Homo sapiens
  misc_feature: GYAE6OF01AMSO0.37.76.G10.1.454.CMB.1.raw
  modified_base (376)..(384): a, c, t, g, unknown or other
  misc_feature (376)..(384): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctctccaagagcacctctgggggcacagcggccctgggctgcctggtcaaggactacttccatctacactactgagcgggctggcaaggcgcatagnnnnnnnnn

SEQ ID NO: 177761 - DNA, 400 bp, Homo sapiens
  misc_feature: GYAE6OF01B7YZ7.37.76.G10.1.454.CMB.1.raw
  modified_base (355)..(355): a, c, t, g, unknown or other
  misc_feature (355)..(355): n is a, c, g, or t
  modified_base (382)..(400): a, c, t, g, unknown or other
  misc_feature (382)..(400): n is a, c, g, or t
tcagtagtgtagatcacgaccggtgctcgatttagtcactcatacagggagttcgttggcgttgtctctgtgaagggccgattcaccatctccagagacaacgccaagaactccctgtatctgcaaatgaacagtctgagagctgaggacacggccttgtattactgtgcaaaggatcagtatcaactggctgtcgaatacttttgatatttggggccaaggcacaatggtcagcgtctcttcagcctccaccaaggcccatccggtccttcccctggccaccctcctccaagacgccacctctcgggggccacgaggcggccctgggctgcctggtcaaggctactcatctacnctctgagcgggctggcaggcgcatagnnnnnnnnnnnnnnnnnnn

SEQ ID NO: 177762 - DNA, 384 bp, Homo sapiens
  misc_feature: GYAE6OF01BU17M.37.76.G10.1.454.CMB.1.raw
  modified_base (377)..(384): a, c, t, g, unknown or other
  misc_feature (377)..(384): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctcctccaagagcacctctgggggcacagcggccctgggctgcctggtcaaggactacttccatctacactactgagcgggctggcaaggcgcatagnnnnnnnn

SEQ ID NO: 177763 - DNA, 654 bp, Homo sapiens
  misc_feature: GYAE6OF01B4N7N.37.76.G10.1.454.CMB.1.raw
  modified_base (525)..(525): a, c, t, g, unknown or other
  misc_feature (525)..(525): n is a, c, g, or t
  modified_base (535)..(535): a, c, t, g, unknown or other
  misc_feature (535)..(535): n is a, c, g, or t
  modified_base (553)..(554): a, c, t, g, unknown or other
  misc_feature (553)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
tcagtagtgtagatcacgaccggtgctcgatttagtcactcatacagggtagttcgttggcgttgtctcgtgtcgtaagggcccgagttcacccaatccttccagtagacaacgccaagaactccctgtatctgcaaactgaacagtctggagagctgtaggtactacggtccttgttatttactgtgcaaaggatcagtatcaactggctgtcaagtacgttttgatagtttcgggacctaaggcaacaatcggtacagcgtctcttcgacgcctaccacctaacggcccagttccgtcctttaccccgtggtcctacccgtcctaccgaacgacgtccgacctacgtcgggccacggaacggccggcccgttcggggccgtttcgggaccgtaccggttaaccgaaacggtaaacctaaccgtttaccgaaacgttaacgtaaaaccgtaaccgttaaccggttggacggtaccggggtaccgttagggaccggaaaacgggccgtaccgtaactacggaacncgacgacganacgacgacacacgacatnnananacanacacgacacgacgagacgacgacgacgacgacgtactactacgtacgtacgcgtagagacgacgtactacgtacgtactacgttctgtgtcg

SEQ ID NO: 177764 - DNA, 385 bp, Homo sapiens
  misc_feature: GYAE6OF01AGEZY.37.76.G10.1.454.CMB.1.raw
  modified_base (376)..(385): a, c, t, g, unknown or other
  misc_feature (376)..(385): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctcctccaagagcacctctggggcacagcggccctgggctgcctggtcaaggactacttccatctacactactgagcgggctggcaaggcgcatagnnnnnnnnnn

SEQ ID NO: 177765 - DNA, 419 bp, Homo sapiens
  misc_feature: GYAE6OF01ABVX2.37.76.G10.1.454.CMB.1.raw
  modified_base (369)..(369): a, c, t, g, unknown or other
  misc_feature (369)..(369): n is a, c, g, or t
  modified_base (375)..(376): a, c, t, g, unknown or other
  misc_feature (375)..(376): n is a, c, g, or t
  modified_base (378)..(379): a, c, t, g, unknown or other
  misc_feature (378)..(379): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (386)..(387): a, c, t, g, unknown or other
  misc_feature (386)..(387): n is a, c, g, or t
  modified_base (389)..(389): a, c, t, g, unknown or other
  misc_feature (389)..(389): n is a, c, g, or t
  modified_base (391)..(419): a, c, t, g, unknown or other
  misc_feature (391)..(419): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttcccctggcaccctcctccaagcgcacctctggggcacagcggcctgggctgcctggtcaaggctacttccatctacactacgtgagcgggctggcaaggcncatagnncnnangantnntnannnnnnnnnnnnnnnnnnnnnnnnnnnnn

SEQ ID NO: 177766 - DNA, 530 bp, Homo sapiens
  misc_feature: GYAE6OF01BC0F5.37.76.G10.1.454.CMB.1.raw
  modified_base (175)..(175): a, c, t, g, unknown or other
  misc_feature (175)..(175): n is a, c, g, or t
  modified_base (489)..(530): a, c, t, g, unknown or other
  misc_feature (489)..(530): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggntcagtatcaactggctgtcaattacttttgattagtttggggaccaaggcaacaatggtcagcgtctcttcacgccctccaaccgaagggcccctagtccgggttccctttcccccgtggtcccacccccttccctacccgaaaggaccgccgtaaccctccggtcgggggaccaccggacggcccgggcccgtcgggcctcgtcccgttgggtaccgaacggtaccttaaccgttccaagttccaaacctaccttaaccgtggtaacgggccgggtaccgtcggaccgaaacgggccgaccaagtggacacgnnnnnnnnnnnnnnnnnnnnnnnnnnnnnnnnnnnnnnnnnn

SEQ ID NO: 177767 - DNA, 401 bp, Homo sapiens
  misc_feature: GYAE6OF01DTQCZ.37.76.G10.1.454.CMB.1.raw
  modified_base (397)..(401): a, c, t, g, unknown or other
  misc_feature (397)..(401): n is a, c, g, or t
tcagtagtgtagatcacgaccggtgctcgatttagtcactcatacagggagttcttgtcgttgtctctgtgaagggccgattcaccatctccagagacaacgccaagaactccctgtatctgcaaatgaacagtctgagagctgaggacacggctgtgtattattgtgcgagagatttagactacaaagtttcgagtgactggtatgatgcttatgataccgtggggccaagggaccatggtcaccgtctcttcagcctccaccaagggcccatccggtctccccctggcgccctgctccaggagccacctccgagacgcacagccggcccgtgggctgcctggtcaaggactacttccatctacactactgacgcgggctggcaagggcgcatagnnnnn

SEQ ID NO: 177768 - DNA, 464 bp, Homo sapiens
  misc_feature: GYAE6OF01DK2U3.37.76.G10.1.454.CMB.1.raw
  modified_base (331)..(331): a, c, t, g, unknown or other
  misc_feature (331)..(331): n is a, c, g, or t
  modified_base (442)..(464): a, c, t, g, unknown or other
  misc_feature (442)..(464): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaattacttttgatagtttggggccaaggcacaatggtcagcgtctcttcagcctccaccgaagggccctaagtccggtccttcccccgtggcctacccctcctaccaacgacgccacccgtcgtagggggccaaccncggccggcccgtgggcctcgcccgttggtaccgaaaggtaccttaaccgttccaacttctaaccgtactacgttggacggcggggtccagggacaacggtcgcaagtagcnnnnnnnnnnnnnnnnnnnnnnn

SEQ ID NO: 177769 - DNA, 394 bp, Homo sapiens
  misc_feature: GYAE6OF01D1GNA.37.76.G10.1.454.CMB.1.raw
  modified_base (379)..(379): a, c, t, g, unknown or other
  misc_feature (379)..(379): n is a, c, g, or t
  modified_base (385)..(394): a, c, t, g, unknown or other
  misc_feature (385)..(394): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgacaaaggatcagtatcaactggctgtcaatacttttgattagttggggccaaggcacaatggtcagcgtctcttcagcctccaccaacgggcccatcggtccttccccctggccaccctcctccaagacgccacctcgtgggggcacgagcggcctgggctgcctggtcaaggactactccatctacactactgagcgggctggcaaggcncatagnnnnnnnnnn

SEQ ID NO: 177770 - DNA, 429 bp, Homo sapiens
  misc_feature: GYAE6OF01C4R5D.37.76.G10.1.454.CMB.1.raw
  modified_base (410)..(429): a, c, t, g, unknown or other
  misc_feature (410)..(429): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaacggcccatccggtccttcccctggccaccctcctaccaagacgccacctcgtgggggcacgacgccggcccgtgggctcggcccgtggtaccgaacggtacctacttcccatacctactactactgacggcgggcgtcggcgaaggcgacagtacgnnnnnnnnnnnnnnnnnnnn

SEQ ID NO: 177771 - DNA, 383 bp, Homo sapiens
  misc_feature: GYAE6OF01CWZB6.37.76.G10.1.454.CMB.1.raw
  modified_base (378)..(383): a, c, t, g, unknown or other
  misc_feature (378)..(383): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaaggcccatcggtcttcccctggccaccctcctccaagagcacctctgggggcacgagcggccctgggctgcctggtcaaggactacttccatctacactactgagcgggctggcaaggcgcatagnnnnnn

SEQ ID NO: 177772 - DNA, 391 bp, Homo sapiens
  misc_feature: GYAE6OF01BH6LQ.37.76.G10.1.454.CMB.1.raw
  modified_base (222)..(222): a, c, t, g, unknown or other
  misc_feature (222)..(222): n is a, c, g, or t
  modified_base (378)..(391): a, c, t, g, unknown or other
  misc_feature (378)..(391): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgacaaaggatcagtatcaactggctgtcaatacttttgatatttggggccaaggnacaatggtcagcgtctcttcagcctcaccaaggccatcggtctcccctggcgccctgctccaggagcacctccgagacgcacagcggccctgggctgcctggtccaaaggactaacttcatctacacgtactgagcgggctggcaggcgctatagnnnnnnnnnnnnnn

SEQ ID NO: 177773 - DNA, 501 bp, Homo sapiens
  misc_feature: GYAE6OF01B6R0Q.37.76.G10.1.454.CMB.1.raw
  modified_base (460)..(501): a, c, t, g, unknown or other
  misc_feature (460)..(501): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgacaaaggatcagtatcaacgtggctgtactaattactttttgataagtttggggaccaaaggcacaaatggtcagcgtctcttcagccctaccaaccaacgggcccaatcggttcccttcccccgtggacccacccctcctaccaaagacgccaacccgttcgcgggggaccacgacggcccggcccgtggggcctcggtccctagggtaccaaagggtaccttacctttaccaatcctaacgtacctacgtgacgggtcgggactcgggacgaaacgggcgaccaagaggnnnnnnnnnnnnnnnnnnnnnnnnnnnnnnnnnnnnnnnnnn

SEQ ID NO: 177774 - DNA, 385 bp, Homo sapiens
  misc_feature: GYAE6OF01B0CPX.37.76.G10.1.454.CMB.1.raw
  modified_base (175)..(175): a, c, t, g, unknown or other
  misc_feature (175)..(175): n is a, c, g, or t
  modified_base (377)..(385): a, c, t, g, unknown or other
  misc_feature (377)..(385): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggntcagtatcaactggctgtcaatacttttgatatttggggccaaggcacaatggtcagcgtctcttcagcctccaccaagggcccatcggtcttcccctggcaccctcctccaagacgcacctcgtgggggcacagcggccctgggctgcctggcaaggctacttccatctacactactgagcgggctggacaaggcgcatgnnnnnnnnn

SEQ ID NO: 177775 - DNA, 379 bp, Homo sapiens
  misc_feature: GYAE6OF01AI1D2.37.76.G10.1.454.CMB.1.raw
  modified_base (366)..(366): a, c, t, g, unknown or other
  misc_feature (366)..(366): n is a, c, g, or t
  modified_base (371)..(379): a, c, t, g, unknown or other
  misc_feature (371)..(379): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatattggggccaaggcacaatggtcagcgtctcttcagcctccaccaagggcccatcggtcttcccctgcaccctcctccaagacgcacctctgggggcacagcggccctgggctgcctggtcaaggctactccatctacactactgagcggctggcaggcncatgnnnnnnnnn

SEQ ID NO: 177776 - DNA, 520 bp, Homo sapiens
  misc_feature: GYAE6OF01CFGJD.37.76.G10.1.454.CMB.1.raw
  modified_base (178)..(178): a, c, t, g, unknown or other
  misc_feature (178)..(178): n is a, c, g, or t
  modified_base (483)..(483): a, c, t, g, unknown or other
  misc_feature (483)..(483): n is a, c, g, or t
  modified_base (486)..(520): a, c, t, g, unknown or other
  misc_feature (486)..(520): n is a, c, g, or t
tcagtagtgtagatcacgaccggtgctcgatttagtcactcatacagggagttcttggcgtttgtctctgtgaagggccgattcaccatctccagagacaacgccaagaactccctgtatctgcaaatgaacagtctgagagctgaaggacacggccttgtattactgtgacaaaggntcagtatcaactggctgtactaattacttttgattacgtttggggaccaaagggcaacgtaaagtcggtaccagtccgttcttccttcacggtccccttacccaaccgaacggggtccctaacgttccggtccctttaccccctcgggaccctaccccctcctaccaacgacgccacccgttcgcggggccaacgacggccggcccgtgggcctcgccgtacggtaccgaaggtaccttacgtaccattaccgtaactacgttacgtcggacggcgggtactcgggaacgaaacggcgactaagngannnnnnnnnnnnnnnnnnnnnnnnnnnnnnnnnnn

SEQ ID NO: 177777 - DNA, 405 bp, Homo sapiens
  misc_feature: GYAE6OF01BH3LL.37.76.G10.1.454.CMB.1.raw
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (392)..(405): a, c, t, g, unknown or other
  misc_feature (392)..(405): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgattagtttggggaccaaggcacaagtggtcagcgtctcttcagcctccaccaggcccatcgtcctccctgccaccctcctcaagcgccacctcgtcggggcacacggccggcccgtgggcctcgcctggaccaaggtcttacttccatctacactactgagccgggntgggaccgaggcncgatacgnnnnnnnnnnnnnn

SEQ ID NO: 177778 - DNA, 538 bp, Homo sapiens
  misc_feature: GYAE6OF01DQFDL.37.76.G10.1.454.CMB.1.raw
  modified_base (497)..(538): a, c, t, g, unknown or other
  misc_feature (497)..(538): n is a, c, g, or t
tcagtagtgtagatcacgaccggtgctcgatttagtcactcatacagggagttcttggcgttgtctctgtgaagggccgattcaccatctccagagacaacgccaaagaactccctgtatctgacaaatgaaacagtctgagagctgaggacgacggccttgtattactgtgacaaaaggatcagtatcaacgtggctgtacaaattacttttgaattagtttgggggaccaaagggcaacaatgggtacagcgttctcttacgacgtccctacccaaccgaacgggtacccacgttccggtccctttccccgtcggcctacccctccctaccaacggtacgacctacccgttcggtacgggggacaccgacggcccgggccccggtgggcgtcggtcccgtagggtacgtaacggttacctaccgttaccaacttactaactaacctacgtacggacgggtcggtacgacgggacgaacgggtccgacgagtagannnnnnnnnnnnnnnnnnnnnnnnnnnnnnnnnnnnnnnnnn

SEQ ID NO: 177779 - DNA, 389 bp, Homo sapiens
  misc_feature: GYAE6OF01AMJSW.37.76.G10.1.454.CMB.1.raw
  modified_base (175)..(175): a, c, t, g, unknown or other
  misc_feature (175)..(175): n is a, c, g, or t
  modified_base (372)..(372): a, c, t, g, unknown or other
  misc_feature (372)..(372): n is a, c, g, or t
  modified_base (378)..(389): a, c, t, g, unknown or other
  misc_feature (378)..(389): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggntcagtatcaactggctgtcaattacttttgattagtttggggccaaggcacaatggtcagcgttctcttcagcctccaccaagggcccatcggtcttcccctggccaccctcctccaagagccacctctggggcacagcgccctgggctgcctggtcaaggctacttccatctacactactgagcggctggcaggcncatagnnnnnnnnnnnn

SEQ ID NO: 177780 - DNA, 441 bp, Homo sapiens
  misc_feature: GYAE6OF01AVERW.37.76.G10.1.454.CMB.1.raw
  modified_base (298)..(298): a, c, t, g, unknown or other
  misc_feature (298)..(298): n is a, c, g, or t
  modified_base (412)..(441): a, c, t, g, unknown or other
  misc_feature (412)..(441): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtacaattacttttgattatttggggccaaggcacaatggtcagcgtctcttcagcctccaccgaacgggcccatcggtccttcccctggccaccctcctccaacgngcctacctcgtcggggcacgacgccggccctgggcctcggccgttggacaacggacctacttccatcctacactactggacgtcgggctacgggcaaacggccgacaatacggnnnnnnnnnnnnnnnnnnnnnnnnnnnnnn

SEQ ID NO: 177781 - DNA, 370 bp, Homo sapiens
  misc_feature: GYAE6OF01EZOR3.37.76.G10.1.454.CMB.1.raw
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (359)..(370): a, c, t, g, unknown or other
  misc_feature (359)..(370): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaaggccatcgtctccctgcaccctctccagancacctctggggcacagcgcctggctgctgcacgctactcatctacnctactgagcgggntcggacaggcgcatagnnnnnnnnnnnn

SEQ ID NO: 177782 - DNA, 533 bp, Homo sapiens
  misc_feature: GYAE6OF01BXLD8.37.76.G10.1.454.CMB.1.raw
  modified_base (177)..(177): a, c, t, g, unknown or other
  misc_feature (177)..(177): n is a, c, g, or t
  modified_base (260)..(260): a, c, t, g, unknown or other
  misc_feature (260)..(260): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (496)..(533): a, c, t, g, unknown or other
  misc_feature (496)..(533): n is a, c, g, or t
tcagtagtgtagatcacgaccggtgctcgatttagtcactcatacagggagtttcttggcgttgtctctgtggaagggccgattcaccatctccagagacaacgccaagaactccctgtatctgcaaatgaacagtctgagagctgaggacacggccttgtattactgtgcaaaggntcagtatcaacgtggctgtacaattacttttgattagtttgggggaccaaggtcaacaagtgggtacaggtcgttctcttacncgccctacccaccgaacgggccctaagtccggttaccctttcccccgtggtccctaccccgttcccctacccgtaacgaccgccgtacccgtcgggtccgggggaccgaccgtacggcccgggtcccgtcgggcgtcgtccgttcggacgtaacggaacgttcctaccagtacctacacgtactggacggcggcgtcgaggacggcgtaccgaagtcggngtcangtcngatncgnnnnnnnnnnnnnnnnnnnnnnnnnnnnnnnnnnnnnn

SEQ ID NO: 177783 - DNA, 660 bp, Homo sapiens
  misc_feature: GYAE6OF01ECY0Q.37.76.G10.1.454.CMB.1.raw
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (564)..(564): a, c, t, g, unknown or other
  misc_feature (564)..(564): n is a, c, g, or t
  modified_base (579)..(579): a, c, t, g, unknown or other
  misc_feature (579)..(579): n is a, c, g, or t
  modified_base (587)..(587): a, c, t, g, unknown or other
  misc_feature (587)..(587): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (612)..(612): a, c, t, g, unknown or other
  misc_feature (612)..(612): n is a, c, g, or t
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (634)..(634): a, c, t, g, unknown or other
  misc_feature (634)..(634): n is a, c, g, or t
  modified_base (647)..(647): a, c, t, g, unknown or other
  misc_feature (647)..(647): n is a, c, g, or t
  modified_base (654)..(654): a, c, t, g, unknown or other
  misc_feature (654)..(654): n is a, c, g, or t
tcagtagtgtagatcacgaccggtgctcgatttagtcactcatacagggagttcttggcgttgtctctgtgaagggccgattcaccatctccagagacaacgccaagaactccctgtatctgacaaatgaactagtctgaagagcgtgaggacgacggcctttagtacttactgtagacgaaaggatacgatactactaacgtggctagtacctaatttacgttttagtagtttacgtttacggggaccaaaggtacaactaagttcggtaacctagtccggttctttaccttacgaacctcccgtaccaaccggtaaccgggcccctaaggttcccggttcccctccccggtacgacccctacccctaccgtaccaacggtaccgaccttaccgggtccgggtacgggggtaccaacccggtacgggcccggtacccggtcgggtcgtaccgccggtacggtacaacggtaccttaccgtacctacttaccctaactacgtacgtacgggaacgtcgggacgtacggaacggacgggtccaactaggtacngtacngacgcgnagagtacgtcagacncacagtgncactancngangtagtacngngtangagtnacgancncgttaggacncactcgatcaganactacgnggtcgg

SEQ ID NO: 177784 - DNA, 425 bp, Homo sapiens
  misc_feature: GYAE6OF01EITMG.37.76.G10.1.454.CMB.1.raw
  modified_base (175)..(175): a, c, t, g, unknown or other
  misc_feature (175)..(175): n is a, c, g, or t
  modified_base (236)..(236): a, c, t, g, unknown or other
  misc_feature (236)..(236): n is a, c, g, or t
  modified_base (379)..(425): a, c, t, g, unknown or other
  misc_feature (379)..(425): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaaatgaacagtctgagagctgaggcacggccttgtattactgtgcaaaggntcagtatcaactggctgtcaatacttttgatatttggggccaaggcacaatggtcagcgtntcttcagcctccaccaagggcccatcggtcttcccctggcacccctcctccaagagcacctctgggggcacagcgccctgggctgcctggtcaaggactactcatctacactactgagcgggctggcaaagggcgcagtacgnnnnnnnnnnnnnnnnnnnnnnnnnnnnnnnnnnnnnnnnnnnnnnn

SEQ ID NO: 177785 - DNA, 380 bp, Homo sapiens
  misc_feature: GYAE6OF02IUC96.37.76.G10.1.454.CMB.1.raw
  modified_base (376)..(380): a, c, t, g, unknown or other
  misc_feature (376)..(380): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctggggcacagcggccctgggctgcctggtcaaggctacttccatctacactactgagcgggctggcaaggcgcatagnnnnn

SEQ ID NO: 177786 - DNA, 431 bp, Homo sapiens
  misc_feature: GYAE6OF02JN99J.37.76.G10.1.454.CMB.1.raw
  modified_base (221)..(221): a, c, t, g, unknown or other
  misc_feature (221)..(221): n is a, c, g, or t
  modified_base (272)..(272): a, c, t, g, unknown or other
  misc_feature (272)..(272): n is a, c, g, or t
  modified_base (412)..(412): a, c, t, g, unknown or other
  misc_feature (412)..(412): n is a, c, g, or t
  modified_base (415)..(423): a, c, t, g, unknown or other
  misc_feature (415)..(423): n is a, c, g, or t
  modified_base (425)..(431): a, c, t, g, unknown or other
  misc_feature (425)..(431): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttgggtccaaggnacacaatgtcgagcgtctcttcacgcctccaccaacggaccgacgtccggnttccccgttccccgtccgcctccctccctaccgacgacgaccacctcggtcgggcgacacgccgccggcggcgtcgtcgtcgtacgacgactacctactactactactactactacgacggcggcgcgacgacgcgacanagnnnnnnnnnannnnnnn

SEQ ID NO: 177787 - DNA, 377 bp, Homo sapiens
  misc_feature: GYAE6OF02I66O2.37.76.G10.1.454.CMB.1.raw
  modified_base (374)..(377): a, c, t, g, unknown or other
  misc_feature (374)..(377): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatactttgatatttgggccaaggcacaatggtcagcgtctcttcagcctccaccaagggcccatcggtcttccccctggcaccctcctccaagagcacctctggggcacagcggccctgggctgcctggtcaaggctacttccatctacactactgagcgggctggcaaggcgcatagnnnn

SEQ ID NO: 177788 - DNA, 382 bp, Homo sapiens
  misc_feature: GYAE6OF02F7A92.37.76.G10.1.454.CMB.1.raw
  modified_base (378)..(382): a, c, t, g, unknown or other
  misc_feature (378)..(382): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 177789 - DNA, 503 bp, Homo sapiens
  misc_feature: GYAE6OF02GOQ9B.37.76.G10.1.454.CMB.1.raw
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (434)..(435): a, c, t, g, unknown or other
  misc_feature (434)..(435): n is a, c, g, or t
  modified_base (437)..(438): a, c, t, g, unknown or other
  misc_feature (437)..(438): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (456)..(461): a, c, t, g, unknown or other
  misc_feature (456)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (468)..(469): a, c, t, g, unknown or other
  misc_feature (468)..(469): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (486)..(487): a, c, t, g, unknown or other
  misc_feature (486)..(487): n is a, c, g, or t
  modified_base (489)..(490): a, c, t, g, unknown or other
  misc_feature (489)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(503): a, c, t, g, unknown or other
  misc_feature (498)..(503): n is a, c, g, or t
tcagtagtgtagatcacgaccggtgctcgatttagtcactcatacaggggagttacttggcgttgtcttcgtcgtgaaggggacccgaatttcgaaccacctctcccagagactaacgcctaacgaacctccctgtatctgcaaactgaacagtctgagagctgaggacacggccttgtattacctgtcgccaaaggatcagtatccaacgtaggctcgtccaataccttttgatagtttcggggccaaggcacaatggtcagcgtctcttcagccctcaccaagggaccccagtccggtacttcccccctcggccgacccctccctccaagacgcacctctgggggcacacgcggacccgtcgggactgcctggtccaaggcctacgttccatcgtacactacgtgaggcggctggcaaggcncactagnagnncnncagtcngangttantatnnnnnnananatnncnctntntgcgngnngnnannananangnnnnnn

SEQ ID NO: 177790 - DNA, 386 bp, Homo sapiens
  misc_feature: GYAE6OF02I42U2.37.76.G10.1.454.CMB.1.raw
  modified_base (379)..(386): a, c, t, g, unknown or other
  misc_feature (379)..(386): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctgggggcacagcggccctgggctgcctggtcaaggactacttccatctacactactgagcgggctggccaaggcgcatagnnnnnnnn

SEQ ID NO: 177791 - DNA, 382 bp, Homo sapiens
  misc_feature: GYAE6OF02I1KLF.37.76.G10.1.454.CMB.1.raw
  modified_base (377)..(382): a, c, t, g, unknown or other
  misc_feature (377)..(382): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctggggcacagcggccctgggctgcctggtcaaggactacttccatctacactactgagcgggctggcaaggcgcatagnnnnnn

SEQ ID NO: 177792 - DNA, 382 bp, Homo sapiens
  misc_feature: GYAE6OF02I9606.37.76.G10.1.454.CMB.1.raw
  modified_base (377)..(382): a, c, t, g, unknown or other
  misc_feature (377)..(382): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctgggggcacagcggccctgggctgcctggtcaaggctacttccatctacactactgagcgggctggcaaggcgcatagnnnnnn

SEQ ID NO: 177793 - DNA, 381 bp, Homo sapiens
  misc_feature: GYAE6OF02G1U0Y.37.76.G10.1.454.CMB.1.raw
  modified_base (373)..(381): a, c, t, g, unknown or other
  misc_feature (373)..(381): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaaggcccatcggtcttccccctgcaccctcctccaagagcacctctgggggcacagcggccctgggctgcctggcaaggactactccatctacactactgagcggctggcaaggcgcatagnnnnnnnnn

SEQ ID NO: 177794 - DNA, 381 bp, Homo sapiens
  misc_feature: GYAE6OF02GEWHX.37.76.G10.1.454.CMB.1.raw
  modified_base (377)..(381): a, c, t, g, unknown or other
  misc_feature (377)..(381): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctgggggcacagcggccctgggctgcctggtcaaggctacttccatctacactactgagcgggctggcaaggcgcatagnnnnn

SEQ ID NO: 177795 - DNA, 546 bp, Homo sapiens
  misc_feature: GYAE6OF02G0VGE.37.76.G10.1.454.CMB.1.raw
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (479)..(483): a, c, t, g, unknown or other
  misc_feature (479)..(483): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (497)..(500): a, c, t, g, unknown or other
  misc_feature (497)..(500): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (538)..(539): a, c, t, g, unknown or other
  misc_feature (538)..(539): n is a, c, g, or t
  modified_base (541)..(541): a, c, t, g, unknown or other
  misc_feature (541)..(541): n is a, c, g, or t
  modified_base (543)..(545): a, c, t, g, unknown or other
  misc_feature (543)..(545): n is a, c, g, or t
tcagtagtgtagatcacgaccggtgctcgatttagtcactcatactaggggtagggttcttcggcgttgtcgtctgtgaagggccgagttcaccatcgtcccagagacaacgccaaggaactccctgtatctgcaaatgaaccaggtctcgaagagctgaggaccacggccttgtacttactgtcgcaaaggtatcagtatcaactggctggtcaatacttttgatactttggggccaaggtcacgaatggtcagcgtctcttcagcctcctaccaacgggcccatcggcttccccctggaccaccgtacctcccaaagacgcacctctgggggccacgacgcggcccttagggtcgtaggtcccggtcggtactaacgggacgttaaccttccgacttcgtacgacttactgggaacgaccggggactttcgggacctaacgggtccggactaagtacggancggcctagcagtcngnnnnnctactatncncacnnnntctcncnctcgcgngngacgngngngnagngcngngcnncncnnnc

SEQ ID NO: 177796 - DNA, 381 bp, Homo sapiens
  misc_feature: GYAE6OF02G88UQ.37.76.G10.1.454.CMB.1.raw
  modified_base (374)..(381): a, c, t, g, unknown or other
  misc_feature (374)..(381): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctggggcacagcggccctgggctgcctggtcaaggctactccatctacactactgagcggctggcaaggcgcatagnnnnnnnn

SEQ ID NO: 177797 - DNA, 386 bp, Homo sapiens
  misc_feature: GYAE6OF02F8JY0.37.76.G10.1.454.CMB.1.raw
  modified_base (381)..(386): a, c, t, g, unknown or other
  misc_feature (381)..(386): n is a, c, g, or t
tcagtagtgtagatcacgaccggtgctcgatttagtcactcatacagggagttcttggcgttgtctctgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 177798 - DNA, 371 bp, Homo sapiens
  misc_feature: GYAE6OF02ILAIY.37.76.G10.1.454.CMB.1.raw
  modified_base (363)..(371): a, c, t, g, unknown or other
  misc_feature (363)..(371): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggctatttattactgcgcgagagaaggactgggcggtttcgactactggggccagggaaccctggtcaccgtctcctcagcctccaccaaggcccatcggtcttccccctggcgccctgctccaggagcacctccgagagcacagcggccctggctgcctggtcaaggctacttccatctacactactgagcgggctggcaaggcgcatagnnnnnnnnn

SEQ ID NO: 177799 - DNA, 380 bp, Homo sapiens
  misc_feature: GYAE6OF02IFAZ8.37.76.G10.1.454.CMB.1.raw
  modified_base (376)..(380): a, c, t, g, unknown or other
  misc_feature (376)..(380): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagacgcacctctgggggcacagcggccctgggctgcctggtcaaggctactccatctacactactgagcgggctggcaggcgcatagnnnnn

SEQ ID NO: 177800 - DNA, 383 bp, Homo sapiens
  misc_feature: GYAE6OF02HG8X8.37.76.G10.1.454.CMB.1.raw
  modified_base (377)..(383): a, c, t, g, unknown or other
  misc_feature (377)..(383): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcacccctcctccaagagcacctcgtggggcacagcggccctgggctgcctggtcaaggctactccatctacactactgagcgggctggcaaggcgcatagnnnnnnn

SEQ ID NO: 177801 - DNA, 385 bp, Homo sapiens
  misc_feature: GYAE6OF02GGYUZ.37.76.G10.1.454.CMB.1.raw
  modified_base (377)..(385): a, c, t, g, unknown or other
  misc_feature (377)..(385): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttgggccaaggcacaatggtcagcgtctcttcagcctccatcaagggcccatcggtcttccccctggcaccctcctccaagagcacctctgggggcacagcggccctgggctgcctggtcaaggactacttccatctacactactgagcgggctggcaaggcgcatagnnnnnnnnn

SEQ ID NO: 177802 - DNA, 409 bp, Homo sapiens
  misc_feature: GYAE6OF02GDVEN.37.76.G10.1.454.CMB.1.raw
  modified_base (395)..(395): a, c, t, g, unknown or other
  misc_feature (395)..(395): n is a, c, g, or t
  modified_base (401)..(409): a, c, t, g, unknown or other
  misc_feature (401)..(409): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaattacttttgattagtttggggccaaggcacaatggtcagcgtctctcagcctccaccaagggcccatcggtcttccccctggccaccctcctcccaagacgccaccctcgtcggggggccacgacggccggccccgtggggcctcggcctggtccaaggactacttccatcctacactactgagcgggctggacaggcncatagnnnnnnnnn

SEQ ID NO: 177803 - DNA, 411 bp, Homo sapiens
  misc_feature: GYAE6OF02GY95W.37.76.G10.1.454.CMB.1.raw
  modified_base (397)..(400): a, c, t, g, unknown or other
  misc_feature (397)..(400): n is a, c, g, or t
  modified_base (402)..(411): a, c, t, g, unknown or other
  misc_feature (402)..(411): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaattacttttgattatttgggggaccaaggcacaatggtcagcgtctcttcagcctccaccaaggccatcggtcttccccctggccaccctcctccaagacgcacctcgtgggggccacgacgccggccctgggccttgccctggtccaagggactacgttccagttctacactactgaagcgggctggcaggcgcagtgacnnnntnnnnnnnnnn

SEQ ID NO: 177804 - DNA, 383 bp, Homo sapiens
  misc_feature: GYAE6OF02I4D8A.37.76.G10.1.454.CMB.1.raw
  modified_base (377)..(383): a, c, t, g, unknown or other
  misc_feature (377)..(383): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctggggcacagcggccctgggctgcctggtcaaggactacttccatctacactactgagcgggctggcaaggcgcatagnnnnnnn

SEQ ID NO: 177805 - DNA, 404 bp, Homo sapiens
  misc_feature: GYAE6OF02GGRKW.37.76.G10.1.454.CMB.1.raw
  modified_base (352)..(352): a, c, t, g, unknown or other
  misc_feature (352)..(352): n is a, c, g, or t
  modified_base (381)..(404): a, c, t, g, unknown or other
  misc_feature (381)..(404): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagccgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagacgcacctctgggggccacgagccggccctgggctgccgtggtacgaggactactcatctanctactgagcgggctggcaaggcgcatagnnnnnnnnnnnnnnnnnnnnnnnn

SEQ ID NO: 177806 - DNA, 380 bp, Homo sapiens
  misc_feature: GYAE6OF02HEAT9.37.76.G10.1.454.CMB.1.raw
  modified_base (373)..(380): a, c, t, g, unknown or other
  misc_feature (373)..(380): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctggggcacagcggccctggctgcctggtcaaggactactccatctacactactgagcggctggcaaggcgcatgnnnnnnnn

SEQ ID NO: 177807 - DNA, 430 bp, Homo sapiens
  misc_feature: GYAE6OF02HN8Q7.37.76.G10.1.454.CMB.1.raw
  modified_base (405)..(405): a, c, t, g, unknown or other
  misc_feature (405)..(405): n is a, c, g, or t
  modified_base (408)..(430): a, c, t, g, unknown or other
  misc_feature (408)..(430): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaaattacttttgattatttgggggccaaaggcaacaaatggtcagcgtctcttcagccctccaccgaaacgggcccagtcggtccttcccccctggccacccctcctacccaagacgcacctcgtgggggccacgagccggccctgggctgtccgtggtacaaggtactactccatctactactactgagcggctggcaaaggcacatagncgnnnnnnnnnnnnnnnnnnnnnnn

SEQ ID NO: 177808 - DNA, 400 bp, Homo sapiens
  misc_feature: GYAE6OF02HIYSE.37.76.G10.1.454.CMB.1.raw
  modified_base (378)..(400): a, c, t, g, unknown or other
  misc_feature (378)..(400): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaagggcccatcggtcttccccctggcaccctcctccaagagcacctctgggggcacagcggccctgggctgcctggtcaaggactactccatctacactactgagcgggctggcaaggcgcaatagnnnnnnnnnnnnnnnnnnnnnnn

SEQ ID NO: 177809 - DNA, 415 bp, Homo sapiens
  misc_feature: GYAE6OF02F06GY.37.76.G10.1.454.CMB.1.raw
  modified_base (405)..(415): a, c, t, g, unknown or other
  misc_feature (405)..(415): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagcctccaccaacgggcccatccggtccttcccccctcggccacccctcctacccaagacgccacctcgtgggggccacacggccggcccgtggggctgccgtggtccaaggacctacttccactctaccactactgagcgggcgtggcgaaggcgacatacgnnnnnnnnnnn

SEQ ID NO: 177810 - DNA, 481 bp, Homo sapiens
  misc_feature: GYAE6OF02IPIO5.37.76.G10.1.454.CMB.1.raw
  modified_base (236)..(236): a, c, t, g, unknown or other
  misc_feature (236)..(236): n is a, c, g, or t
  modified_base (436)..(436): a, c, t, g, unknown or other
  misc_feature (436)..(436): n is a, c, g, or t
  modified_base (456)..(456): a, c, t, g, unknown or other
  misc_feature (456)..(456): n is a, c, g, or t
  modified_base (458)..(481): a, c, t, g, unknown or other
  misc_feature (458)..(481): n is a, c, g, or t
tcagtagtgtagatcacgaccggtgctcgatttagtcactcatacagggagttcttggcgttgtctctgtgaagggccgattcaccatctccagagacaacgccaagaactccctgtatctgacaaatgaacagtctgagagctggaggacacggtccttgtattactgtgacaaaggatcagtactacaactggctgtactaattacttttgattacgttggggaccaaggcaanaagtggtacaggcgtcttactacgactccctaccaaccgaacgggccagttccggtcccttcccccgtgacccctacccttaccgacccgaaggcctaccaccgttcgggacggggccacgacggcccggtccgtagggctccggcgtcgggtaacaacggtacttaccttacactacctaaccatcgtggacgtccggngtacgacgaagtcgataagngnnnnnnnnnnnnnnnnnnnnnnnn

SEQ ID NO: 177811 - DNA, 466 bp, Homo sapiens
  misc_feature: GYAE6OF02J2CDV.37.76.G10.1.454.CMB.1.raw
  modified_base (171)..(171): a, c, t, g, unknown or other
  misc_feature (171)..(171): n is a, c, g, or t
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (409)..(409): a, c, t, g, unknown or other
  misc_feature (409)..(409): n is a, c, g, or t
  modified_base (416)..(420): a, c, t, g, unknown or other
  misc_feature (416)..(420): n is a, c, g, or t
  modified_base (423)..(424): a, c, t, g, unknown or other
  misc_feature (423)..(424): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (434)..(466): a, c, t, g, unknown or other
  misc_feature (434)..(466): n is a, c, g, or t
tcagtagtgtagatcacgaccggtgctcgatttagtcactcatacaggggagttcttggcgttgtctctgtgaagggccggattcaccatctccagagacaacgccaagaactccctgtatctgcaaatgaacagtctgagagctggaggacacggtccttgtattactgngcaaaggatcagtatcaacgtggctgtcaattacttttgatatttgggggccaaggcacaatgggtcancgtctcttcagccctcaccaggccancgtctcccctggcnccctcctcagtacncacctcgtcgggggcacgagcggcccttgggctggccctggtacaacgggactccttacgacctctaacacgttaccgtggagtccgggggccttggaccgaaacgggcgcttanacggtcnnnnntannagtngatnannnnnnnnnnnnnnnnnnnnnnnnnnnnnnnnn

SEQ ID NO: 177812 - DNA, 459 bp, Homo sapiens
  misc_feature: GYAE6OF02JD71G.37.76.G10.1.454.CMB.1.raw
  modified_base (411)..(411): a, c, t, g, unknown or other
  misc_feature (411)..(411): n is a, c, g, or t
  modified_base (418)..(419): a, c, t, g, unknown or other
  misc_feature (418)..(419): n is a, c, g, or t
  modified_base (421)..(459): a, c, t, g, unknown or other
  misc_feature (421)..(459): n is a, c, g, or t
tcagtagtgtagatcacgaccggtgctcgatttagtcactcatacagggagttcgttggcgttgtctctgtgaagggccgattcaccatctccagagacaacgccaagaactccctgtatctgcaaatgaacagtctgagagctgaggacacggccttgtattactgtgcaaaggatcagtatcaactggctgtcaatacttttgatatttggggccaaggcacaatggtcagcgtctcttcagccttccaccaagggccccatcggtccttcccccctggccaccccgtccctccccaaagacgaccacctcgtggggggccacagccggccctgggcctggcccttgggtaccaacgggaccttacttccagttcctacacctactgacggcgggctcggacaacggcncataggnngnnnnnnnnnnnnnnnnnnnnnnnnnnnnnnnnnnnnnnn

SEQ ID NO: 177813 - DNA, 497 bp, Homo sapiens
  misc_feature: GYAE6OF02HALTA.37.76.G10.1.454.CMB.1.raw
  modified_base (485)..(497): a, c, t, g, unknown or other
  misc_feature (485)..(497): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggatcagtatcaaactggctgtcaattactttttgaattagtttgggggacccaaaggcaacgtaaatgggtacaagccgtcttccttcaagtcccttacccaaccaacggggccccaagttccggtccctttcccccccgtggcccaaccccgttccctacccaaacgacgcccaacccttccggtgggggaccaaccgtacggcccgggcccgttggggcctggccccgttggtaccgaaggtacctacttcccaacgttctaacctaacgtactggtacggcggggtactggacgaaacggcgcagtagnnnnnnnnnnnnn

SEQ ID NO: 177814 - DNA, 464 bp, Homo sapiens
  misc_feature: GYAE6OF02I75NN.37.76.G10.1.454.CMB.1.raw
  modified_base (395)..(395): a, c, t, g, unknown or other
  misc_feature (395)..(395): n is a, c, g, or t
  modified_base (426)..(464): a, c, t, g, unknown or other
  misc_feature (426)..(464): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagccgaggacacggctatttattactgcgcgagagaaaggacctgggtcggtttcgactacgtggggccaagggaaccctgggtccaccgtctcctcacgcctccaccgaaacgggccccaatccgggtccttccccccgtggacccgccccgtgtccctacccgaagggcgacctacccgtaccggaagacgaccaactacggccggttccgtgggctcgcctgggacaaggaccttactccatcacacgttacngaggcggacgtcggacgaaggcgacagtagnnnnnnnnnnnnnnnnnnnnnnnnnnnnnnnnnnnnnnn

SEQ ID NO: 177815 - DNA, 422 bp, Homo sapiens
  misc_feature: GYAE6OF02FFM2I.37.76.G10.1.454.CMB.1.raw
  modified_base (175)..(175): a, c, t, g, unknown or other
  misc_feature (175)..(175): n is a, c, g, or t
  modified_base (398)..(399): a, c, t, g, unknown or other
  misc_feature (398)..(399): n is a, c, g, or t
  modified_base (402)..(422): a, c, t, g, unknown or other
  misc_feature (402)..(422): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcaaaggntcagtatcaactggctgtcaattacttttgatagtttggggccaaggcacaatggtcagcgtctcttcagccctccaccaagggcccatcggtccttcccccctggccacccctccctccaacgtagccaccctcgtcggggcacgagcggcccgtgggctcgcctggtcaaggactacttccatctacactactgacgcgggctggccaaggtcgcactagnncannnnnnnnnnnnnnnnnnnnn

SEQ ID NO: 177816 - DNA, 512 bp, Homo sapiens
  misc_feature: GYAE6OF02GFHM3.37.76.G10.1.454.CMB.1.raw
  modified_base (288)..(288): a, c, t, g, unknown or other
  misc_feature (288)..(288): n is a, c, g, or t
  modified_base (468)..(468): a, c, t, g, unknown or other
  misc_feature (468)..(468): n is a, c, g, or t
  modified_base (470)..(512): a, c, t, g, unknown or other
  misc_feature (470)..(512): n is a, c, g, or t
tcagtagtgtagatcacgaccggtgctcgatttagtcactcatacagggagttcttggcgttgtctctgtgaagggccgattcaccatctccagagacaacgccaagaactccctgtatctgcaaatgaacagtctgagagctgaggacacggccttgtattactgtgcgagagatcagacggagtatagcagcagctctgactacgtgggccaccggaaccctggtccaccgtctcctcacgccctccaccaacgggcccagtccggtcctttccccccgtggcccncccctccctacccaagacggcccaccctcgtcgggggaccaccgacggccgggccctcggggccgtcggtcccgtcggtacgaaacggaccgttaccttcccgtaattccctaacctaaccttaccgtaggaacggccgggtaccgttacgggccgtaaacgggccgacctaagtaggcngnnnnnnnnnnnnnnnnnnnnnnnnnnnnnnnnnnnnnnnnnnn

SEQ ID NO: 177817 - DNA, 403 bp, Homo sapiens
  misc_feature: GYAE6OF02IK3H7.37.76.G10.1.454.CMB.1.raw
  modified_base (384)..(384): a, c, t, g, unknown or other
  misc_feature (384)..(384): n is a, c, g, or t
  modified_base (391)..(403): a, c, t, g, unknown or other
  misc_feature (391)..(403): n is a, c, g, or t
tcagtagtgtagatcacgaccggtgctcgatttagtcactcatacagggagttcttggcgttgtctctgtgaagggccgattcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctcaccaagggcccatccggtccttccccctggccgccctgcctccaggacgcacctccgagagcacagccggcccgtgggctgcctggcaaggctacgttccatctacactactgagcggctggcaggcncatacgnnnnnnnnnnnnn

SEQ ID NO: 177818 - DNA, 533 bp, Homo sapiens
  misc_feature: GYAE6OF02FORWA.37.76.G10.1.454.CMB.1.raw
  modified_base (180)..(180): a, c, t, g, unknown or other
  misc_feature (180)..(180): n is a, c, g, or t
  modified_base (251)..(251): a, c, t, g, unknown or other
  misc_feature (251)..(251): n is a, c, g, or t
  modified_base (354)..(354): a, c, t, g, unknown or other
  misc_feature (354)..(354): n is a, c, g, or t
  modified_base (484)..(484): a, c, t, g, unknown or other
  misc_feature (484)..(484): n is a, c, g, or t
  modified_base (486)..(493): a, c, t, g, unknown or other
  misc_feature (486)..(493): n is a, c, g, or t
  modified_base (495)..(503): a, c, t, g, unknown or other
  misc_feature (495)..(503): n is a, c, g, or t
  modified_base (505)..(533): a, c, t, g, unknown or other
  misc_feature (505)..(533): n is a, c, g, or t
tcagtagtgtagatcacgaccggtgctcgatttagtcactcatacaggggagttcttggcgttgtctctgtgaagggccgattcaccatctccagagacaacgccaagaactccctgtatctgcaaatgaacagtctgagagctgaggaccacgggtccttgtaattactgtgcaaaggntcagtatcaactggctgtcaattcttttgattagtttgggggccaaggcacaatggtcagcgtctcttccngcctccaccgaacgggcccagtccggttccttcccccgtggcccaccctccctaccgaagacgccacctaccggtcgggggctaccgacggccgggtccccgnggggtacctcggtcccgtacgggttaccgaaacgggtaccttaacgttccctactaccgtaacctaaccgttaccgtggtaaccgggcggggtacctggggaaccgaagggtccgacgtaaggtagacgntnnnnnnnnannnnnnnnncnnnnnnnnnnnnnnnnnnnnnnnnnnnnn

SEQ ID NO: 177819 - DNA, 628 bp, Homo sapiens
  misc_feature: GYAE6OF02FNJC6.37.76.G10.1.454.CMB.1.raw
  modified_base (332)..(332): a, c, t, g, unknown or other
  misc_feature (332)..(332): n is a, c, g, or t
  modified_base (367)..(367): a, c, t, g, unknown or other
  misc_feature (367)..(367): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (514)..(514): a, c, t, g, unknown or other
  misc_feature (514)..(514): n is a, c, g, or t
  modified_base (601)..(601): a, c, t, g, unknown or other
  misc_feature (601)..(601): n is a, c, g, or t
  modified_base (609)..(609): a, c, t, g, unknown or other
  misc_feature (609)..(609): n is a, c, g, or t
tcagtagtgtagatcacgaccggtgctcgatttagtcactcatacagggagttcttggcgttgtctctgtgaagggccgattcaccatctccagagactattccaagagcacttctgtatctgacaaatgaacagcctgagtgccgaggacacggtccctatatttattgtgacgaaagtggtagggggaggtgggggctactccgtggtcgttttgacgtacggtgggccgagggcgtcccgttggtccaccgtcgtcctcgacgccctccaccgaacgggccctagtccggtccttcccccgtggcccgtcccgtcgcctaccgaggacnccctaccgtcggagacgcaacgcggccgtcccggnggcgtacgtcccgttaggtaccaaaggtccttacgttacccagttacctaacctactaccgtaggtacggccgggttccgtaggggaacctaaccgggggcctacggtaacgtagcggtccgngngcgtcgagatagtacgtgtacncgcgacagtctacgtgtcgtgacgcgacgtacgcgagtagtactacgtcgtactatacggcgtcgtacgtactcctacgtacgtacncgctacgngtcggagtccgtacgtacg

SEQ ID NO: 177820 - DNA, 389 bp, Homo sapiens
  misc_feature: GYAE6OF01BBTLP.11.12.B01.1.454.CMB.1.raw
  modified_base (387)..(389): a, c, t, g, unknown or other
  misc_feature (387)..(389): n is a, c, g, or t
tcagcgagagataccacgaccggtgctcgatttagtagtgtagatttgggttttccttgttgctattttaaaagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttcccctggcgccctgctccaggagcacctccgagagcacagcggccctgggctgcctggtcaaggactacttccgtatctctcctgagcgggctggcaaggcgcatagnnn

SEQ ID NO: 177821 - DNA, 164 bp, Homo sapiens
  misc_feature: GYAE6OF01CCJEQ.11.12.B01.1.454.CMB.1.raw
  modified_base (164)..(164): a, c, t, g, unknown or other
  misc_feature (164)..(164): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcgggctggcaaggcgcatagn

SEQ ID NO: 177822 - DNA, 392 bp, Homo sapiens
  misc_feature: GYAE6OF01CA3R1.11.12.B01.1.454.CMB.1.raw
  modified_base (388)..(392): a, c, t, g, unknown or other
  misc_feature (388)..(392): n is a, c, g, or t
tcagcgagagataccacgaccggtgctcgatttagtagtgtagatttgggttttccttgttgctattttaaaagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttcccctggcgccctgctccaggagcacctccgagagcacagcggccctgggctgcctggtcaaggactacttccgtatctctcgctgagcgggctggcaaggcgcatagnnnnn

SEQ ID NO: 177823 - DNA, 399 bp, Homo sapiens
  misc_feature: GYAE6OF01BB0OU.11.12.B01.1.454.CMB.1.raw
  modified_base (390)..(399): a, c, t, g, unknown or other
  misc_feature (390)..(399): n is a, c, g, or t
tcagcgagagataccacgaccggtgctcgatttagtagtgtagatttgggttttccttgttgctattttaaaagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggcccctgggctgcctggtcaaggactacttccgtatctctcgctgagcggctggcaaggcgcagtagnnnnnnnnnn

SEQ ID NO: 177824 - DNA, 662 bp, Homo sapiens
  misc_feature: GYAE6OF01EFST4.11.12.B01.1.454.CMB.1.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggctccgagggagggctggagtgggtcttctttattacngcagtggtagtacatactccgnagacgtccggtggagggccgtattcacactctaccagacgacaactctaaagaacncgtcttgtttactacaaatcgaaacagtcctagaacgacgaccgaagtacggaccgaccgggtcccgttagttaacttaaccgtggtacggacggtaacggaaggtaacgggttaccggggggaacccccctaaacgggttaaaccccgggtttaacctaaaccgggtccgtttaaagggtccggggttaacccggttaccgggtaccggggggtaaaccccgaaaacggggggtaaccccccg

SEQ ID NO: 177825 - DNA, 629 bp, Homo sapiens
  misc_feature: GYAE6OF01CQJXD.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggcctccgaggggaaggggctgggagtgggtctcctttattacagcagtggtagtacatattccgcagactccggtggacggggccgattccacctatcctccaagtacgaactaactctaaagaaccacgcttgtttaccttacaaattgaaacagcctaggacgagccgaatcggaaccaccggggtccgttaggttaactttaccgtggtacggtacggaagagggtagtaccggggggacccccaacgggtaaaccggtttaccaccggtacttaagtcggggtaaccgttcggtacggggggacccgaaagggggtaacccccg

SEQ ID NO: 177826 - DNA, 540 bp, Homo sapiens
  misc_feature: GYAE6OF01BAZ2Z.11.12.B01.1.454.CMB.1.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (521)..(521): a, c, t, g, unknown or other
  misc_feature (521)..(521): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggagggctggagtgggtctcctttattacngcagtggtagtacatattccgnagactcgtgacggggccattcaccatctccagagacaactcaagaacacgctgtttactacaaatgaacagcctgagacgccgatcgacacgggccgtgtatcgtgtgcgagagagtcggggcccaggtaaccgttacacgtctaagtcggacgttcgnggggcccgaagggtacccg

SEQ ID NO: 177827 - DNA, 562 bp, Homo sapiens
  misc_feature: GYAE6OF01BV4M1.11.12.B01.1.454.CMB.1.raw
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
  modified_base (478)..(478): a, c, t, g, unknown or other
  misc_feature (478)..(478): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccnccaggctccaggggaagggctggagtgggtctcctttatttacagcagtggtagtacatattcccgnagactccgtggacggggccgattcaccatctccagagacaactctaaagaacacgcttgtttcttacaaatgaacagcctagagagccgatgacacgggccgttgtattctgtgngagagagtcgggggcccaacggtaaccgttcctaacgcttaagtcgggtaccggttcgcgggggtcccaaagggggtaaccccg

SEQ ID NO: 177828 - DNA, 536 bp, Homo sapiens
  misc_feature: GYAE6OF01E0G7L.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaaggggctgggaggtgggtctcctttatttacagcagtggtagtacatattccgcagactcgtgaggggcattcaccatctcagagacaactctaaagaacacgcttgtttactacaaatgaaacagcctgagagccgatcgacacgggccgtgtattactgtgcgagagagtcggggcccagaaacgttctaacgctagtcggactgcgggccgaaggggaccc

SEQ ID NO: 177829 - DNA, 545 bp, Homo sapiens
  misc_feature: GYAE6OF01APYQK.11.12.B01.1.454.CMB.1.raw
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtcccgccaggcctccgagggaagggctgggagtgggtctcctttattacagcagtggtagtacatattccgcagactccggtgaggggccattccaccatctccagagaacaactctaaagaaccacgcttgtttcctacaaatgaacagcctgagngccgaatgacacggccgtgtacttacgngtgcgagagagtcggggcccaagtaacgttacacgctagtcggacttcgcggggccgaaggggacccg

SEQ ID NO: 177830 - DNA, 548 bp, Homo sapiens
  misc_feature: GYAE6OF01D6GI3.11.12.B01.1.454.CMB.1.raw
  modified_base (217)..(217): a, c, t, g, unknown or other
  misc_feature (217)..(217): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (479)..(479): a, c, t, g, unknown or other
  misc_feature (479)..(479): n is a, c, g, or t
tcagcgagagataccacgaccggtgctcgatttagtagtgtagattcggacggggctgccctttggctttggagatcggttttctcgatgagctctgggagaggagcccagcactagaagtcggcggtgtttccattcggtgatcagcactgaacacagaggactcaccatggagtttgggctgagcttggggttttcctcgttgcttcttttaagnggtgtccagtgtcaggtgcaactggtggagtcgtggggggagcgtgggtccagcctggggaggtccctgacgactctcctgtgcagcgtctggattcaccttcaggganctatgacatgcactgggtccnccgaggctccagggcaaggggctgggagtggggtgcaagtttatagtggtatgattgggaattaataaatactaagtgggacacgtccgtaggaacgggccattcacntcncagacactacttccaagaacncggtatatctagactaaatcgaacaggtccctagacggaacgtcccggaaggaccaacggcgtgttacg

SEQ ID NO: 177831 - DNA, 537 bp, Homo sapiens
  misc_feature: GYAE6OF01BWTDK.11.12.B01.1.454.CMB.1.raw
  modified_base (339)..(339): a, c, t, g, unknown or other
  misc_feature (339)..(339): n is a, c, g, or t
  modified_base (430)..(430): a, c, t, g, unknown or other
  misc_feature (430)..(430): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgagggaagggctggagtgggtctctttattacngcagtgtagtacatatccgcagactccgtgacggggccattcaccatctccagagacaactctaagacacgcttgtttctacaaatgaacngcctagagagccgatcgacacgggtccgtgtacttacgtgtgcgagagagtcggggccccaggaacgttcacgctagtcgggacgtcgcggggccgaaggggacccg

SEQ ID NO: 177832 - DNA, 526 bp, Homo sapiens
  misc_feature: GYAE6OF01BSY8P.11.12.B01.1.454.CMB.1.raw
  modified_base (296)..(296): a, c, t, g, unknown or other
  misc_feature (296)..(296): n is a, c, g, or t
  modified_base (433)..(433): a, c, t, g, unknown or other
  misc_feature (433)..(433): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccnccaggctccaggaagggctggagtgggtctcctttattacagcagtggtagtacatattccgcagactccgtgaggggccattcacatctcagagacaactctaagaacacgctgttcttcaaatgaacagcctganagccgatgacacggccgtagtattactgtgcgagagagtcggggcccacgaacgttactacgctagtcggacgtcgtgggccgaagggacccg

SEQ ID NO: 177833 - DNA, 681 bp, Homo sapiens
  misc_feature: GYAE6OF01B9YLE.11.12.B01.1.454.CMB.1.raw
  modified_base (487)..(487): a, c, t, g, unknown or other
  misc_feature (487)..(487): n is a, c, g, or t
tcagcgagagataccacgaccggtgctcgatttagtagtgtagatttgggtctgggagaggagcccagcactgggattccgaggtgtttccattcggtgatcagcactgaacacagaggactcgccatggagttttggctgagctgggttttccttgttgctaattttaaaaaggagtccagtgtgaggtgcgtctggtggagtctgggaggaggcctgatccagccgtggggggtccctgagacctctcctgtgcagcctcgtgggtcaccgtcagtccaacacctacatggagttcgggtccgccaggctccggaggggaaggggcgtgggaggtgggtcttccttttattacgagcgtaggttggtaactactaatacttccgactagtactccggtggacggggccgtattcaacctatcctacaagacgaactaaactcgtaaaagaacacgtcttacgtttactaacgaaaatcggaaacncgacctggaagtacgccgtaatcggaaccgtaccggggtaccgttagttaactttaccgtggacggacggtaagggaaacgggtacggttcccgggggaaccccctaagggtaaaaccgttttacccaaaccgggtcttaaacgggtcgggtaacccgtagggtacgggggaacccgtaaaggggtaaccccgg

SEQ ID NO: 177834 - DNA, 662 bp, Homo sapiens
  misc_feature: GYAE6OF01BHEUC.11.12.B01.1.454.CMB.1.raw
  modified_base (562)..(562): a, c, t, g, unknown or other
  misc_feature (562)..(562): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagacctctcctgtgcacgcctcgtgggttcaccgtcacgtcacacctacatgagttcgggtccgccaggcctccgaggggagggcgtggagtcgggtcttctttatttacgagtcgaggtgtagtactatacttccgcgacgaccgtcgtggacggggtcccgtacgttccaacctattccctacccgaagtaacgaacctaaacgttacaaaacgaaccctaccgtctttacgttttacctaacaaaagttcggaaaacctggacccgtagaacggacgacccgaataccggaaccgtaccgggtccgttaagttacgttacgnggtcgaacggtagacggtacggtccggggacccctaaggtaacggttaccacggtactaaggtccggtacggtgtacgggggaccgtaaagggtaccccg

SEQ ID NO: 177835 - DNA, 739 bp, Homo sapiens
  misc_feature: GYAE6OF01AG5YM.11.12.B01.1.454.CMB.1.raw
tcagcgagagataccacgaccggtgctcgatttagtagtgtagatttgggtctgggagaggagcccagcactgggattccgaggtgttccattcggtgatcagcactgaacacagaggactcaccatggagttttggctgagctgggttttccttgttgctatttaaaaggagtccagtgtgaggtgcgtctggtggagtctggaggaggcctgatccagcctggggggtccctgagactctcctgtgcagcctctgggttcaccgtcagtccacacctacatgaggttgggtccgccaggcctccgaggggaagggctgggagtcgggtctcctttattacagctaggtgtagtaccatacgttccgcacggtactccggtggacgggggtcctacgttcacccgtaacttcctaccgaaggaacgaaccctaaaccgttacgtaaaacggaaaccctaccggtactttacggtttttaccttaaccgtaaaaagttccggaaaacctacgggtaccccgttagggaacggtaacccggtaccccggaatttaccggggaacccgtaacccgggggtccgttaaggttaaacgtttaccgttaggtcggtaccggaaggtaaccggtaggtacccggggggacccctaaagggtaacccggtttaacgaccggtcttaacggtacgggtacccgggttacggtacggggggtaaccccggtaaaggggtaacccccgg

SEQ ID NO: 177836 - DNA, 872 bp, Homo sapiens
  misc_feature: GYAE6OF01CEVJO.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagtttggctgagcgttgggttttccttgttgtcttaagttttaaaaggagtccagtgtgaggtgcgtcgtgggtggagtcgtgggaggacggtcctgactcccgaggtcccgggttcggggggtcccctggacgtaccttccttccgttggtcgccgacgtcccgttcggttcggggttccacccggttcgacgtaccacctaaccctaactagttggtacgggtttccggggtcccgacccgacgggtccgtaccgggaaggggggaacggggccgtaggggtacgggtttcggggttccttttaccgtttttaacgtttaaccgacggtaccgttaaggttgggttaaacgtaacgttaacgtttaaccgtttcccggacgtaacggtaacccgttcccgggttaggggaaccgggggtcccgtaacgtttacccgaacccttacgttccccgttaacccgaaggaaaccgtaaaccctaaaccgttaacgtaaaacggaacccgttaccgttccgttttacgttttaccttaaccgaaaagttcgaaaacccgtcgacccgtaggaacgaccgaccgtaagtaccggaccgtaccgggtcttaggtttaacttcgtggacggacggtaaggacggtaaccgggtccggggaacccctaaaggttaaccgtttaccgtacggtacgttacggtccgggtaccgttaccggggacgggtaacccggaacggggtaccccg

SEQ ID NO: 177837 - DNA, 618 bp, Homo sapiens
  misc_feature: GYAE6OF01BCVEN.11.12.B01.1.454.CMB.1.raw
  modified_base (175)..(175): a, c, t, g, unknown or other
  misc_feature (175)..(175): n is a, c, g, or t
  modified_base (373)..(373): a, c, t, g, unknown or other
  misc_feature (373)..(373): n is a, c, g, or t
tcagcgagagataccacgaccggtgctcgatttagtagtgtagatttgggtctgggagaggagcccagcactgggacttccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtggggggtccctggacgactctcctgtgcagcctctgggttcaccgtcaggtcacacctacatgagtggtccgccaggcctccgagggacgggctggagtgggtctcgtttattacagcagtggtagtacatactccgcagactcgnggacgggccgattcaccatctccgagacgacaactctaacgaacacgtcttcgtttctacaactgaaacacgcctaggacgacgccgatacgaccgacgggtccgtagttaacttacgtggtgaccgaggtacgaagggtccgggggaacccctaagggtaaacccggtttacgtaccgtaccgttaacggtccgggtaaccccggttaggtaccggggggaaccctaaacggggggtacccccg

SEQ ID NO: 177838 - DNA, 887 bp, Homo sapiens
  misc_feature: GYAE6OF01AF65Q.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtcgtggagggaggcctgatccagccgtcgggggtccctgagactctcctgtgcagcctcgtggttccaccgtcacgtccaacctacctacagtggtaggttcgggtcccgccgacgggtcctaccggaagggggaacggggtcgtaggggtacggttcggggttcctttaccgttttaagtttaaccgacggtacgtaagggttcgggttaacgtaaccgtaagttaacgttcccgaccgtaacggtacccgttccgggtacggggaacgggggtccctaacgtttcccgaacccgtacgttccctacccgaaggtaaaccgaaccttaaaccgtacgtaaaacggaaccctaccgttctttacggttttacctaaacgtaaaactcggaaacctacgggtccctaagggaacggtaacccggtaccggtaattaccgggaaaccggtaccccggggtaccggtttacggtttaaactttaccggtaggtaaccgggacgggtaaacgggtaacggtaaccgggttaccccggggggaacccccttaaaacggggttaaaaccggtttaccccgttaaaccgggggtaccctttaaaacggggttcccgggggtaaaaccccggggtttcggggtaaaccccgggggggtaaacccgggtaaaaacccggggggttaacccccg

SEQ ID NO: 177839 - DNA, 565 bp, Homo sapiens
  misc_feature: GYAE6OF01DCBPV.11.12.B01.1.454.CMB.1.raw
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (527)..(527): a, c, t, g, unknown or other
  misc_feature (527)..(527): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgagggaagggctggagtggtcttcgtttattacagcagtggtagtacatatccgnagactcgnggagggccatcacatctccagagacaactctaaagaacacgtcttgtttctacaaatcgaaacagcctaggagtacgccgaagtcgaaccgacgggtccgttaggtaacttacgtggtcgacgagagacgtcggggacccaaggtaacttacgtacgnttagtcggtaacgtcgtcgggggaccaaggggtacccg

SEQ ID NO: 177840 - DNA, 615 bp, Homo sapiens
  misc_feature: GYAE6OF01A7C38.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaaggggctgggagtgggtcttcctttatttacagcagtggtatacatacttccgcagactccggtggacgggggccattccaccatcctccagacgacaactctaaagaacacgtcttgtttaccttacaaatgaaacacgcctaggacgacgccgaagtcgaaccgaccgggtccgttagttaacttacgtgtacgcgaaggaggacggtccgggggccccaacgggtaaaccggtttacctaaccggtacttaggtcgggtaccggttcggtacgggggacccgtaaacggggtaccccgg

SEQ ID NO: 177841 - DNA, 720 bp, Homo sapiens
  misc_feature: GYAE6OF01DW34R.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccgagccggtggggggtccctgacgactctcctgtgcagtcctcgtggtccaccgtcacgtcacacctacatgagttcgggtccgccgaggcctaccggaagggggacgggcgtagggagttgggtccttccgttttaattacgagcgtaggtaggtaacgtacattacgttacccgactagtaccgtccgggtaggacggggccctacttccgacctactccgtaccaggaacgaacctaactaacgaaacgaacctacgtacttcgttttactacaaatcgaaacaggtaccgtagaacggacgccggtaactacggaacccgtaaccggggtccgttagttacgtttacgtcggttacgacggtaaaggacggtaacgggtacccggggtaaccccaaacgggttaaaccgtttacccgtaaccggtacgttaacggttacggggaaccggttccggggtaccgggggaacccgtaaacggggtacccccggg

SEQ ID NO: 177842 - DNA, 752 bp, Homo sapiens
  misc_feature: GYAE6OF01D7CZ8.11.12.B01.1.454.CMB.1.raw
  modified_base (218)..(218): a, c, t, g, unknown or other
  misc_feature (218)..(218): n is a, c, g, or t
  modified_base (333)..(333): a, c, t, g, unknown or other
  misc_feature (333)..(333): n is a, c, g, or t
tcagcgagagataccacgaccggtgctcgatttagtagtgtagatttgggtctgggagaggagcccagcactgggattccaaggtgtttccattcggtgatcagcactgaacacagaggactcaccatggagtttttggctgagtcttgggtttttccttgttgcttaattttaaaaggagtccagttgtgaggtgcgtgtggtggagtcgtggaggnggcctgactccgaggccggtcggggggtccctggacgtacctctcctgtcgcacgccttcgtgggttccaccgtcacgtcacctacctacagtggtacggttcgggtcccgccgnggccgtaccggaaggggggaacggggtctgggtaaggttcgggttcctttactttttattacgacgtgtaggttaggttaactaacgtaatttaccgtcccgacgtaacgtaccggttccgggtaggggtaccgggggtaccttacttacccgaacctacgttcctaaccgaaggaaccgtaaacctaaaccgtaaccgtaaaaacgaaccgtaaccgttactttacgttttacccgtaaactaaagtacgaaaccgacgtccggtaagaggtacccgacgtacggtacgacccggtaccgggtcttaagtttacttcgtaggcggacgaaggacgtaggggtcccggacccgtaaagttacccgtagtccggtaactagggtacgtaccgttaggggccgaaacgggaccgtaaccgg

SEQ ID NO: 177843 - DNA, 663 bp, Homo sapiens
  misc_feature: GYAE6OF01CV4GI.11.12.B01.1.454.CMB.1.raw
  modified_base (252)..(252): a, c, t, g, unknown or other
  misc_feature (252)..(252): n is a, c, g, or t
  modified_base (475)..(475): a, c, t, g, unknown or other
  misc_feature (475)..(475): n is a, c, g, or t
  modified_base (500)..(500): a, c, t, g, unknown or other
  misc_feature (500)..(500): n is a, c, g, or t
  modified_base (596)..(596): a, c, t, g, unknown or other
  misc_feature (596)..(596): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcngcctgtgggttcaccgtcagtcacacctacatgaggttcgggtcccgaccaggcctccgaggggaacggggctgggaggtgggtggactagttatagtggtatgtagtggtaaagtttaataaaatactagtagggacgacgttccggagggtaacggggccgtaatttcccgaacctatcctaccaaggacgaacctacttacccgaaagaacctacgggtntactcgttacgacaaagtcgaaacncgacctggaacgacggtacccggaagggacccgtaacgggtcttagggttacgttaagtttaccgtgggtacgaaccggggaagggggtaaaaccnggtacccgaagggtccgtagggacccgggtaagggggtacttagggactttgggttccgttttaagg

SEQ ID NO: 177844 - DNA, 765 bp, Homo sapiens
  misc_feature: GYAE6OF01BNQUW.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcttgggttttccttgttgctaattttaaaaggagtccagtgtgaggtgcgtcgtggtggagtcgtggaggaggcctgactccgaggtccgtcgggggtccctggacgactcctcctgtgcacgcctcgtcggttccaccgtcacgtccaccacctacagtgtacggttcgggtcccgccgacggtccgtaccggaggggaacggggcgttgggaggttcgggttcctttaccttttatttacgagtacgtaggtgtaacgtactaattacgttcccgactacgtaccgtccggtggacggggtcctattccgacctactcctaccgaagtacgaaacctaacttacaaacgaacctaccggtactttacgttttacctaacgtaaaacgtcgaaaaccgtacgtcccgttaagggaacgtaccggtacccgaagtaccggaacccggtaccggggtacccgtttaagttaactttccggtaggtccggaacggtaagtacggtacgggtacccggggaacccctaaacggttaaacccggtttccgtaacccgttcgttaacggtcggggtacccggttacgggtacccgggggaaacccgtaacccggggtaacccccg

SEQ ID NO: 177845 - DNA, 614 bp, Homo sapiens
  misc_feature: GYAE6OF01A54PL.11.12.B01.1.454.CMB.1.raw
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
  modified_base (504)..(504): a, c, t, g, unknown or other
  misc_feature (504)..(504): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggagcctgatccagccgtgggggtccctgagactctcctgtgcagcctcgtgggttcaccgtcagtcacacctacatgaggttcgggtccgccgaggcctacgaggggagggctgggagtgggtcttctttattacagcgagtggtatacatatccgcagacctcggtggacggggcctattcacctatcctaccagacgtaacctaacgtcgtaaacgaacncgtcttagtttcctanaaagtcaacngccctaggacgacgtcgatcggaccgaacggtcccgttagtaacttcgnggtcgacggagacgtagggtccggggacccctaagggtaacccgttacgtaccggacttaacggtcgggtaacggttccggtacgggggaacccgaaaggggtaccccgg

SEQ ID NO: 177846 - DNA, 607 bp, Homo sapiens
  misc_feature: GYAE6OF01AWV00.11.12.B01.1.454.CMB.1.raw
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccnccgaggctcgagggagggctggagtggtctcttattacngcagtggtagtacatatccgcagactcgtggacggggccagttcaccatcctaccagaacgacaactactaaagaaccacgtcttgtttactactaaatagaacagtccctagacgacgaccgatacggaccgacgggtcccgttagttaacttacgtggtacgacggtaggaggacggttaccgggggacccctaacgggtaaaccgtttacgtaccgtacttaggtacgggtaccgttacgggcggggtacccgaacggggtaaccccg

SEQ ID NO: 177847 - DNA, 638 bp, Homo sapiens
  misc_feature: GYAE6OF01B8BZF.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctgggtggagtcgtggaggaggcctgatccagccgtgggggtccctgagactctcctgtgcagcctcgtgggttccaccggtcagtcaccacctacatgaggttcgggtccgccaggcctccggaggggaaggggcgtgggagtgggtccttccgttttattacgagctaggttggtagtacagttacttcccggctaaggtacctccggtaggacgggggcctatttccaacctatcctaccaaggacgaaccaactctaaacgaaccacgtcttgtttactacaaattgaaacacgcctagacggacgccgaagtcgaccgacgggtccgttagttacttacgtgtcgacggagacggtaggtccggggacccaaggtaaccgttacgtaccggtacgtacgtacgggaccgttacggcgggggaaccgaacggggtaccccgg

SEQ ID NO: 177848 - DNA, 653 bp, Homo sapiens
  misc_feature: GYAE6OF01DG1D9.11.12.B01.1.454.CMB.1.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (331)..(331): a, c, t, g, unknown or other
  misc_feature (331)..(331): n is a, c, g, or t
  modified_base (498)..(498): a, c, t, g, unknown or other
  misc_feature (498)..(498): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagttttggctgagcgtggtttcgtgtagctattaaagagtcagtgtgaggtgcgtgtggtgagtcgtggaaggngcctgactccaggccggtgggggtccctggacgtctcgtctgtgcncgtcctcgtggttaccaccgtnacgtcacctacctangtggtacggtttcggccgaccgacggccaccggaggggacggngtagggaggttcggtccttacctttattcgacgagtgtaggtactactattacgtcccgatacgtcgtcgggtggacgggtaccctagttccaaccgtactacgtaccgagtaccgaacttaacacgtaaacgactcgtacttcgtttaactacaagtcgtaaaccncgacgtagacgacgacgtagaccgaccgtacggttcgttagttacgttcgtacgacggaggacggtacggtacggtaccggaaccgtaacggttaccgtacgtacgtacgtacggtacgtacgggtacgggacccggtaacggtaccggtacccg

SEQ ID NO: 177849 - DNA, 962 bp, Homo sapiens
  misc_feature: GYAE6OF01CDMBK.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcgttgggttttccttgttgcttaagttttaaaaggagtccagtgtggaggtgcgtcgtggtggagtcgtggaggaggcctgactccgaggtccggttcggggggtccctggacgtacctccgtccgtgtcgcacgtccgttcggttcgggttccgtaacccgtcgaacgttacccaacctaacccttaacgtagttggtacggtttccggggtaccccgacccgaacgggtcccgttacccgggaagggggaacggggtccggttagggtaacgggtttcgggtttacccttttacccgtttttaaagttaccgtacggtaccgttaagggttacggttaaagtactaacgttaccgttaccgacgtaacggtaccgtccgggttagggaaccggggtacctacgttaccgaacctacgttaccctaccgaacggaacgtaacctaaaccgttaaccgtaaaaccgaaacccgttaccgttaccgttttaacgttttaccttaaaccgtaaaacgttaacggaaacccgttaacggtacccgtaaacgggtaacgtaaccgggaacccgtaaagtacccggtaaccgggtaaccccgggttccggtttaaacgttaaccgttttaccggtacgggtacgggtaacgggtaacgggtaaccggggtaaccgggttaccccgggggaaaacccccttaaacccggggttaaacccggtttaaacccggtaacccgttacggtttacgggtaacccgggtacgggttacccggggttaacccgggggaaacccgggtaaaccccggggttaacccccggg

SEQ ID NO: 177850 - DNA, 859 bp, Homo sapiens
  misc_feature: GYAE6OF01DB07J.11.12.B01.1.454.CMB.1.raw
  modified_base (177)..(177): a, c, t, g, unknown or other
  misc_feature (177)..(177): n is a, c, g, or t
  modified_base (291)..(291): a, c, t, g, unknown or other
  misc_feature (291)..(291): n is a, c, g, or t
  modified_base (713)..(713): a, c, t, g, unknown or other
  misc_feature (713)..(713): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagttttggctgagcttgggttttccttgttgcttaatttaaaaggngtccagtgtgaggtgcgtctggtggagtcgtgggaggacggcctgactccgaggccggtcggggggtccctgacgacctctccgtgtgccacgtcctcgtcgggttccaccgtnacgtcaacctacctacatggtacggttcgggtacccgccgtaggcctccggaaaggggacgggcgtgggaggttcggttaccttaccgttttaattacgaggtacgtaggttacggttaacgtaacgtacgttaacgttccccggaacgtaacggtacccggttccgggtacggggaaccgggggtacccttaacgttacccgaaaccctaacgttccccgtaaccggaaacgaaaccggtaaccaaaacccgttaacgtaaaaccgtaaacccgtaccgttacgtttaccgttttaacctaaacgtaaaacgtttaaccgaaaaccgtaccgtacccgttaggaacggtaacccgggtaccgttaaacgtaccggaaccccggtaacgggttacccggttttaagttaacgttttaaccgngggtaccggacggtaagggaaacggtacccgggtacccggggtaacccctaaaccgggtttaacccggttaaaccgaccgttacgttaacggttccgggaaccggttacgggacccggggaaacccggtaaacccggggtacccgg

SEQ ID NO: 177851 - DNA, 855 bp, Homo sapiens
  misc_feature: GYAE6OF01DF0TS.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagtttggctgagtcgttcgggttttccttgttgacttaattttaaaaaggagtccagtgtgaggtgcgtcgtggtggagtcgtggaggaggcctgactccgacggtccggtcgggggtccctgacgtactcctccgtgtcgcacgcctcgtcggttccaccgtcacgtaccacacctacagtggtaggttcgggtccgccgacgggcctaccgggaaggggaaggggtcgtaggggtaggttcgggttcctttaccgttttaagttaccgagtcgtaggttaggtagtactagttacgttcccgacgtacgtaccgttccggtggacggggtcccgtattaccgaccgtactcccgtaccgaagaaccgtaaccaaaccgttaacgtaaaacgtaccgaccgttacgtttacgtttaccttaacgaaagttaccggaaaccgtacgtacccgtagggaacggtaaccgtaccggtaacgtaccggtaacccggtacccggggttccggttaacgtttaaccgtttaacggtcgggttaacgggtaaccgggaaagggtaccggtaaccggggttaccccgggggtaaaacccccctaaaacggggtttaaacccggttttaacccgtaaccgggttacccgtttaacggggttacccggggttaaccgggttcccgggggtaaaccgggggaaccccgggtaaaacccgggggtaccccccggg

SEQ ID NO: 177852 - DNA, 918 bp, Homo sapiens
  misc_feature: GYAE6OF01BB209.11.12.B01.1.454.CMB.1.raw
  modified_base (198)..(198): a, c, t, g, unknown or other
  misc_feature (198)..(198): n is a, c, g, or t
tcagcgagagataccacgaccggtgctcgatttagtagtgtagatttgggtctgggagaggagcccagcactgggattccaaggtgtttccattcggtgatcagcactgaacacagaggactcaccatggagttttggctgagtcttgggttttccttgttgcttaattttaaaaaggagtccagtgtgaggtgcgtntggtggagtctgggaggaggcctgatccaggccggtcggggggtccctgacgtacctctccgtgtgcacgtcctcgtggttccaccgtcacgtccacctacctaacagtaggtaggttcgggtcccgaccgagggtcctaccggaaggggggaacggggtcgttaggggacggttcggggtttcctttaccgtttttaagtttaaccgaggtacgtaggttacgggttaacgttaactaacttaacgttcccgaccgtaacggtacccgttcccgggtaggggaacgggggtaccctaaatttcgtaacttaccgaacttcccgtaaccgaaggtaaccgtaaaccctaaacgttacgttaaaaacggaaacctacgggtttacctttacggtttttaacctttaaccgaaaaagtttaccgaaaaccgtcggtacccgtaaggaaccggtaccggtaccgtaaacgttaccggaaacccgttaccccggggtaccgttttaaggtttaaccgtttaacgggtcgggttacggtaaccgggtaaacggggtaacggggtaaccgggttccccggggggtttaaacccccaaaaacccgggggttttaaacccgttttaaccccgtaaaccggggtacccctttttaaacgggggtccggggtaaaccccgggttttacgggtaacccggggggggaaacccccggtaaaaacccgggggg

SEQ ID NO: 177853 - DNA, 686 bp, Homo sapiens
  misc_feature: GYAE6OF01BQKCO.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggtttccttgttgctattttaaaaggagtcagtgtgaggtgcgtctggtggagtctggaggaggcctgatccagccgtgggggtccctgacgactctcctgtcgcacgcctcgtgggttcaccgtcacgtcacacctacatggagttcggtccgccgaggccgtaccgagggggaacgggcgtgggagtcgggtccttacgtttattacgagtctagttggtatactattacttccgacgacgaccgtccggtggacgggggtccctagtttacccaaccgtatccctacgaaggtaacgaacctaaaccgtaccgtaaacgaaaccgaccgtcgtttaggttttacctaataaaacgttcgaaacctacggtaccctaggaacgacggtccgaagttacgaaccgtaccgggtaccgttagttaaccgttacgtggtccggaacgggtacgaaggtacggtaccgggaccctaaggttaaaccgttacgacgtaccgtagtacgggtaccgtcggtacggggacccaagggtaccccgg

SEQ ID NO: 177854 - DNA, 825 bp, Homo sapiens
  misc_feature: GYAE6OF01EEZFG.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagttttggctgagcttgggtttttccttgttgacttaagttttaaaaggagtccagtgtgaggtgcgtcgtggtggagtctggaggaggcctgatccgagccgtcgggggtccctgacgactctcctgtgcacgtctcgtcggttcaccgtcagtccacacctacatgacggttcggtccgccgaggcctaccggagggggaacggggtcgtagggtaggttcgggtactttaccgttttattacacgtacgtaaggtggtaacgttaacgtacttacgttcccggactacgtacccgttccgggtacgggaacgggggtccctaagtttcccgaaaccctacttcccgtaccgaacggaaacgtaaaccctaaacgttaccgttaaaaacggaaacccgtaccgttaccgttttcgttttaaacccgtaacgtaaaagttaccgaaaccgtacgtaccggtaacggaacgggtaaccgtaccggaacgtacggtaacccggaccgggttacccgtttaacggtttaacttacgggttcggtacggaacggtaacggagggtaaccgggtcccgggggtaaaccctaaccgggtttaaaacccgtttccggtaacggtaccgttaaacgggtaccgggtaacccgggttaccgggtaaccgggggtaaccccggtaaacggggtaaccccccgg

SEQ ID NO: 177855 - DNA, 762 bp, Homo sapiens
  misc_feature: GYAE6OF01CBHKP.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtccctgagactctcctgtgcacgtcctcgtcgggttcaccgtcagtccacacctacatggtacggttcgggtcccgccgacggccgtaccggaggggaacggggtcgtggggtaggttcgggttccttaccttttaagtttacgacgtcgtaaggttaggtaacgttactagttacgttcccgacgtacggtaccgtccggtacgggacgggggtccctacgttcccaaccctactcccgtaccgaacggaacaaccaacttaccgtaaacgaaccctaccgttactttcgttttaccttaactaaacgttacgaacgtacgtcccgttagacggaccgaccgtaagtccgaaccggtaccgggtccgttagtttaacgttacggttggtacggcggtaaggacggtacgggtacccggggtaacccgtaaccggttaaaaccggtttaccggtaaccggttaaccgttacggttacgggtacccggttacggggttacccggggggaacccgtaaacgggggtacccccgg

SEQ ID NO: 177856 - DNA, 794 bp, Homo sapiens
  misc_feature: GYAE6OF01ELGJS.11.12.B01.1.454.CMB.1.raw
tcagcgagagataccacgaccggtgctcgatttagtagtgtagatttgggtctgggagaggagcccagcactgggattccaaggtgtttccattcggtgatcagcactgaacacagaggactcaccatggagttttggctgagctgggttttccttgttgctattttaaaaggagtccagtgtgaggtgcgtctggtggagtctgggaggaggcctgatccaggccgtgggggtccctgagactctcctgtgcagcctcgtgggttccaccgtcagtcacacctacatggtaggttcgggtcccgccgaggcctaccggagggggaaggggcgtgggaggtcgggtcttccttttatttacagtcaggttggtagtacattacgttcccgacacgtacctcggtacggacggggggtcccgtagtttcccaaccctacttcccgtacccgaaggtaacgaaccctaaaccttaccgtaaaacggaaccccaaccggtcgtttaccgtttttaccttaaccgtaaaagttccgaaacccgtaacggtccccgttaaggaacggtacgacccggtaagtaacccgggaaccggaccccggggttcccggtttaagtttaacttaaccggttcggttacggaccggtaaaggtacgggtaagggtaccccggggggtaccccctaaacccgggttaaaccggttttacccgtaaccggtccgtttaacgggtacggggtaaccccgggttcgggaacccgggggggtaccccgtaaaaccgggggtaaccccccggg

SEQ ID NO: 177857 - DNA, 603 bp, Homo sapiens
  misc_feature: GYAE6OF01CQQJI.11.12.B01.1.454.CMB.1.raw
  modified_base (299)..(299): a, c, t, g, unknown or other
  misc_feature (299)..(299): n is a, c, g, or t
  modified_base (440)..(440): a, c, t, g, unknown or other
  misc_feature (440)..(440): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttccaccgtcagtcacacctacatgagttcgggtccnccgaggcctccgaggggaaggggctggaggtgggtcttcctttatttacagcgtagtggtagtactatacttccgacagtactccggtggacggggcctattcacctatcctccagacgacaactctaaacgaactacgtnttacgtttctacaaatcgaacagtcctagacgacgccgtaagtcgaccgtaccgggccgttattacgttatggtagacggtaaggagcggtaccggggacccaacggtaaccgtttacaccgtatacggtcggaccggtggacggggcccgtaagggaccccg

SEQ ID NO: 177858 - DNA, 827 bp, Homo sapiens
  misc_feature: GYAE6OF01AR8XN.11.12.B01.1.454.CMB.1.raw
tcagcgagagataccacgaccggtgctcgatttagtagtgtagatttgggtcgtgggagaggagcccagctactgggattccgaggtaggtttaccgattcggtcgatcagtcactcgaaccaccagaggactcaccatggagttttgggctggagcgttgggttttccttgttgcttaattttaaaaggagtccagtgtgaggtgcgtctgggtggagtcgtgggaggaggcctgactcccgaggcccggttcgggggggtcccctggaacgcctcctcctgtcgcagtcccttcgtgggttccaccggtcagtcaaccacctacagtgtacggttcgggtccccgaccgagggtccgtacccgggaagggggaacggggtccgtaggggtacgggttcgggtttacctttaccctttttaagtttaccgagtccgtaagggttaggttaacgtaactacgttaaccgtttcccggacctaacggtacccgttccgggtagggaccggggggtaccctacgtttacccacctacgttcccacccgtaacgaacgaaccctaaccgtaactaaacgaaccgtaaccgtcgtttacgttttaccttaactaaacgtacgaaaccgtacgtaccgtaggaacgaccggtaccgaagtaccggaaccgtaccggggtacccgttagttaacgtttaccgtaggtacggtacgggacggtaaggtaccgggtacccggggaccccgtaaacggttaaacccggttaccgtaacgtcgttaacggtcgggtaccggtaccgggaccggggaacggaaccggggtaaccccgg

SEQ ID NO: 177859 - DNA, 929 bp, Homo sapiens
  misc_feature: GYAE6OF01ARW2H.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtctggaggaggcctgatccacggccggtcggggggtccctggacgtactcctccgtggtggccgacgtccttcgttcgggttccaccggtctacgtaccaaccacctactagtgtacggttcgggtcccgccgaggccgtaccggaggggaacggggtcgtgggtacggtcgggttaccttacgttttaacttacgtacgcgtaaggttaggtaacttaacgtaacttacgttcccgacgtaaggtacccgttccgggtaggggaccgggggtacctaacgttcccgaacccgtaacgttcccgttaccgaaggtaaccaaaccgtaaacccttaacccggttaaaacgaaaacccggtaccggttaccttttacggtttttaaccctttaaacgtaaaacgttacgaaaacccgtacggtacccccgttaaagggaccggtaaaccggtacccgggtaaagttaccgggaaaacccggttacccgggggttaacccggttttacgtttaaacgtttaacccgtggttaccgggaacggaaacggggttaaccgggtaagggtaccccgggggggttaacccctaaaacccgggtttaaaacccggttttaaaccggtaaacccgggtttccgttaaacggggttaccccgggggttaaaccgggttaccccggggggttaaccggggggttaaaccccggaaaaaccgggggggtaaaccccccgg

SEQ ID NO: 177860 - DNA, 815 bp, Homo sapiens
  misc_feature: GYAE6OF01D6QTX.11.12.B01.1.454.CMB.1.raw
  modified_base (178)..(178): a, c, t, g, unknown or other
  misc_feature (178)..(178): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgcttaagttttaaaaggngtccagtgtgaggtgcgtcgtggtggagttcgtgggaggacggcctgatccgagccggtcggggggtccctgacgaccttcctccgtgtcgcacgtcctcgtggttccaccgtgacgtcaccacctacagtaggtaggttcgggtcccgtccgacggtccgtaccgggtaagggggggaacggggtcgtggggtacggttcggggttcctttaccgttttaatttacgagtcgtaggttaggtacgtaactattacgttcccgacgtacggtaccgtccgggtagggaccggggtcccgtaactttccaaccgtactcccgtacccgtaaggaaccgtaacctaaacttacgtaaaacggaaaccctaccggttaccttttgttttaacccttaacgtaaaacgttccgaaaaccgtcgttacccggtaaggaacggtaaccgggtacccgaaagttcccgggaaaccgtaacccggggtcgtttacgttttaaacttacggtgggtacgacgggtaaaggtacggtaaccgggtcggggtaaacccctaaacgggttaaacgttaccgtaccgtacttacgggtccgggttaacggtaccgggtaccgggggaacccgtaagggggtaacccccgg

SEQ ID NO: 177861 - DNA, 452 bp, Homo sapiens
  misc_feature: GYAE6OF01CJORE.11.12.B01.1.454.CMB.1.raw
  modified_base (437)..(437): a, c, t, g, unknown or other
  misc_feature (437)..(437): n is a, c, g, or t
  modified_base (440)..(452): a, c, t, g, unknown or other
  misc_feature (440)..(452): n is a, c, g, or t
tcagcgagagataccacgaccggtgctcgatttagtagtgtagatttgggttttccttgttgctattttaaaagactccgtgaggggccgattcaccatctccagagacaactctaagaacacacttgtttcttcaaatgaacagcctgagagccgatgacacggccgtgtattactgtgcgagagagtcggggccccaacggaaacgttacacgctagtggacgtcgtggggaccaagggaccacgggtcacccgtctcctcacgccctccaccgaacgggcccagttccggtccttcccccgtggcccgccctgcctccgaggacgccaccctccggagaacgcacgacggcccggtcctgggctcgcctggtacaacggccttacttccgtacgtctcctacgcgtggacggcggtctcggacaacggcgatanagnnnnnnnnnnnnn

SEQ ID NO: 177862 - DNA, 815 bp, Homo sapiens
  misc_feature: GYAE6OF01DELTD.11.12.B01.1.454.CMB.1.raw
  modified_base (308)..(308): a, c, t, g, unknown or other
  misc_feature (308)..(308): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgcttaatttaaaaggagtccagtgtgaggtgcgtctgggtggagtcgtgggaggaggcctgactccagccgtgggggtccctgagactctcctgtgcagcctcgtggttcaccgtcagtcactacctacagtgaggttcgggtacccnccgaggcctccggaagggggaaggggctagggaggttcgggtccttaccgttttaattaacgagcaggttggtaagtacattagttcccgataagtacctccggtaggacgggggtccctagttccaacctacttcccgtaccaagggaactaaaccctaaacccttaacgtaaaagtaaaccctaccgttccgtttaacgtttttacctaaacctaaaacgttacggaaaaccacggttaccccgtaagggtaaggaaacccggtcccggaaacttgggaaaccccgtaaccgggggtacccgtttagttaaaccttttaaccggtgggtaccgtaaccgggtaaaggtaccgggtaacgggttacccggggggaaaacccccttaacgggtaaaaacccggttttaacccgtaaaccgggtaccgttaaaggttacccggggaacccgggtttacccgggggtaacccgggggtaaccccgtaaaaaccggggggtaacccccgg

SEQ ID NO: 177863 - DNA, 616 bp, Homo sapiens
  misc_feature: GYAE6OF01A60V4.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctggacgactctcctgtgcagcctcgtgggttcaccgtcagtccacacctacatgaggttcgggtccgccgaggcctccgaggggaaggggctgggagtgggtctctttattacagcagtggtatacattacttccgcagaccttccggtggacgggggccctattccgaccctacttcctaccgagacgaacctaacgtactaaacgaaccacgtcttacgttttcttacaaatcgaaactacggaccctaggaacgacgccgagttacggaccgccgggtccgttagttactttacgtggtcgcggaggagtaggtcgggaccctaacggaacgttaccacgtctacgtcggacggtggacggggccgaaggggacccg

SEQ ID NO: 177864 - DNA, 599 bp, Homo sapiens
  misc_feature: GYAE6OF01BM5UL.11.12.B01.1.454.CMB.1.raw
  modified_base (336)..(336): a, c, t, g, unknown or other
  misc_feature (336)..(336): n is a, c, g, or t
  modified_base (441)..(441): a, c, t, g, unknown or other
  misc_feature (441)..(441): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttggtccgcaggctccgagggagggctggagtgggtctctttattacngcagtggtagtacatatccgcagactccggtggacggggccattcacctatcctccagacgaactaactctaaagaaccacgtcttagtttctacaaatcgaacncgcctgagacgccgatcgacgacgggtccttagtacttacgtggtacgcgaaggacggtacggtccgggggacccctaaacgggtaaccgtttacccgtaacggtccttaacggtcgggtaccgttcgggtacgggggacccaacgggggtacccccg

SEQ ID NO: 177865 - DNA, 858 bp, Homo sapiens
  misc_feature: GYAE6OF01C5H8C.11.12.B01.1.454.CMB.1.raw
  modified_base (185)..(185): a, c, t, g, unknown or other
  misc_feature (185)..(185): n is a, c, g, or t
  modified_base (192)..(192): a, c, t, g, unknown or other
  misc_feature (192)..(192): n is a, c, g, or t
  modified_base (441)..(441): a, c, t, g, unknown or other
  misc_feature (441)..(441): n is a, c, g, or t
  modified_base (728)..(728): a, c, t, g, unknown or other
  misc_feature (728)..(728): n is a, c, g, or t
tcagcgagagataccacgaccggtgctcgatttagtagtgtagatttgggtctgggagaggagcccagcactgggattccgaggtgttccattcggtgatcagcactgaacacagaggactcaccatggtagttttggctgagcgttgggtttttccttgttgcttaagttttaaaaggagtccngtgtggnggtgcgtcgtggtggagtcgtgggaggacggcctgactccgaggcccggttcggggggtccctaggacgtactccgttcctggtcgcacgtccgtcgttcgggttaccctaccgtacgacgtaccaaccctacctaaccgtagtcggtaggttccggggtccccgaccggacggccgtaccggggaagggggtaacggggtccgtaggggtaccgggtttcgggtcccttttaccgttttacttaacgnggaccgtaggtggtaactactaacgttaccttaccggacacgtaccgttcggcgggtaaccgggccgtacttacccaccgttactacccgtacgaagaaccgtaaacctaaccgttaacgaaacccggtaaccgttccgttaacgttttaccgttttaacccgttaaataaaaccgggttaaccgaaaacccttaccggtccggtaaagggtaaccggtacggaacccggttaacgtaccgggtaaacccggtacccggggtaccgtttaaggtttactttacgggngggtaaccggacggtaaacgggcgttaccgggtacccgggtaaccccgtaaacggttaacgttcccgtaacggtcgttacggtacgggaccggttcgggaacccggggaccggtaaccgggtaaccccgg

SEQ ID NO: 177866 - DNA, 832 bp, Homo sapiens
  misc_feature: GYAE6OF01B6P32.11.12.B01.1.454.CMB.1.raw
  modified_base (176)..(176): a, c, t, g, unknown or other
  misc_feature (176)..(176): n is a, c, g, or t
  modified_base (790)..(790): a, c, t, g, unknown or other
  misc_feature (790)..(790): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgtcttaatttaaaaggngtcagtgtgaggtgcgtcgtggtggagtcgtggaggacgcctgactccgacggccgtcgggggtccctggacgtacctccgtcctgtcgcacggtccttgtcggttccaccggtcacgtaccaactaaccttacgagtcggtacggttcgggtccccgacgtacgggtccgtaccggaaggggtaacggggtccgttaggggacggttcgggttacctttaccgttttaagttacgagtaccgtagggtacggttaactactagttaccgttcccggacgtacggttacccgtaccgggtacggggtaccggggtaccctacgttaccgaaaccccgtacttcccgtaccggtaaaaggtacctaaacccggttaaaccttaacgtaaaaacccgggtaccgttaaccggttacgttttcccgtttaacgttacaaaaccggtttcggaaactaccggtcccgtaagggaaccggtacgaaccgtacgttacgggaaacccggtccgggttacccggttagtttaaagttcccggaggtaggtacccggaaggtacgggtaccggtaccggggaacccctaaaggttaacccgtacgttacccgaggttaccgnggggtaccccttagggacggggaacccgtaacgggtaccccg

SEQ ID NO: 177867 - DNA, 639 bp, Homo sapiens
  misc_feature: GYAE6OF01D38FF.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtctggaggaggcctgatccagccgtggggggtccctgagactctcctgtgcagcctcgtggtcaccgtcagtcacacctacatgagttcgggtccgccgaggcctccgaaggggaacggggcgtgggagtcgggtccttccgttttattacagcaggtggtagtacatacttccgacacgcgtccggtggacggggccgtattccacctatcctaccgagaacgaaccaactacgtaaacgaacctacgtcttagttttactactaaatcgaaacacgcctagacgacgaccgaagtacgaaccgacgggtaccgttagttacttacgtgtcgacgaggacgtacggtccggggaccctaacggtaaccgttacgtaccgtattacggtacgggtaccggtacgggtaccgggggaacccgtaaacggggaccccg

SEQ ID NO: 177868 - DNA, 851 bp, Homo sapiens
  misc_feature: GYAE6OF01ECBWD.11.12.B01.1.454.CMB.1.raw
tcagcgagagataccacgaccggtgctcgatttagtagtgtagatttgggtctgggaggaggagcccagcactgggattccgaggtgtttccattcggtgatcagcactgaacacagaggactcaccatggagttttggctgagtcttgggtttttccttgttgtcttaagttttaaaaggagtccagtgtgaggtgcgtctgggtggagtcgtgggaggaggcctgactcccgaggtcccgtcgggggtccctaggacgtacctcctcctggtcgcacgtccgttcgtcggggtttaccacccggttctaacggtcccaaccgtaccctaactagttcggtaacggtttcggggtaccccgtcccgaacgggtccgttacccgggaaggggggtaacgggggtcgttggggaacggtttcggggtttaccttttacccgtttttaacgtttaaccgacggtaccgttaagggttacggttaaacggttaacctaagtttaacctttacccggaccgtaacggtaacccgttccggggtagggtaccgggggtaccctacgtttaccgaacctacttcccgtaccgaagtaaccgaaacctaactaacgtaaacgacgtactctttagtttaccgtaacaaacgtcgaaaccgtacgtaccgtaagacggtacggaccgaaggtcgaacccggtacggtacccgttagttacgttaacgtcggtacggtaacgggtagaacggtaccggggtccgggaaaccccgttaacgggtaaacccgtttacgacccgttaggttaacggtcggtaaccggtcgggtaccgggaaccggtaacccgggtaaccccgg

SEQ ID NO: 177869 - DNA, 903 bp, Homo sapiens
  misc_feature: GYAE6OF01BRNZB.11.12.B01.1.454.CMB.1.raw
  modified_base (188)..(188): a, c, t, g, unknown or other
  misc_feature (188)..(188): n is a, c, g, or t
  modified_base (671)..(671): a, c, t, g, unknown or other
  misc_feature (671)..(671): n is a, c, g, or t
  modified_base (708)..(708): a, c, t, g, unknown or other
  misc_feature (708)..(708): n is a, c, g, or t
  modified_base (857)..(857): a, c, t, g, unknown or other
  misc_feature (857)..(857): n is a, c, g, or t
tcagcgagagataccacgaccggtgctcgatttagtagtgtagatttgggtctgggagaggagcccagcacgtgggattccggaggttgtttccagttcggtgatcagcactgaacacagaggactcactagtggtagttttggctgagtcgttggttttccttgttgtacttaaagttttaaaaggngttaccaggttggtagagggtcgtcgttcggtgggtggtagttcggtaggggacggacggtcctagtactcccggacgggtccgggttcgggggtccctaggaacgtccttccgtccgttggtcgaccgtacgtccgttcggttacggttaccaaccgtcgtacgttaccaacctaacctacgtaggttacgggttaccggttccggggacccgtacccggtaacgggtccggtaaccggggaagggggtaaccgggggtcgttagggggttacgggtttccggttttccttttaaccgttttaacgttaccggacggtcggttaaggttaacgggtaacttaacgttagttaccgtccggacgtaccggtacccgttcgggtacggggaccgggtaccttaaccttaccgaacccgtacgttcccgaaaccgtaacggaaccgtaaacttaaaccgttaacggaacgttaactaccggtttntttaccttttaaacgacgtaaaacgtcgaaacccgtntaacgtaacggacgaaccacggtaacgaaccgggtaccgtacggttacgtttaacgttacgttacgtacggacggtacggaaaacggtccgggttaaccgggaacccggtacccttaaacggtaacgtttacccgacgtaggttaccgnggggttaccccgaccggggtaacggaccggttaacccggaacccgg

SEQ ID NO: 177870 - DNA, 785 bp, Homo sapiens
  misc_feature: GYAE6OF01DM7LB.11.12.B01.1.454.CMB.1.raw
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
  modified_base (669)..(669): a, c, t, g, unknown or other
  misc_feature (669)..(669): n is a, c, g, or t
tcagcgagagataccacgaccggtgctcgatttagtagtgtagatttgggtcgtgggagaggagcccagcactgggacttccgaggtgtttccagttcggtgatcagcaactgaacacagaggactccaccatggtagttttggctgagtcgttgggttttccttgttgtctaagttttaaaagagtccagtgtgaggtgtctgtggtggagtcgtgggaggacggtccgtgactaccgacggtccggtcggggggtccctagaacgtcctccgtccgtgtagcgtcgccgttcgtggtccctaaccgtgacgtaccaaccgtacctaacgngtaggttaggttccgggccctaccgcggtaccgtacgggaaggggtaacggggtcgtggggtaacggttcggttaccctttacttttaagttaccggngtaaccggtagtttacggtaacgtctacgttaaacgtcccacgttaagtccgttacgggaggtacggggaccttatacccaaccgttacgtaccgtaccgaagtaacccggaactaaaccgtacgaaacgaacgtacgtactttacgtttaaccaagtaaacgtcgaaacgtacgtaaccgtagaccgaaccggacgacgtaacgaccgggtacgttacgttacgttacgtttaaccgngtaccggaacggtaagcgtaaccgggtacgggaaccccgtaaggttaacccgtttacgaacgttcgaaaggttccgggacggtacccgggtaccggaacggtaacccgggtacccg

SEQ ID NO: 177871 - DNA, 908 bp, Homo sapiens
  misc_feature: GYAE6OF01DM6ZR.11.12.B01.1.454.CMB.1.raw
  modified_base (287)..(287): a, c, t, g, unknown or other
  misc_feature (287)..(287): n is a, c, g, or t
tcagcgagagataccacgaccggtgctcgatttagtagtgtagatttgggtctgggagaggagcccagcactgggattccgaggttgttccattcggtgatcagcactgaacacagagactcaccagtggtagtttggctggagtcgttcgggtttttccttggttgtacttaaagttttaaaaagggacgttccgtaggttggtggagggtcgtcggttcggttggggtggtagtcggtagggagggcggcctaggactccgacggtccgggtcggggggttcccngtacgtaccttccgtcgtgtcgcgtacgtcccgttacggttcggttaccgaccgtacgaccgtaccaacctaaccgtacgtagttcgggtacgggttccggtccccggccgtacggtaccggacgggtaaggggggacggtcggtagggtacggttcggtttacttttaccgtttagttacgagtacggtacggttaggtaacgttacgtaacgttaccggtaccgtacgtaacgggttacccgtacggggtacgggaacccgggtcctaccgttacccgaaccttacgttacccgaccgaaggtaacctaaaacgacgttaaacggtaaaacgtaccggtaccttacgtttaccgttttacggaaactaaacggttacccggaaactccgggttaccgaaggaaccggtaaccgtcggtaaccggtaaccggacccgggttccgggttacgttaaaccggttgtttaaccggcgggggttaaggacggtacgggtaacggggtacccgggtacccggtaaccccggttaaaggttaaccccttccggacggttaacccggttaacggggccgggtttaccggtaggggaccccggggtaaaccggtacgggtaaccccgg

SEQ ID NO: 177872 - DNA, 854 bp, Homo sapiens
  misc_feature: GYAE6OF01C97FJ.11.12.B01.1.454.CMB.1.raw
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (646)..(646): a, c, t, g, unknown or other
  misc_feature (646)..(646): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcgttgggtttttccttggttgtcttaaagtttttaaaaaggacgtccgtaagtggttggaggtggtcgtcgtgggtggagttcgtgggaggaggccttggactaccgacggtccggttcggggggttcccctaggacgtaccgttccgttccgttggtcgccacgtcccgtttacggttcggggttacccaaccggtcctaacggttaccaacctaacctaacgtacgttaggtacgggtttcggtccccggaccgtaacggtccgtaccggaagggggaacgggtcgtagggtaggttcggttccttttaccttttacgttacgagtacggtaggtggttagtaactagttacgttcncgtaaccgngtcccgggtaggacggggtcctaacgttaccgaacctattacccgtaccgaagaaccgtaacctaaaccgttacggtaaaaccacccgtacgttccgtttaggttttacctaaacgtaaattacggtaaaccncggtaccgtacggaacggtacccggtaacggtacgtacgaacccgggtaccggtaccggtttaattaccgttttacggaggtaccggtaacgggaggtacggtaacggggcccggtaaaccccgtaacggttaaaccggtactaaccggttacgtacgggtaccgggtaacgggttccggaccggggacccgaaacggggtaaccccg

SEQ ID NO: 177873 - DNA, 850 bp, Homo sapiens
  misc_feature: GYAE6OF01ETVHO.11.12.B01.1.454.CMB.1.raw
  modified_base (185)..(185): a, c, t, g, unknown or other
  misc_feature (185)..(185): n is a, c, g, or t
  modified_base (744)..(744): a, c, t, g, unknown or other
  misc_feature (744)..(744): n is a, c, g, or t
tcagcgagagataccacgaccggtgctcgatttagtagtgtagatttgggtcgtgggagaggagcccagcactgggattccgaggtgtttccattcggtgatcagcactgaacacagagactcaccatggtagttttggctggagtcgttgggttttccttgttgtacttaagttttaaaaaggngtccagtggtgaggtgcgtcgtgggtggagtcgtgggaggacggcctagactccgacggtcccggtcggggggttaccctggacgtaccgttccgtccgtggtcgccgtaccggtcccgttcggttcggggttaccctacccggtaccgtacgtacccaacctaccgttaactagtcggtacggttcggtcccgccgacggccgtaccggaagggggtacggggtcgttagggacgggtttcgggttaccctttaccgttttaactttaacgacggtacggtaaggtttacgggttaagtaactaagtttaccgttacccgactaacggtacccggttccgggtacggggtaccgggtacccgtaacgtttacccaaccgtacttaccgtaccgaaggtaaccgaaacccttaacgtaaccgtaaaacggtaaccctaccggttctttacgttttaacctaaaccgtaaaggtaccgaaccgtaccgtaccggttaggaaccggtacggacccgtaaggtaccgaaccggtacccgggttacgttagttacgttacggnggttacgacggtaagagtaccggtccggggaaaccctacggttaacttaccggacttacgagggtacggcccggttaagggcccgggaaaccgtaacggtacccgg

SEQ ID NO: 177874 - DNA, 921 bp, Homo sapiens
  misc_feature: GYAE6OF01COD6F.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcgttcgggtttttccttggttgtacttaaagtttttaaaaaggagtcctaggtgtggaggtgcgtcgtgggtggagtcgtgggaggacggcctagactccgacggtcccggtcggggggtccctggtacgtacctcctccgtgtcgcgacgtccgttcggttcgggttaccctaccgtaccgtacgtaccaacctacccgtaactagtcggtacggttccggggtccccgaccggacgggtccgtaccgggaagggggtacggggtcggtgggtacggttcgggttaccctttacgttttaacgtttaccgaggtacgtacgggttaggttaacgtaccgtaagttaccgttacgaccgtaacgtaccggttccgggtagggtaaccggggtcccgttaacgtacccgtaaccgtaccgttaccgtacccggaaaggtaaccgtaaaccctaaaccgttaaccgtaaaaccggtaacccttaaccgggttcctttaccggttttaacctaaacgtaaacgttacggaaaccgtcggtaaccggaaggtaacggaccggtacgtaacgtaccgggacccgtaccggggttcgttaacgttacttaacggtcggtacggtacggtaaggtacgggtaccgggtaccccggggtaacccttaaccgggttaaacccggtttccggttaaccggtacggttttaacccgggtaccggggttacccgggttaacccggggtaacccggggtaaacccccggggtaagggtaaccccccggg

SEQ ID NO: 177875 - DNA, 982 bp, Homo sapiens
  misc_feature: GYAE6OF01BY3TR.11.12.B01.1.454.CMB.1.raw
  modified_base (219)..(219): a, c, t, g, unknown or other
  misc_feature (219)..(219): n is a, c, g, or t
tcagcgagagataccacgaccggtgctcgatttagtagtgtagatttgggtttaggggggagaggagcccagcactgggattccgaggtgtttccattcggtgatcagcactgaacacagaggactcaccatggagttttggctgagcttgggtttttccttgttgcttagttttaaaaggagtccagtgtgaggtgcgtcgtggtgagtcgtggaggnggcctgactccgagccgtcggggggtccctgagtacctctccgtgtcgcacgtcctcggtcgggttccaccggtctacggtcccaacctacccttacgtaacgttcggtaacgggttttcggggtacccccgtaccggtaacgggtcccgttacccggggaaaggggggtaaccgggggtccgtttagggggtacggttttccgggggtttacccttttacccgttttttaaacgtttaacgacgggtaccgttaagggtttagggttaaccgtttaacgtacgtttaaccgtttcccggacgtaacggtacccgtttacccggggtagggtaccgggggacccttaacgtttacccgaaccctacgtacccgtaccgaagtaaccgtaacctaaaccgttaaccgtaaaaggaaccccttcggttaccgttttacggttttaaccccttaaaggtaaacgttacggaaaacccgtaggtacccgtaaggaacggtccgtaacccggtagttaacccgggaccggtttaacccgggtccgtttttaaacgtaacgttttaccggtacgggtagggtaaaccgggtacggtaaagggtcccggggttaaccccggggtaccccgtaaaacccggggtttaaacctttacccggtaaaccggttcccgggttaaacggtttcccggggggttaaacccgggcccggggttaaacccgggggggaaacccccttaaaacgggggggccccctttaaacccccgggg

SEQ ID NO: 177876 - DNA, 676 bp, Homo sapiens
  misc_feature: GYAE6OF01C87OI.11.12.B01.1.454.CMB.1.raw
  modified_base (514)..(514): a, c, t, g, unknown or other
  misc_feature (514)..(514): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgtcttaattttaaaaggagtccagtgtggaggtgtcgtcgtggtggagtcgtggaggaggcctgactccgaggcccggtgggggtccctgagtccttctccgtgtcgcacgtcctcgttcggttccaccgtcacgtccaccacctacagtggtacggttcgggcccgacgacggtccgtacgggagggggaacggggtcgtagggtaggttcggttcctttaccgtttattacgagtacgtaggttaggtacgtacagttacgttcccgagacgtacgtccggtaggaaccgggcctattccacctctccacagacaaccactacgtaacgactacgtctttacgtttacctanaaacgtacgaaccgtcgaccgtaggacgacgaccgtataccggaaccgtcgggtacgtttagttactcggtgcggagaggaggtccggtacgggtacccaagggttaccttacgaccgttgacggttacggacggttacggccggacggacccggtacccgg

SEQ ID NO: 177877 - DNA, 868 bp, Homo sapiens
  misc_feature: GYAE6OF01AXRD8.11.12.B01.1.454.CMB.1.raw
  modified_base (478)..(478): a, c, t, g, unknown or other
  misc_feature (478)..(478): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcgttgggtttttccttgttgtcttaaagtttttaaaaagggcgttccgtaggttggtgggtagggttgtccgttgtgggtggagttcgtggagggacggccttgactccgacggtccggtcgggggtccctgacgtaccttccgttcgttggtacgccgtacggtccgttcggttccgggttacccgtacccgtcgtacgtaccaacctaacctacgtagttacgggtcggtttccgggtccccgaccggtaccggccgtaccggggaagggggtaacggggtcggttagggtacggtttcgggtttccttttaaccgttttagttaaccggngtacgttaaggttacggttaacgtactaacgtttcgtacccgagtaaccgtcgttccgggagggtcgggtaccttatacccgacttcgtcctacgaagtaccgtaacctaacgtacgtaaacgtaccgtaccgttcgtttacgtttacctaaacgtaacgtacgaaccgtcgtacggtaacgaacggtaccgaacggtacctacgggaacccggttaccgggttccgtttaagtttaccgtaggttcgggtacgaacgggtaacggtacgggtaaccgtacccgggggtaaccctaaaccgggtttaaaccggttcccgtaaccggttacgtacgggttaaccggtcgggttaccgggaacccggggttaaacggaaccgggtacccccg

SEQ ID NO: 177878 - DNA, 754 bp, Homo sapiens
  misc_feature: GYAE6OF01D5PTA.11.12.B01.1.454.CMB.1.raw
  modified_base (180)..(180): a, c, t, g, unknown or other
  misc_feature (180)..(180): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatgggtagttttggctgagtcttgggttttccttgttgcttaattttaaaaggngtccagtgtgaggtgcgtcgtgggtggagtcgtgggaggacggtcctgactccgacggtccgggttcgggggtaccctgaacgtaccttcctccgttggtcgctacgtccgttcggttcggttccaccgttcacggttaccaccgtaacctactagttcggttacgggttcggtcccgaccgtacggtaccgttaccgggaaggggtacggggtcgtaggggtacggttcgggttaccttttaccgtttaactttacgacgtcgtaggtcgtacgtactagtacgtcgagtacgaccgttcggaggtacggggtacctacgttccaaccgtacttccgtacgagtaactacctaactaacgtaaacgaccgtacgttcgtttacgtttaaccacgtaaacgtcgaacctacggtaccgtaggaacgccgtacgtagtaccggaccgtaaccggtctttaaggactttacgcgggtcgaacggacgttacgggaccggtacgggacccttaaggttaaccttcgaccgtagtaccggttcggaccgtcgggaacggacccggtaaggtaccccgg

SEQ ID NO: 177879 - DNA, 886 bp, Homo sapiens
  misc_feature: GYAE6OF01D115P.11.12.B01.1.454.CMB.1.raw
  modified_base (219)..(219): a, c, t, g, unknown or other
  misc_feature (219)..(219): n is a, c, g, or t
tcagcgagagataccacgaccggtgctcgatttagtagtgtagattcggcggggctgccctttggctttggagatggtttttctcgatgagctcgtgggagaggagcccagcactagaagtcggcggtgtttccattcggtgatcagcactgaacacagaggactcaccagtggtagtttggctgagtcgttggttttcctcgttgtcttcttttaagnggtgtccgagtgtcgaggtcacgtaacgtggtaggtaggtcgggtgggggacggtcggttcggtcccgaggtcccggtgggggtaccggttcccgtaggaccgttaccttccgttcccgtggtcgaccgtacggtccgttccggttagggttacctttacccgtacccgtttacgaaggggtacgtaccgttagttacggtaacgtacgttcggaaccgtacccggttccggggtaccccgaccgtaaccggggtcccgtaaccgggagggtaaccggggtaacgggggtcggtttaggggtagggggttcgggggttacgggtacgttaaagggttttacgttagggtttaggggtaagttagggttaaaggttaaagggttaaacgttttaaaagttaaaacggtttaaacgttaacgggttaacgggtaaccggtaacccgggtttaaccgggtaacgggtaaaccggggtacccgttaactttaccccgaaccttaaccgtaccgtaaccggtaacgtaaccgtaacccgtaaccgtttaaacccgaaacgtaaccggttacggtaacgttacgtacgtaacggtaactaaacggtaaccgaacgtaccggtacgaacggtacgaaccggacgggaacggacggtaccggtcgttaggttacg

SEQ ID NO: 177880 - DNA, 771 bp, Homo sapiens
  misc_feature: GYAE6OF01DGVUL.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcgttgggtttttccttgttgtacttaagttttaaaaggagtccagtgtggaggtgcgtcgtgggtggagtcgtgggaggaggtcctgaactccgacggtccggttcgggggtccctagacgtaccttccgtccgtgtcgcgtacgtcccgttcgttcgggttaccctaccggttacacgttaccaacctaaccgtaacgtagtacggttacggttccgggtcccgtaccgacgggtccgtaccgggaagggggtacggtcggtagggtcggtttcgggttccttttacgttttacttacgacgtacgtaggttacggttacgtaacgtattacgttcccggacaacggttaacgttcccgggtagggaccggggtaccctacgtttacccaccgttactcccgtaaccgagaaaccgtaccgtaacttaacgaaacggtaccttacgttacctttagttttaacctaacaagttaccgaaacgtacgacccggttaaggaacggtacgtcggttaacaaccggaccgttccgggttacttagttacgttacgtggtcggacgtagcggtacgcgggtacctaacgtattcgacgtcgtagcggacgtcggacggcgaacggtcccg

SEQ ID NO: 177881 - DNA, 1005 bp, Homo sapiens
  misc_feature: GYAE6OF01BGR7G.11.12.B01.1.454.CMB.1.raw
  modified_base (662)..(662): a, c, t, g, unknown or other
  misc_feature (662)..(662): n is a, c, g, or t
  modified_base (716)..(716): a, c, t, g, unknown or other
  misc_feature (716)..(716): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatgggtagttttggctgagtcgtttgggtttttcccttgttagtctttaaagttttaaaaggacgtccgtagtggttggaggttggcgttcgtgggtagggaggttcgtaggggtagggacggtcccgttggtaacctccggaacgggtcccggggttcgggggggttccctagggacgtaccttcccgttccgttggtcggacctacggtcccgtttcggttaccggggtttacccctacccggttaccgtacggtaccctaaacccgttaacccttaaacggtacggtttacgggttaaccgggggtttcccgggggaacccctcccggaacggggtcccggtaccggggaacggggggtaacggggccgtttaaggggtccgggttttacgggtttcccttttaaccggttttaacgttaacggcgttacgggtacggttaggttaaccgtaacttacgtttaccgtacgacctaggtacccgtcgggtaacgggtccggggtaccacgttccgaaccctgtccgtaaccganaacgaacctacgtaacgtaaacgacgtccgtttagtttacgtttaacccgtaanaaaccggtactaaccggtacgaaccggttcggaaccgaacggtccggtagtaaccccggtacggtaccgggttacccggtttatttaacccggtccgttaggggtacgaaccgggtaacgggttacgggtaccggggttaacccccggtaaacccggttaacccggtaaaacccccggttttcgaccccgggttttaaaacgccggggttttaaaccccggggggttacccgtcccggggggttaaaccccggggaacccggggttaaaccccgggtaaaccccccggg

SEQ ID NO: 177882 - DNA, 711 bp, Homo sapiens
  misc_feature: GYAE6OF01C5S2M.11.12.B01.1.454.CMB.1.raw
  modified_base (335)..(335): a, c, t, g, unknown or other
  misc_feature (335)..(335): n is a, c, g, or t
  modified_base (407)..(407): a, c, t, g, unknown or other
  misc_feature (407)..(407): n is a, c, g, or t
  modified_base (565)..(565): a, c, t, g, unknown or other
  misc_feature (565)..(565): n is a, c, g, or t
  modified_base (629)..(629): a, c, t, g, unknown or other
  misc_feature (629)..(629): n is a, c, g, or t
  modified_base (635)..(635): a, c, t, g, unknown or other
  misc_feature (635)..(635): n is a, c, g, or t
tcagcgagagataccacgaccggtgctcgatttagtagtgtagatttgggtctgggagaggagcccagcactgggattccggaggtgtttccattcggtgatcagcactgaacacagagactcaccatggtagttttggctgagtcgttgggttttcttgttgtacttaagtttaaaggctccgtagtgtggaggtgccgttgtagggtggagtcggtgggaggacggcctgactccgacggtcccggggttacgggggtccctaggaacgtccttccgttccgtgtcgccgtacgtccgttggtcggtccaccgtcacgtccacgtccttaagngtggtcggttcggccgacaggccgtacgggaaggggcggcgtgggtacgtcgttactttacgtttatacggngtcgtaggttacgtacgtaacttacgtaccgttaccgactaaccgggtcggtaccgggttagggaccggttacccttacttaccacgttacttacgaccgagaaactaaccgttactaaacgacgtaaccctcgtttacgttactttacaatacgacncgtactgaacggactacgtcgtaaccgcggttccggtaacgtcgtttacgatttaccgaggggntaacgngggtaccgtcggaccgtaactacgggtactggacgacgtgggtccgtaacgggccggacggaaaccgtcggtaccg

SEQ ID NO: 177883 - DNA, 861 bp, Homo sapiens
  misc_feature: GYAE6OF01AS7QO.11.12.B01.1.454.CMB.1.raw
  modified_base (176)..(176): a, c, t, g, unknown or other
  misc_feature (176)..(176): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgctaattttaaaaggngtccagtgtgaggtgcgtcgtggtggagtcgtgggaggaggcctgatccgaggccggttcggggggtccctggacgtacctccttccgtggtgccgacgtccgttcgttcgggttccaccgttcgacgtaccaacctacctactagttcggtacggtttccggggtccccgccgacgggtccgtaccggaagggggtaacggggtcggtaggggtacggttcgggttcctttaccgttttactttaaccgaggtacgtagggttacggtaacgtaactacgtttacgttcccggactaaccgtccgttaccgggtacgggtacgggggtacccttaagtttacccgacccgtaacttacccgtaaccgaaggaaccgtaacctaaccgtaacgtaaacgaaaccctaccggttctttacgttttaacctaacgtaaacgtacgtaaaccgtacggtaccgtagggaacgaccggtaccgtaacgttacccgggaacggttaccccggggtaaccgtttacggttaaacgtttccggttaggtacgggaaccggtaagggtaccggtaaccggggtacccgggaaaccccgtaacgggttaaacccgttacgtaaccggttaccgtaaggttaccgggtacggttaccgggaacggggtaacccgggtaacccggggtaaccccgg

SEQ ID NO: 177884 - DNA, 883 bp, Homo sapiens
  misc_feature: GYAE6OF01BAXHO.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagcgttgggttttccttgttgctaagtttaaaaggagtccagtgtgaggtgcgtcgtggtggagtcgtgggaggacggcctgactccgacggtccggtcggggggtccctggacgtactccgtccgtgtcgcgacgtcctcgttcgggttaccaccgtcgacgtccaacctacctacgagtaggtacggttcgggtcccgaccgtacggccgtaccgggaagggggaacggggtccgttaggggtacggttcgggttacctttccgttttaacgtttacgaggtaccgtaggttacggttaacgtaacgtaacgttacgttacccggcgtaaacgtaccgttaccgggtacgggtaaccgggggtccctaacgtttccgaacccgtacgttaccccgtaacccgtaaaggtaaccgtaaacccttaaaccgttaacccgtaaaaacggtaaaccccgtaccggttaccgtttacggttttttaccctaaacggtaaaaacgtttaccggaaaaccgtcggtacccgtaaggaaccggtaaccggtaccggtaacgtacgggaacccgtaccggggtccctttaagtttaaccggtacgttaggaccgggtacggtaagggtaccggttaaccgggtcccgggaaaccccgtaacgggttaaacccggttaccgacggttaacggttacggtacggggtaccgttacggggacccgggtaaccgtaacccggggtaaccccgg

SEQ ID NO: 177885 - DNA, 884 bp, Homo sapiens
  misc_feature: GYAE6OF01CF2JI.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcgttgggttttccttgttgtactttaaagttttaaaaaggacgtacctaggtggtaggtaggtcgccggttgtgggtggagtcgtgggaggacgtctgactccgacggtccgggtcgggggtccctaggacgtaccttctccgtgtcgacgtacgtccgtcggttcggtacctaccggtcacgtaccaacctaccctactagttagggtacggttccgggtacccgaccggtacggtccgtaccggggaaggggtaaccggggtcggtacggggtacgggtttccgggtttaccctttaccgtttttaacgtacggtacggtacggttaagggttaggttaaccgttaacgtaactttaccgttaacccaacgttaaccggtacccggttacgggtacgggtaccgggtaccgttaacttacccgaaacctacgtacccgtaacggacgtaaaccgtaaccctaaacgttaaccgaaacgttaaccgtaccggtttccttttaacggttttaccaaaacgtaaacgttaaccggaaccgttaccggtacggtaacggaacggtaaccgtccggtaaagttacccggaacccggtttaccggtacgtttaacgtacgtttacgggtcggtaacggaaccggttaggaccgggtaccggtacccggggtaaccctaaggttaactaccggtaccgtagtacggtaccggtcgtacggggtaccggacggtaaaccggtccg

SEQ ID NO: 177886 - DNA, 755 bp, Homo sapiens
  misc_feature: GYAE6OF01E1MK9.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggtttttccttgttgtctaattttaaaaaggagtccagtgtgaggtgcgtctggtggagtcgtggagggaggcctgatccagccgtcgggggtccctgacgactctcctgtgcacgccttcgtcgggttccaccgtcacgtccaccacctacagtgtacggttcgggtcccgccgacggccgtccggaagggggaacggggcgtaggggtacggttcgggttccttttaccgttttaacgtttacgaggtcgtaaggttaggtaacgttaactaacgttacgttccgacgtaacgtacccgtccggtacgggacggggtaccgtacttaccgaacctacgttcctaccgaagaacgtaacctaactacgtaaaacgaacccgtacgttccttttagttttaaccctaagtaaaagtacgaaacctacgtaccgttaagggaaccgacgtaacccgtagtaccgggaacccgtacgggttacccgtttattaacgtttacgtagggtgaacggagtacggacgggttccgggaaaccctaacggttaaacccgttcaacgtacgttacgtcggggacgttaccgggcgggaacccgaacgggtaccccg

SEQ ID NO: 177887 - DNA, 871 bp, Homo sapiens
  misc_feature: GYAE6OF01DH7R7.11.12.B01.1.454.CMB.1.raw
  modified_base (689)..(689): a, c, t, g, unknown or other
  misc_feature (689)..(689): n is a, c, g, or t
  modified_base (753)..(753): a, c, t, g, unknown or other
  misc_feature (753)..(753): n is a, c, g, or t
tcagcgagagataccacgaccggtgctcgatttagtagtgtagatttgggtctgggagaggagcccagcactgggattccgaggttgtttccattcggtgatcagcactgaacacagaggactcaccatggtagttttggctgagtcgttgggtttttccttgtttgtacttaagtttttaaaaagggacttccgtaggttggtggaggtgtcgttcgtgggtggtagtcgtaggagggacgtccgtagactccgacggtccgggttcggggggtccctagacgtacctccttccgttgtcgaccgtacgtcccgttccggttacgggttacccacccgttaccgacgtaccctaacctaacccgtaacgtagttacggtacgggtttacgggacccccgaccggtaccgggtcccgtaacggggacgggggtaaacggggtcggttaggggacgggttttcgggtttacctttaccgtttttaaagtttaacgagtacggttaaggttacgggttaactaacgttagttaccttacccgggtaataccggtaaccggttccgggaacgggtaccggggtcctttaacttaccgtaaacctacgtaccctacggaaacgtaacgtacccaaaagttaacccgtaaaacgtacccgtacggtttacgttttcgtttaaacccttttaaanaaagtaaccgaaactaggtaccgtaggaacgacggtcaacgtcgaaccggtacgtcgttaattntacgtgacgacgtaggacggtaccgggccggttaaacccgaaagttacccgttaacgtaccgtagttaccggttacggggaccttacgggaacgggtaacccggacccgggtaacccg

SEQ ID NO: 177888 - DNA, 1029 bp, Homo sapiens
  misc_feature: GYAE6OF01C7D0Y.11.12.B01.1.454.CMB.1.raw
tcagcgagagataccacgaccggtgctcgatttagtagtgtagattcggcggggctgccctttggctttggagatggttttctcgatgagctctgggagaggagcccagcacgtagaagtcggcggtgttccattcggtgatcagcactgaacacagagactcacagtggtagtttggctggagtcgttgggttttcctcggttgtctttacgttttaaggagggttcgtaccgtaggttcgtcgtagggtcgacgtaacggttgggtacgggtcggttcgggtagggggggacggtccggtcgggttaccgacggtccggttaggggtaccgtcccgtaggacgtccgttcctccgtacggtcgacgtacggttccgtacgtacggttaccttcccgtaaccgtttacggaacgggttactaccgttaagtacgtaaacctaggtccgtaacggtacccggttaccgggggtacccgaacccggtagggttaccccggtaaccggaacgggggtaaccggtaaacggggggtccgtaaggggggtttaacgggtcgggggttacgggttaacggttaaggtttaaacgttacgggttaaggggtttaacgtagggttaaagggttaagggtttaaaaccgttttaaagtaaaaaccgtttacggtaaacggtttaaaccggggtaccggttaacccggttaacccggggttaacggggtaaacccggggtttacccgttaaaccgttttacccgaaacccgttaaccggtttacccgtaaacccggttaaacgggtaaaccccgttaaacccggttaaaccggtttaaaccccgaaagggttaaaccccgggttaacggtttacccggtttaaaccgtaccggttaaaaccgtaaacgtttaaaacggggtaaaccctaacgggttaacccggttacgggtaaaccgggtaaacgggaacccgggttaaacccgggaaacggttaaacccgggttaccggggtttacgttttaaccgggttaaacggg

SEQ ID NO: 177889 - DNA, 817 bp, Homo sapiens
  misc_feature: GYAE6OF01BF0W0.11.12.B01.1.454.CMB.1.raw
  modified_base (185)..(185): a, c, t, g, unknown or other
  misc_feature (185)..(185): n is a, c, g, or t
  modified_base (314)..(314): a, c, t, g, unknown or other
  misc_feature (314)..(314): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccagtggtagttttggctgagtcgttgggtttttccttgttgtacttaagttttaaaaggngtccagttggtggaggtgcgtcgtaggtggagttcgtagggaggtacggcccttagacgtccgaggtccggttcgggggtccctggacggtcctcctccgtgtcgctacggtccttcggtcggttaccnccgttacgacgttaccaacctaacctacgtagttacgggtcggttccggggtcccgacccgaggtccggtaccggggtaagggggaacggggtcgttaggggtacggttcgggtttacccttttacgttttacgttaacggtacgtaccgtaaggttacgggttactaaacgtttctaacgttcccggaactacgtccgtcggtacggacgggtcctattaccgacctataccgacaagtacgtaaccgacttaacgtaaacctaacgtaccgttcggtttactttaactaacgtaagtaacggaacctacggtcgtaacggagccgtaacggtgtaaccggtaccggtaccgggtttaccgtacgtttacgttaaccggtggtacgacgggtacgtacggtacgggtacccggtaaaccggtaaccgttaaccggtttaccgcggtttaacgtcggtaacgggtaccgttagggtcccgggaaacccgtaacgggtaccccg

SEQ ID NO: 177890 - DNA, 717 bp, Homo sapiens
  misc_feature: GYAE6OF01CLD41.11.12.B01.1.454.CMB.1.raw
  modified_base (279)..(279): a, c, t, g, unknown or other
  misc_feature (279)..(279): n is a, c, g, or t
  modified_base (426)..(426): a, c, t, g, unknown or other
  misc_feature (426)..(426): n is a, c, g, or t
  modified_base (642)..(642): a, c, t, g, unknown or other
  misc_feature (642)..(642): n is a, c, g, or t
  modified_base (679)..(679): a, c, t, g, unknown or other
  misc_feature (679)..(679): n is a, c, g, or t
  modified_base (700)..(700): a, c, t, g, unknown or other
  misc_feature (700)..(700): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagtcgttgggttttccttgttgtcttaattttaaaaggagtccagtgtgaggtgcgtcgtggtggagtcgtggaggaggcctgactccgacggtcccggtcgggggtcccctgacgtaccttccgtccgtggtgaccncgtcccttcgtcgggttccaccgttcacgtaccaccgaacctactagtcggtacggttccgggccgaccgtacgggccgtaccgggagggggtaacgggtcggtacgggtaggttcgggttacctttaccgttttaacgttaaccgngtacgtaggttacggtaaagttactacgtacggttcccgacgacgtacccgtccgggtaggaccggttaccgacttacccgactactaccgtacgaaggtaaccacgtaactacgtaaacgactacgttcttagttactaacgtaagtacaacgcggacctgacggtacacggataacgggcctacggggtctacgtttagaaccgtgtcggaagngtacggtgacccgggtaccaaggtacgttacgaccgntacggtaccggtgacccgggnggaacccggacgtcccg

SEQ ID NO: 177891 - DNA, 770 bp, Homo sapiens
  misc_feature: GYAE6OF01DU4C1.11.12.B01.1.454.CMB.1.raw
  modified_base (219)..(219): a, c, t, g, unknown or other
  misc_feature (219)..(219): n is a, c, g, or t
tcagcgagagataccacgaccggtgctcgatttagtagtgtagattcacggggctgccctttggctttggagatggttttctcgatgagctctgggagaggagcccagcactagaagtcggcggtgtttccattcggtgatcagcactgaacacagagactcacagtggtagttgggctggacgtcgttgggttttcctcgttgtcttacgttttaagnggtcgtccagtgtcgaggtgacagtggtggacgtcggtggggagcgtcggcaggccgtggggacgtccgtggactcgtctccgtgtcgcaggtccgtagtcggtacttccgaccgttgacgggtatactagtacgactagtccgacgtaccggtcgggtcccgcggacgtcccgtagggaacggtacgggaacggggtcgtagggggtacggtgggggtacgtacgttaaacggtttataggttacggtatagggtaaacggttaagggttaaagtttaaactaaacgtttggtaaacggtacgggttaacgtaccgggttacgggtaacgggtaaccgggccttaacgttacccaaccggtacttacccggtaacgtaaacggtaccgtaaccgtaacccttaaaccgggaaaacttaccgggttacgtaacggtttacccttaaggtacgaaaacccggtaaagttaacccgaacgggttacccgtacggtaacggaacggtaacccgggtacgaaacccgggtacgtacggtacgttaggttaaccgg

SEQ ID NO: 177892 - DNA, 763 bp, Homo sapiens
  misc_feature: GYAE6OF01DJC1H.11.12.B01.1.454.CMB.1.raw
  modified_base (385)..(385): a, c, t, g, unknown or other
  misc_feature (385)..(385): n is a, c, g, or t
tcagcgagagataccacgaccggtgctcgatttagtagtgtagatttgggtctgggagaggagcccagcactgggattccggaggtgtttccattcggtgatcagcactgaacacagaggactcaccatggtagttttggctgagtcgttgggttttccttgttgtcttaagttttaaaaggagtccagtgtgaggtgcgtcgtgggtagagtcgtagggaggcggcctgactccgacggccggttcggggggtccctgacgtacctctccgtggtcgcgagcccgttcggttaccggttcgaacccgtcgacgttaccacctaacctatagtggtacggttcgggcccgaccgtacgggtcctaccgggaaggggggacggggngtaggggtacggttcggtttccttaccttttaagttacgagacgtaggttgtaactacacgtttacttcccgacacggtaccgtcccgggtgggacccgggtcccgtattaccgaaccttacgtcccgtacgaaagtaccgtaaacctaaccttaacgtaaaccggaaactttcccgtagttttaccgtttaccttaaacaacgttacgaaaccgcgtacccgtagagacgtccgatacggaccgtacgtcggtaattacgttcgtgaggacggagtacggtccgggtaaccggtaccacggttaaaccgttacgcccgaacgttagtttccgggaacgttcggggaccggggaaaccccaacggggttaacccccgg

SEQ ID NO: 177893 - DNA, 709 bp, Homo sapiens
  misc_feature: GYAE6OF01C7G5B.11.12.B01.1.454.CMB.1.raw
  modified_base (426)..(426): a, c, t, g, unknown or other
  misc_feature (426)..(426): n is a, c, g, or t
tcagcgagagataccacgaccggtgctcgatttagtagtgtagatttgggtctgggagaggagcccagcactgggattccgaggtgtttccattcggtgatcagcactgaacacagaggactacaccagtggtagtttggctgagtcgttgggttttccttgttgacttaaagttttaaaaggacgtacgagtgtaggacggtgcgtgtggtgggatcgtaggaggtacggcctagactccgagggtccggttcggggggttcccagaacgtacctctccgtggtcgcacggtccgtcgttcgggtacctaccgtcaaggttccaacgtaccaagtgtaggtcgggttacggtccgccggtagccgttacgggaacgggaggggtccgtaggggtcggtagggtcgacttaggttatagtagtagngtagtaacggtaattaataactgtagtggaactacgttacgggaacgggtccggaagtacttaccgactactctaccgagtaacctactaccgttacaaacgtacgtacggtatacgtactacgaataacaacgtacgaacaccggtagacggtaccggacgacggtaccgagttacgtattaggttcgttaaccgtggaaccggaggtaacgggaaacgtacggacgacggttacggacgggaacggtaggggaattacgggtagtttacggtgtttaacgg

SEQ ID NO: 177894 - DNA, 859 bp, Homo sapiens
  misc_feature: GYAE6OF01BXIRH.11.12.B01.1.454.CMB.1.raw
  modified_base (197)..(197): a, c, t, g, unknown or other
  misc_feature (197)..(197): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgcttagttttaaaaggagtccagtgtgaggtgcgttntggtggagtcgtggaggaggcctagatccagccggtgggggtccctgagactctctgtgcagccttcgtgggttcaccgtcacgccacctacctactatgtaggttcgggtaccgccgaggccttacggaggggtaacggggctagggaggttcgggttcctttacttttaagtttacagtcgtaacggttcggtaacggtactagtttaacttccccgagtaacggtaccgttccgggtaggtacgggggtaccctagtttaccaacccgtacttctacccgaaggtaacgaaaccctaaacgttaaccgtaaaacggtaaccccgtaaccggttacttttacggtttttaacccttaaaccaaaacgggttttaacggaaaaccgtaacgggttaccctagggaacggaaccgggtacccggaacgtttaaccgggaaccggtacccggggttaccggttttaacgttaacggtttacccgtaggttaaccgggaacccgggtaagggtaaacgggtaacggggttaccccgggggaaaccccctaaacgggttaaaacccgtttacccggtaaccccggttaacggtttaacgggtaccgggttaaacccgggggttccggaaccgggggtaaccccgggtaaacccgggggtaccccg

SEQ ID NO: 177895 - DNA, 790 bp, Homo sapiens
  misc_feature: GYAE6OF02GMUC6.11.12.B01.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (480)..(480): a, c, t, g, unknown or other
  misc_feature (480)..(480): n is a, c, g, or t
  modified_base (636)..(636): a, c, t, g, unknown or other
  misc_feature (636)..(636): n is a, c, g, or t
tcagcgagagataccacgaccggtgctcgatttagtagtgtagatttcgggtttgggggggggagaggaggcccgagcactgggatttccgagggtgtttccatttccggtgatcgacgcgactgaacacagaggacctcacccatggagttttggcgtgagcgggtcgtttcggtctaggctnttaaacgtagcangtcngcncgtntgtggctctggagaggccagactccagtccgttcgggggtccctgacgaccgtaccctcctaggttggaccgttagggtccgtttacgttaacggggtttactaccggtttcctaaggttttccgaaaccctaaccccttaacgtacctaccggaagggtttccgggtaaaccccgtcccccaaaagggtcctaaccgaagggggtaaagggttctaggggaacggttcggtaccttaccgtttacttacgagggtctagtagtacgtactnttacttccggactacgtaacgttcccgtggaaccgggacctacgttcccacccgtatccctactacgtacggaccgtaaccttccgaaaggaccctacgggaccttacgggtttacctactaaaactcgttaaacttacgtccgtagacggtaccnccgaattacggaaccacggtccgttaagtactttaacgttcggtacggttcggggtaagtaccgggacgggtaccggggaccccctagggttaaccgttaacccgtgttacgagtcgggacccgtggtaccggggccctacccgggcctaacgg

SEQ ID NO: 177896 - DNA, 394 bp, Homo sapiens
  misc_feature: GYAE6OF02IBBRT.11.12.B01.1.454.CMB.1.raw
  modified_base (389)..(394): a, c, t, g, unknown or other
  misc_feature (389)..(394): n is a, c, g, or t
tcagcgagagataccacgaccggtgctcgatttagtagtgtagatttgggttttccttgttgctattttaaaagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcgctgagcgggctggcaaggcgcatagnnnnnn

SEQ ID NO: 177897 - DNA, 535 bp, Homo sapiens
  misc_feature: GYAE6OF02JH3F7.11.12.B01.1.454.CMB.1.raw
  modified_base (450)..(450): a, c, t, g, unknown or other
  misc_feature (450)..(450): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactcgtgaggggccattcaccatctccagagacaactctaagaacacgctgtttctacaaatgaacagcctagagagccgatgacncggccgtgtattactgtgcgagagagtcggggacccacgtaacgttacacgctagtcggaccgtcgtcggggaccaagggtaccc

SEQ ID NO: 177898 - DNA, 574 bp, Homo sapiens
  misc_feature: GYAE6OF02GZHP8.11.12.B01.1.454.CMB.1.raw
  modified_base (437)..(437): a, c, t, g, unknown or other
  misc_feature (437)..(437): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggagggctggagtgggtctctttattacagcagtggtagtacatacttccgcagactccgtggacggggccattcaccatctccagacacaactctaaagaacacgtcttgtttctacaaatcgaaacngcctagacgagccgatcgaccgacgggccgttagtacttacgtgtacgacgagagtacggtacggggccccaaggtaaccgttacgaccgtctaagtcgggaccgttccggtacgggggacccgaaggggtaccccg

SEQ ID NO: 177899 - DNA, 595 bp, Homo sapiens
  misc_feature: GYAE6OF02HCGQ3.11.12.B01.1.454.CMB.1.raw
tcagcgagagataccacgaccggtgctcgatttagtagtgtagatttgggtcgtgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgaggttgggtccgccaggctccgaggggaaggggctggaggtgggtctctttatttacagcagtgtagtacatattccgcagactccgtggagggccgattccacctatcctccgagacgaacaactctaaacgaacaccgtcttacgttttcctactaaattcgaacacgtcctagacggagtcccgaatcggaaccgacggccgttagttaacttacgtgtcgacggagagtggtaccggggccctaaacgaacggttacacggacttagccgggtacgttccggtacggggccgaacgggtacccg

SEQ ID NO: 177900 - DNA, 569 bp, Homo sapiens
  misc_feature: GYAE6OF02F1B8C.11.12.B01.1.454.CMB.1.raw
  modified_base (298)..(298): a, c, t, g, unknown or other
  misc_feature (298)..(298): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccnccagggcctccgagggaaggggctgggagtgggtctcctttattacagcagtggtagtacatattccgcagactccggtggaggggccattccacctatctccgagacgacaacgtctaaagaaccacgtcttgtttcctacaaattgaacagcctgagacgccgatcgaccgacggtccgtgtaacttctggtgcgagagacgtcggggacccaacggtaaccgttacacgctagtgggaccgttcggacggggacccgaagggtacccg

SEQ ID NO: 177901 - DNA, 556 bp, Homo sapiens
  misc_feature: GYAE6OF02GKX3G.11.12.B01.1.454.CMB.1.raw
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (492)..(492): a, c, t, g, unknown or other
  misc_feature (492)..(492): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcgtggtttcgtgttagctatttaaaggagtccagtgtgaggtgcgtctggtggagtctggaggaggcctgatccagcctggggggtccctgagactctcctgtgcagcctctgggttcaccgtcagtcacacctacatgagttgggtcccgccaggcctccgagggaaggggctggagtgggtctcctttatttacagcagtggtatacgattattccgcagactccgtggacggggccgattccaaccatctccagacgacaaacgtctaaacgacacgtcttgtttctacaaattgaaacngtccngagngtcccgatgaccgacgtccgttgtattagtgtgacgngagaggtcgggacccaggtaacgtccgtagctagtgggaccgtcgtagggtccgaagggacccg

SEQ ID NO: 177902 - DNA, 600 bp, Homo sapiens
  misc_feature: GYAE6OF02H0C5H.11.12.B01.1.454.CMB.1.raw
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (313)..(313): a, c, t, g, unknown or other
  misc_feature (313)..(313): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcggtcgttcggtctaaggcacttaaagtagnatgnagtgntntgtgantggagngctgatcanctggggtccgtgagactctcctgtncngctctggtctcgcagcacactacatgtgttggtcgccaggctccgaggaaggggtgtaggagtggtcttcttattactgngtagtagtagtatatactcgtcgtacgtacgtacgtgacggtcgtacgtctactactctacgacgacactaactactaacgactacgtacgttacttacttactaacgtaacgtactacgtacgtacgtacgacgacgtacgtacgtaccgtaccggtcgtacgttacgttacgtagtacgtacgtagtacgtacggtaccgggtaacccgtaaccgttaaccgtaaccgtaacgtacgtacggtacggtaccggtaccgggtaccggtaccggtaccggtacccgg

SEQ ID NO: 177903 - DNA, 553 bp, Homo sapiens
  misc_feature: GYAE6OF02GVEH2.11.12.B01.1.454.CMB.1.raw
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggaaggggctgggagtgggtctcctttattacagcagtggtagtacatacttccgcagactccggtgacggggccattcacatctccagagacaactctaagaacncgcttcgtttctacaattgaacncgcctgagagcagtgacgacggccgtgtacttagtgtgcgagagtagtcggggacccaacggtaacgttacacgtcgtacgtgggtaccgtcggtcggggaccgagggtaccccgg

SEQ ID NO: 177904 - DNA, 564 bp, Homo sapiens
  misc_feature: GYAE6OF02I3FJI.11.12.B01.1.454.CMB.1.raw
  modified_base (452)..(452): a, c, t, g, unknown or other
  misc_feature (452)..(452): n is a, c, g, or t
  modified_base (481)..(481): a, c, t, g, unknown or other
  misc_feature (481)..(481): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccgaggctccgaggggaaggggcgtgggagtgggtctcctttatttacagcagtggtagtactatattccgcagactccgtggacggggccattcacctatctccagagacaactctaaagaacacgcttgtttctacaaatgaacagcctagancgcgatcgacgacggcgttagtatttcgngtcgagaggagaggtcgggacccaacggtaacgttacgtacgtactacgtggaccgttcggtacggggaccgaagggtacccg

SEQ ID NO: 177905 - DNA, 557 bp, Homo sapiens
  misc_feature: GYAE6OF02GK36U.11.12.B01.1.454.CMB.1.raw
  modified_base (392)..(392): a, c, t, g, unknown or other
  misc_feature (392)..(392): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagcctggggggtccctgagacctctcctgtgcagcctctgggttcaccgtcagtcacacctacatgagttgggtccgccaggctccgagggaagggctgggagtgggtctcctttattacagcagtggtagtacatatccgcagactccgtgacggggccattcaccatcncagagacaactacaagaacacgcttgtttctacaaatgaacagcctgagacgccgatcgacacggccgtagttagttactgtgcgaggagagtcggggacccaacggtaaccgttaaccgtacgcgtagtcgggtacgtcggtacgggggaccgaagggtacccg

SEQ ID NO: 177906 - DNA, 703 bp, Homo sapiens
  misc_feature: GYAE6OF02GHN6T.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggcctccgagggagggctggagtgggtctcctttattacagcagtggtagtacatacttccgcacgtactccggtaggacggggtcctagttccgacctacgttcctacccaaggacgtaccaaaccgttactaaagaacccacgtccttacggttttacctaacgtaaacgttcgaaaccgacgttacccgtaggtaacggacggacccgtaagttacggaaaccccggtacgggtacccggtttacggttaacgttttaaccgtggtaggtacccggtaagggtacggtacgggttacccggggggacccctaaacgggttaaccggtttaaccggtaccggacgtttacggtcggggtaaccgttcgggtcccgggggacccaacgggggtaaccccgg

SEQ ID NO: 177907 - DNA, 585 bp, Homo sapiens
  misc_feature: GYAE6OF02FX8HE.11.12.B01.1.454.CMB.1.raw
  modified_base (301)..(301): a, c, t, g, unknown or other
  misc_feature (301)..(301): n is a, c, g, or t
  modified_base (445)..(445): a, c, t, g, unknown or other
  misc_feature (445)..(445): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaagaggtgtccagtgtcaggtgcaactggtggagtctgggggaggcgtggtccagcctgggaggtccctgagactctcctgtgcagcgtctggattccaccttcaggagtctatgacatgcacgtggggtcccnccgaggcctccgaggcgaaggggctggaggtggggtgctagttatagtggtatgatggaagtttataaaatactatgggatacctcggtagaacgggccagttccacatcctcgagacgactaccttaccaagaacctacggtntatctagactaaagcgaaccaggacccgtagaacggccgaacggaccgacggtcgagttagttacttacgtcggtggacggaacgggggaaaccgaacgtacgacggacggtaccggaccggaggggtacgtaggtaacg

SEQ ID NO: 177908 - DNA, 535 bp, Homo sapiens
  misc_feature: GYAE6OF02FSM4V.11.12.B01.1.454.CMB.1.raw
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggagggctggagtgggtctcctttatttacagcagtggtagtacatattccgcagactcgtggaggggccgattcaccatctccagagacaactctaaagacacgcttagtttctacaaattgaacngcctgaganccgatgacncggcctgtacttcgtgtgcgagagagtcgggccaacggtaacgttacacgtctagtcggaccgtgtcgggaccagggacccg

SEQ ID NO: 177909 - DNA, 578 bp, Homo sapiens
  misc_feature: GYAE6OF02GNG98.11.12.B01.1.454.CMB.1.raw
  modified_base (296)..(296): a, c, t, g, unknown or other
  misc_feature (296)..(296): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccnccaggctccgagggaggggctgggagtgggtctcctttatttacagcagtggtagtacatattccgcagactcggtgacggggccattcaccatcctccagagacaactctaaagaacacgtcttgtttctacaaattgaaccagcctagagacgccgatcgacgaccgggccgttgttaacttactgtgaccgagaggacgtcgggggaccctaacggtaaccgttaacgtaccggcttaggtcgggaccgttcggtacgggggacccaaggggtaccccg

SEQ ID NO: 177910 - DNA, 785 bp, Homo sapiens
  misc_feature: GYAE6OF02JFIL2.11.12.B01.1.454.CMB.1.raw
  modified_base (192)..(192): a, c, t, g, unknown or other
  misc_feature (192)..(192): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaggagtccagtgtgaggtgcgtntggtggagtctggaggaggcctgatccgagccgtgggggtccctgacgactctcctgtcgcagcctcgtgggttcaccgtcacgtcacacctacatgtacggttcgggtcccgaccgaggcctccggaaggggacggggtcgtgggacggttcgggttacctttccgttttaagtttacgacggtcgtaaggttaggtaacgtactaattacgtttaccgacgtaacggtaccgttccgggtagggaccgggggtaccgtaactttccgaaacccgtacgtttcccgtaccgaacggtaacgtaacctaaacttaccgtaaaacggaaccctacgtcgtttacgttttacctaaacaaacgttcgaaaccgtacggtaccccggaaagcggtaacccggagttaccggaacccggtaccgggtccggttaagtttaaccgttacgttcggtacggaaccggtaagggtaacgggtacgggtaccgggggtaacccctaaacgggttaaacccggttccgtaaaccggtacgtttagaccggggtaccggttaccgggtagggggaaccccgtaaggggaccccgttaaccggg

SEQ ID NO: 177911 - DNA, 650 bp, Homo sapiens
  misc_feature: GYAE6OF02GFQ98.11.12.B01.1.454.CMB.1.raw
  modified_base (486)..(486): a, c, t, g, unknown or other
  misc_feature (486)..(486): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttccaccgtcagtcaccacctacatgtaggttcgggtcccgccgaggcctccggaaggggaaggggcgtggggaggtgggtccttccttttattacgagcgtagtggtagtacatacttccgctacgactccggtgggacggggccctattaccacctactcctaccgagaacgaacctaactactaaagaaccacgtcttagtttacctaacaaatcgaaacncgtcctaggacgacgccgaatcggaaccgaccgggtcgttagttaacttctcggtgacgaagaggtacggtccggggaaccccaacggtaaccgtttaccgtaaccgtgttacggtcgggtaaccggttccgggtacgggggaacccgaacgggggtaaccccg

SEQ ID NO: 177912 - DNA, 615 bp, Homo sapiens
  misc_feature: GYAE6OF02IXOBI.11.12.B01.1.454.CMB.1.raw
  modified_base (296)..(296): a, c, t, g, unknown or other
  misc_feature (296)..(296): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccncaggctccgagggacgggctggagtgggtcttcctttattacagctaggtggtagtacattacttccgactagacgtcgtggacggggtccattccacctatctccgagacaccaactactaaacgaacncgtacttgtttacctacaaagttgaaacncgcctagaacgacgaccgtatcgaaccgtaccgggtccgttagttacttacgtgtcggacgtagagtacggtccgggggaccctaaggtaaaccgtttaccgaacgtcttaacggtcgggtaaccgttccgggtcggggaacccgtaacggggtaacccg

SEQ ID NO: 177913 - DNA, 620 bp, Homo sapiens
  misc_feature: GYAE6OF02FZ4YW.11.12.B01.1.454.CMB.1.raw
  modified_base (465)..(465): a, c, t, g, unknown or other
  misc_feature (465)..(465): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaaggggctgggagtgggtctctttattacagcagtggtagtacatattcgcagactccggtggaggggccgattccacctactctaccagacgacaactctaaagaaccacgcttagtttactacaaattcgaacacgcctagacgacgccgancgaaccgaccgggtccgttagttaacttacgtgtcgacgaaggtacgtacggtccgggggacccctaaccggtaaaccggtttacccgaccggtaccttacggtacgggtaaccggttccgggttcggggggacccgtaacgggggtaaccccgg

SEQ ID NO: 177914 - DNA, 670 bp, Homo sapiens
  misc_feature: GYAE6OF02I2BCU.11.12.B01.1.454.CMB.1.raw
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcacgcctcgtgggttcacccgtcagtccaccacctacatgagttcggggtcccnccgaggcctccgaaggggacggggctgggaggtcgggtcttccttttattacngtcaggtggtatacatattccgacagactcggtggacggggctatcaacctntctcaagtacgaacaacnctaaaagacaacgtccttagttttcctaactaaagtacgaaacgtcgtacctaggaacgtacggacgtaatacgaaccggaccgggtccgttagttactttacgtacggtagggtcgaagtagtagggttcccggggaacccgtaacccggttaaacggttaacccgtaaccgtacttaacgggtaccggggtaacccggtttcgggtaacgggggtaaccccggaacgggtaacccccggg

SEQ ID NO: 177915 - DNA, 595 bp, Homo sapiens
  misc_feature: GYAE6OF02FXF7S.11.12.B01.1.454.CMB.1.raw
  modified_base (273)..(273): a, c, t, g, unknown or other
  misc_feature (273)..(273): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgacgactctcctgtgcagcctcgtgggttcaccgtnagtcacacctacatgtagttcgggtccgccaggctccgaggggaaggggctgggagtcgggtcttcctttattacngcagtgtagtacattactccgnagctcgtggacgggcattcactatctcagacgacaactctaaagaccacggtcttcgttttactacgtaaaatcgaaacgcgtcctaggaaggtaccgccgtaagtacgacctaccgggtccttaagttacttacgtgtcgacgagtacgacggtcgggaaccccaaggttaaccgtaccacgtgtagtcgggtaccgtcgacggggtacccaagggtaccccg

SEQ ID NO: 177916 - DNA, 671 bp, Homo sapiens
  misc_feature: GYAE6OF02FZUH7.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtggttccaccgtcacgtcacacctacatggaggttcgggtccgccgaggcctccgaaggggagggcgtgggagtcgggtcttctttattacagctagtggtagtacattacgttccgcacgacctccggtagggacggggccgtacttccgaccctattcctccgaaggacgtaaacctaacttacgtaaaacgaaccgtaccgtctttgttttaccttaacgtaaagttcgaaaaccgtcgtaccctagggaacgaccgtacccgtaagtaccggaacgtacccggtccgttagttaacgttacgtggtacgacgggtagacggacggtcccggggaaccctaaaccggttaacgttaccacgtacgtaacggtcgggtaaccgtcgggtacggggaccgtaacgggacccg

SEQ ID NO: 177917 - DNA, 752 bp, Homo sapiens
  misc_feature: GYAE6OF02JDDN6.11.12.B01.1.454.CMB.1.raw
  modified_base (608)..(608): a, c, t, g, unknown or other
  misc_feature (608)..(608): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagacctctcctgtgcagcctcgtgggttccaccgtcacgtccaccacctacatggtaggttcgggcccgaccgacggcctaccggagggggaacggggcgtgggaggttcggggttccttaccgttttaagtttacgaggacgtaggttacgggtacgtactacttacgttccgacgtacgtacccgttccgggtagggacgggggtccctacgttacccaccctagttccctaccgaagaacgaaccaacttacgtaaaacgacctaccgtcttacgttttacctaacaaagttacgaacctacgtccgtaggacggacgacccgtataccggaacccgtaccgggtaccgttagttaacttttaccggnggttacgacggtaacggtaggtaccgggtaccgggggtaaccccctaaacgggtttaacccgtttaaccgtaaccggtaccgttaacggtaccggggttaccggttccgggtaccggggggtaacccaacgggggtaacccccg

SEQ ID NO: 177918 - DNA, 841 bp, Homo sapiens
  misc_feature: GYAE6OF02H02BN.11.12.B01.1.454.CMB.1.raw
  modified_base (713)..(713): a, c, t, g, unknown or other
  misc_feature (713)..(713): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggtttttccttgttgctattttaaaaggagtccagtgtgaggtgcgtctggtggagtctggaggaggcctgatccagccgtggggggtccctgacgactcctctgtgcacgcctcgtcggttccaccgtcacgtccaaccacctacagtggtagggttcgggtcccgcccgacggtccgtaccggaagggggggaacggggtccggtaggggtacgggttccggggtttacccgtttacccgttttttaagtttaaccgacggtaccgtaggggttacggtaacgttaacctaacgttaaccgtttcccggaacgtacgggtacccgttaccgggtacggggtaaccgggggtacccgtacgtttacccgaacccgtaaccgttacccgtacccgaaaggtaacccgtaaaccttaaaccttaccgtaaaaaccggaaacccgtaaccggtttcgtttacgttttttaacccgttaaacaaaaacgttaccggaaaacctacggtacccgttaagaacggtaccgaccgtaagtaccgaaccgtaccgggtcttaagttacttacgnggtacgacggaagtacgggtaggtaccccggggtaaccccgaaaggttaaccgttaacgtaccggtacgttaacggtccggggtaaccgttaccggggtaccgggtaacccggaacggggtaaccccg

SEQ ID NO: 177919 - DNA, 631 bp, Homo sapiens
  misc_feature: GYAE6OF02ICVXV.11.12.B01.1.454.CMB.1.raw
  modified_base (288)..(288): a, c, t, g, unknown or other
  misc_feature (288)..(288): n is a, c, g, or t
  modified_base (453)..(453): a, c, t, g, unknown or other
  misc_feature (453)..(453): n is a, c, g, or t
tcagcgagagataccacgaccggtgctcgatttagtagtgtagattgggtctgggagaggagcccagcactgggattccgaggtgtttccattcggtgatcagcactgaacacagaggactcaccatggagttttggctgagctgggttttccttgttgtctatttaaaaggagtccagtgtgaggtgcgtctggtggagtcgtggaggaggcctgatccagccgtgggggtccctgagactctcctgtgcacgcctcgtcgggttccacgtccagtcaccacctacntgagttcggtccgaccaggcctccgaggggaagggcgtggtagtcgggtccttcgtttatttacagctaggtgtagtacatactccgcagtactcgaggacggggcctattccacatctccgaagacaactaactactaaagaacgacgtacttgtttacctaanaaagttcgaaacacgtccttaggaacgacggtaccgtagtaccggaaccgtaccgggtaccgttagttaacttacgtgtacgacggaagtaggtaccggtcggggaaccctaacggtaaccgttaacgtaccgtgtaacgtcgggtaccgttcggtacggggacccagggtaaccccg

SEQ ID NO: 177920 - DNA, 611 bp, Homo sapiens
  misc_feature: GYAE6OF02G8EYE.11.12.B01.1.454.CMB.1.raw
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcgtggtttcgtgtagctatttaaagagtcagtgtgaggtgcgtntggtgagtctggaggnggcctgatccagcgtgggggtccngacgctctcngtgcagcctntggttacacgtngtcactcctagagtgaggttcggccgccgaggtcgtaccgaaggggtacgggctaggnggttcgggtcttaactttnttacgagcgtagtcggtanacagttactcgcaagtcgtcgtaggacgggtcctagttaccactacgtctacgagtacgactaacgtcgtaaacgacgacgtnttacttactacgtaaagnaaaccgtncgtagacgagtacgactacggacgtacgtacgttagttacttaccggtgacgacgagtacggaccgtacgggtaaccctaggttaaccgttacgtaacgtacgttacggacggttaccggtacgggtacggaccggtacgtacccgg

SEQ ID NO: 177921 - DNA, 597 bp, Homo sapiens
  misc_feature: GYAE6OF02GVNJE.11.12.B01.1.454.CMB.1.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
tcagcgagagataccacgaccggtgctcgatttagtagtgtagatttgggtcgtgggagaggagcccagcactgggattccgaggtgtttccattcggtgatcagcactgaacacagaggactcaccatggagttttggctgagctgggttttccttgttgctattttaaaaggagtccagtgtgaggtgcgtctggtgagtctggaggaggcctgatccagcctggggggtccctgagactctcctgtgcagcctgtgggttcaccgtnagtcacacctacatgagttgggtccnccaggctccgagggaagggctggagttgggtcttctttatttacagcagtggtatacatattccgcagactccgtagacggggccattcacctatcctccaagtacgacaaactcgtaaagaacctacgtcttgtttacttccgaaaattcgaacaggtccctaggagtacgcccgatcgaacctacgggccgtagttaacttacgtgtacgcgagacgcggtacggggccctaaggtaaccgttacctacgccttaacggtacgggaccgttcgggacgggacccgaaggggtaccccgg

SEQ ID NO: 177922 - DNA, 554 bp, Homo sapiens
  misc_feature: GYAE6OF02HFIC8.11.12.B01.1.454.CMB.1.raw
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttggtccgccgaggctccgagggagggctggagtggtctctttattacagcagtggtatacatacttcgcagactcgtgaggggccagttcacctntcctccaganaccaactactaagaacacgctgtttctacaatgaactgacctgacgagcccgatacgacgacggtccgtagttacttaactgtagacgagagtagtcggggcccaacggtaacgtacgtaccgtactagtcggacgttccgacggggacctaagggaacccg

SEQ ID NO: 177923 - DNA, 735 bp, Homo sapiens
  misc_feature: GYAE6OF02HO2F6.11.12.B01.1.454.CMB.1.raw
  modified_base (302)..(302): a, c, t, g, unknown or other
  misc_feature (302)..(302): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccaatggagttttggctgagctgggtttccttgttgctattttaaaaggagtccagtgtgaggtgcgtctggtggagtctggaggaggcctgatccacgccgtgggggtccctgacgactcctcctgtgcagcctgtgggttcaccgttcagtcacacctactatgagttgggtcccnccgaggctaccgagggtaagggctgggagtcgggtcttaccgttttattaccgagtcaggttggtagtaacgtattactttaccgacgacgtactcccggtaggacggggtccgtaagttccgacccctaagtccgttaccgaaggaacgtaccaaaaccttcgtaaaacgaccggtaccgtactttcggttttacctacgtaaaacttcgggaaaccacggttccctaggtaacgggaaccacggtaacgttaccggaaccgaccggtaccgttagtttaacttaacggtttcgacggaccggttaaggacggtaaccggtttcgggggaacccccgtaacgggttaaacccggtttaacccggaacgtcccgttaaacggcgggttaacccgtttaccggggacggggttacccgaaacgggttaccccgg

SEQ ID NO: 177924 - DNA, 595 bp, Homo sapiens
  misc_feature: GYAE6OF02I4NPZ.11.12.B01.1.454.CMB.1.raw
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctcgtgggttcaccgtcagtcacacctacatgagttgggccgccaggctccgaggggaagggctggagtgggtctcctttatttacagcagtggtagtacatattccgctagactccggtgacggggccattccacatctcagagacaactcaaagacacgctgtttctanaaatgaacngacctgagacgacccgatacgaccgacgggcccttagtaactttccgtggtacgacggaagtaggacgtacgggggaccccaacggtaaccggtttaccaaccggtcttaacgccggggtaccgttccgggtacgggggacccgaacgggggtaacccccg

SEQ ID NO: 177925 - DNA, 679 bp, Homo sapiens
  misc_feature: GYAE6OF02HGYPD.11.12.B01.1.454.CMB.1.raw
  modified_base (516)..(516): a, c, t, g, unknown or other
  misc_feature (516)..(516): n is a, c, g, or t
tcagcgagagataccacgaccggtgctcgatttagtagtgtagatttgggtctgggagaggagcccagcactgggattccgaggtgtttccattggtgatcagcactgaacacagaggactcaccatggagttttggctgagctgggttttccttgttgctattttaaaaggagtccagtgtgaggtgcgtctggtggagtctggaggaggcctgatccagccgtggggggtccctgacgactctcctgtgcacgtcctcgtcgggttccaccgtcagtccaccacctacatggtacggtttcgggtcccgccgagggtcctaccggaaggggggaacggggcgtaggggtaggttcgggttcctttccgttttaatttacgagtcgtaggttggttaagtaactattactttccgcagtacctccggtgggacggggcctacttccaacctactccgtaccagaacgaactaactactaaacgaccacgtctttacgttcctacaaatcgaaacncgtccgtagacggtcggacctagtaccggaccgtaccgggtccgttagttaacttacgtgtcggagtaggaggtacggtcccggggaccctaacggtaaccttacgtaccggattaacggtcgggtaaccggtcgggtaccggggaccgaaccggggtacccg

SEQ ID NO: 177926 - DNA, 569 bp, Homo sapiens
  misc_feature: GYAE6OF02F5ATV.11.12.B01.1.454.CMB.1.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (438)..(438): a, c, t, g, unknown or other
  misc_feature (438)..(438): n is a, c, g, or t
tcagcgagagataccacgaccggtgctcgatttagtagtgtagatttgggtctgggagaggagcccagcactgggattccaaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtnagtcacacctacatgagttcgggtccnccaggcctaccgaggggaacggggctgggagtgggtctcctttattacagcagtggtagtacatacttcgcagcctcggtgacggggcctagttcatcgatctccagacgacaactctaaagacacgtcttacgttcctanaaattgaacagcctagacgacgccgaatcggaccacggccgttgtaacttcgtgtcgacgagtaggcgtcggggaccctaggtaaccgttacgcgtactacggtggaccttcgggacgggaccgtaacggg

SEQ ID NO: 177927 - DNA, 751 bp, Homo sapiens
  misc_feature: GYAE6OF02GBQZ0.11.12.B01.1.454.CMB.1.raw
  modified_base (384)..(384): a, c, t, g, unknown or other
  misc_feature (384)..(384): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagtttggctgagcgtggttttcttgttgtctaattttaaaaggtagtccagtgtgaggtgcgtctggtggagtcgtggaggaggcctggatccgagccgtgggggtccctgacgactctccgtgtgcacgtcctcgtcgggttccaccgtcgagtccaacgtacctacgtagtcggtaggttcgggtcccgccaggtccgtccggaggggtacgggcgtggacggttcgggtcctttccgttttaagttacgnggtcgtaggttggtaacgttactaagttacgttcccgcggtaacgtaccgttccgggtagggacggggtacccgtagtttacccgacgtaacgtccgtcccgaaagtaaccggaacctaaacgttaccgtaaaacgtaaccgacgtttacgttccgttttaacctaaaccgtaaagttaacgaaccgtacgtcccgtaaggacgtacgacccgtagacgtaccgaccgggtcgttaacgtttagtacccgttggtacggacgtaagtaccggaggtttacccgggaaccctaaacggttacggttacctaacggtcgttaacggtccggtaaaccggtgacccgggggtaactaccgggtaacccgg

SEQ ID NO: 177928 - DNA, 784 bp, Homo sapiens
  misc_feature: GYAE6OF02JV8ZI.11.12.B01.1.454.CMB.1.raw
  modified_base (447)..(447): a, c, t, g, unknown or other
  misc_feature (447)..(447): n is a, c, g, or t
  modified_base (730)..(730): a, c, t, g, unknown or other
  misc_feature (730)..(730): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcgttgggttttccgttgttgtcttaattttaaaaggtagtcctagtgtgaggtgcgtcgtggtggtagtcgtggaggaggctgactccagccgtgggggtccctgacgtctctcctgtgcagcctcgtggttcaccgtcagtcacctaccgtacactggtaggttcgggtacccgtaccgacggtccgtaccggaaggggggtaacgggtccggtaggggtacggttcggggttcctttaccgttttaacgtttaacgacgtacgttacggtacgggttaagtaactagttaccgtttaccggngttaacgtaccccggttcgggttaacgggcgggggtccgtaaacttaccgacccgtacttcccgtacgaaggtaacgacctaaaaccttccgaaaagaaccgtaacgtccgtttatttccgttaaaccaaaagttcgaaaccttacgaccgttaaggacggaaacgccgtaataccggtaaacctccggggttactacgtttaattccgtaggtacgacgggtaaggaacgttacgggtaccggggaaccccttaaacgggttaaccgttaccgaaccggttnttaaccggggtcggtaccggttacgggtacccgggggaacctacggacccccgg

SEQ ID NO: 177929 - DNA, 608 bp, Homo sapiens
  misc_feature: GYAE6OF02FSX2Y.11.12.B01.1.454.CMB.1.raw
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctgggtggagtctggaggaggcctgatccagccgtggggggtccctgagactctcctgtgcagcctcgtgggttcaccgtcagtcacacctacatgaggttgggtccgccgaggctccgagggaagggctggagtgggtctctttatttanagcagtgtagtacatacttccgnagactcgtgacggggcctattccaccatcctaccgagacacaactacgtaaagaaccacggtcttcggtttacctactaaatgaaaccagccctagagacgccgaatggaccaccgggtccgttagttaacttaccggtgtcggacgaggtagacggtacggggtaccccaaggtaaacccggtttactaccgacgttacgtcgggaaccgttccgacgggggtacccaacggggtaccccg

SEQ ID NO: 177930 - DNA, 594 bp, Homo sapiens
  misc_feature: GYAE6OF02HLZ9Y.11.12.B01.1.454.CMB.1.raw
tcagcgagagataccacgaccggtgctcgatttagtagtgtagatttgggtctggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccagggcctccgaggggaacgggctggaggtgggtcttcctttatttacgagtctagtggtagtacatattccgcagtactccggtgacgggggtcctacttcaccgattcctccgaagacgacaactctaaagaactcgtcttagtttcttacaaatcgaacctagcctgagcgactatgacgaccggtctgtaacttgtcgtagcgtagaggtacgtacggggccctaacgggtaaccgttactacggtcttagtcgggaccgtttcggaccggggtacaacgggtacccgg

SEQ ID NO: 177931 - DNA, 788 bp, Homo sapiens
  misc_feature: GYAE6OF02HD4NC.11.12.B01.1.454.CMB.1.raw
  modified_base (282)..(282): a, c, t, g, unknown or other
  misc_feature (282)..(282): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagtttggctgagctgggttttccttgttgctaatttaaaaggagtccagtgtgaggtgcgtctggtggagtcgtggaggaggctgatccagccgtgggggtccctgagactctcctgtgcagcctcgtcggttccacgtcagtcacacctanatggtagttcggtccgccaggcctaccgagggacgggtctgggaggtcggttccttacctttagttacgagtcgtaggtggtactactattaacgttccgactacggtacccgtgggacgggaccggtacttaccgacctactaccgtaccgtacgaacgtaccgaaacgtaccgtaaagaacccgtaacgtaccgtttaccgttactttaaacccgtaaaagtaccgtaaacgtaaccgtccggttagaaacgtaaccggggacctaacgtaccgggaaccctacccggggtaccgttacggtttaacgttaaccggtttacgcgggttaaccgggaacgttaacggggttaccgggtacccggggttaaccccgggaaaccccggttaaaacggttttacccgttaaaccggtaacccggttttaggtaacccggggtacggggttaacccgggttaccggggggaaccgggttaaaccccgggaccggttaaaccccccgggg

SEQ ID NO: 177932 - DNA, 816 bp, Homo sapiens
  misc_feature: GYAE6OF02FLITN.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtgggggtccctgagactctcctgtgcagcctcgtgggttcaccgtcagtcacacctacatgaggttcgggtcccgccgaggcctaccggagggggaacggggcgtggggacggttcggggttccttacctttttaagtttaccgaggtactaaggttagggttaacgttaacctaagttacgtttcccggacgtaacggtacccttcccggggtaggggacgggggggtaccccgtaacgttttacccgaaaccccgttacgttacccgttaccccgaaagggtaacccgtaaaaccctaaaaccgtttacccgtaaaaaacgaaacccgtaaccgggttcctttacggttttttacccttaactaaaagttaacgaaaccctacggacccgttaggaacgggtacggtacccgtagttacggaacccgtacggggtacccgttagtttaacgttacgttggtacggtaccgaaggtacggtacgggtccgggggaaccccctaaaggtaaacccggtttacctaaccggtacgttaaccggtcggggtaaccgttcgggtacccgggggaccctaacggggtaaccccg

SEQ ID NO: 177933 - DNA, 699 bp, Homo sapiens
  misc_feature: GYAE6OF02GSMNH.11.12.B01.1.454.CMB.1.raw
  modified_base (377)..(377): a, c, t, g, unknown or other
  misc_feature (377)..(377): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctgggtggagtcgtgggaggaggcctgatccgagccgtggggggtccctgagacctctctgtgcagcctgtgggttcaccgtcagtacacacctacatgtaggttcgggtcccgccgaggcctccggaggggaacgggctgggagtgggtcttctttattacagtcaggtgtatacatatccganagtcctcggtggacggggcctatccaaccacttcctaccgagaacgtaaacctaaacgttaccgtaaacgaaacctaccgtcgtttacggttttacccttaaacgaaaacgttacgaaacctacgtacccgttagaacggtacgacccgtaagttaccggaaccgtacgggtccgttaagttaactttacggcggttacgacggtaggtacggtacgggttacccgggggacccttaaacgggttaaaccgttaccgtaaccggtacttagggtaccgggtaccggtaccggtacgggggacccggtaacgggtaaccccgg

SEQ ID NO: 177934 - DNA, 704 bp, Homo sapiens
  misc_feature: GYAE6OF02IRDT9.11.12.B01.1.454.CMB.1.raw
  modified_base (303)..(303): a, c, t, g, unknown or other
  misc_feature (303)..(303): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtggttccaccgtcagtccacacctacatgagttgggtcccgaccnggtcctaccgagggggaacgggcgtgggacggttggggtaccttccgttttaattacgcgtacgtaggtggtacggtactattacttccggacagtacctcggtggacgggcgtactcgacctagtcctaccgagacgaactaacctactaaacggaaccacgtaccgtttacgtttacttaccgtaaaagttccgaaaacctcggacccttacggaggtaccgacccggtaagtccggaacccgaaccggggtccgttaacggttaactttaccggttgtacggaccgggaaggacggacgggttaccgggggaacccctaacgggttaaaccgtttcccgaacggtccttaggtaggtacccggttccgggacggggtaacccgaacgggtaacccggg

SEQ ID NO: 177935 - DNA, 809 bp, Homo sapiens
  misc_feature: GYAE6OF02HHXL5.11.12.B01.1.454.CMB.1.raw
  modified_base (260)..(260): a, c, t, g, unknown or other
  misc_feature (260)..(260): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagttttggctgagcttgggttttccttgttgctaatttaaaaggagtccagtgtgaggtgcgtctggtggagtctgggaggaggcctgactccgaggtccggtcgggggtccctgacgccttctcctgngcagtcctcgtggttccaccgtcacgtccaactacctacagtggtaggttcgggccccgcgacgggtcctacggaggggaacggggtcgtgggtacgggttcgggttccctttaccgtttttaattaccgaacggtcgtaggttaggtagtaacctagttacgttccgacacgtaccgtccgggtagggtaccgggtcctaaacgttccaaaccgtcttacctaaccgagtaaccgtaacctaaacgttaaccgaaaagaacccgtacggttctttacgtttaacccttagtaaaacgttacgaaacctaccggaccgtagaacggaccgtaccggtaacgtaccggaacccggtaccgggtaccggtttagtttaaacgtttaccggtggtaacggtaccggtaagggtacgggtaccgggtaacccgggggtaacccctaaacggggtttaaacccgtaacccggttaccggtacttaacggggttaccgggtacccgggttacccggggtaaaccgggggaccggtaaaccccgggggtaacccgg

SEQ ID NO: 177936 - DNA, 828 bp, Homo sapiens
  misc_feature: GYAE6OF02IF26W.11.12.B01.1.454.CMB.1.raw
  modified_base (239)..(239): a, c, t, g, unknown or other
  misc_feature (239)..(239): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtcgtggaggaggcctgatccagccgtgggggtcccngagactctcctgtgcacgcctcgttcggttccaccgtcagtccacctacctactagtggtacggttcgggtcccgcgacggcccgtaccgggaagggggtaacggggcgtaggggtacgggtttcgggtttaccctttcgttttttaacgttaacgacggtacgtagggttacgggttaacgtaaccgttaacgttacgtttccccggaccgttaacgtaccccggtttccggtacggggtacgggggacccttacgtttacccaaccctacgtttccctaccgaacggacgtaaaccctaaacgtaacctaaaacgaaccctacggttaccgtttacgtttaccctttaaagtaaaaccgttaacgtaaccgtaccggtaccgtaaggaacgtacccgggaaccgttaagtaacccgggaccgtacccggggtaccgtttaaggtttaaccgttacggtacgtcgggaacgggtagacgggttaccggggtacccgggtaacccctaacgggtaaaccgttaccgtaaccgtacgtacggtacggtacccggttccgggaaccgggtacccggaaacgggtaccccgg

SEQ ID NO: 177937 - DNA, 637 bp, Homo sapiens
  misc_feature: GYAE6OF02IIHHZ.11.12.B01.1.454.CMB.1.raw
tcagcgagagataccacgaccggtgctcgatttagtagtgtagatttgggtctgggaggaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgacgactctcctgtgcagcctcgtggttcaccgtcgagtcacacctacatgagttcggtccgccaggcctccggaggggaaggggccgtgggacggtcgggtccttccttttaatttacgagccaggttgtagtacatattccgcacgactccggtggacggggcctacttaccaccattccctacgaacgacgaaccaacctactaaaacgaactacgctttacggtttacctttacaaagttgaaaccgtcgacccgttgaacggacgccgaagtcggaacctacggggtcccttagtactttaacgtcggtagaccgtaaggcgtaaggccggggccctaacggtaacgttacaccgtatacgtggtaccgtcggtaggggaccccaagggtccccg

SEQ ID NO: 177938 - DNA, 726 bp, Homo sapiens
  misc_feature: GYAE6OF02INPRP.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactcctcctgtgcacgcctcgtgggttccaccgtcacgtctaaccacctacagtgtaggttcgggtcccgccgacgggcctaccggaagggggaaggggcgtgggtaggttcgggttccttaccgttttaatttaccgagtcgtagttggtaagtactagttaactttccgacgtagaccgttccgggtaggacggggcctaagttccaacctactccgtaccaagacgaacctaaactacgaaacgaactaccggtcttaggttttactaactaaaagtcgtaaaccacgttaccgaggaacgtaaccggccgttaaagtaccggaccgtaaccggggtccgttagttaacgtttaccgtggtacggacgaagggtacgaaggtcccggggtaaccctaaacggtaaccgtttaacggtaacccgacgtttaacgggtacgggtaacccgttacgggtaccgggggacccgaaacgggggtacccc

SEQ ID NO: 177939 - DNA, 870 bp, Homo sapiens
  misc_feature: GYAE6OF02HKLRB.11.12.B01.1.454.CMB.1.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctatttaaaaggagtccagtgtgaggtgcgttctagggtggagtctgggaggaggccgtgatccagtccgtggggggtccctgacgactctcctgtgcngcctcgtgggttccnccgtcagtccacaaccctacagtcggtagttcggggtccgtccgagggtccgtccggaagggggtaaggggtccgtacgggggtagggttcggggttacctttacccgtttttaagtttacctaggtcgtaagggttgggttaacgtaactaagttacgtttcccgactaacgtacccgttccggtagggacggggtacccgtacttccgaacctacgtcccgttaaccgaaggtaccggaaacccttaaacgttaccgtaaaaccggaaaccctaccggtttacctttcggtttttaaaccccttaacgttaaaacgttaccggtaaaccgtacccggtccgtttaaacgggaaccggtaaccgggtacccggtaacgtacgggaaacccggtacccggggttccggttaacgtttaccgggtttttaaacccggtacgggtccgggttaacggaaccgggttacggttaggggtttaccccggggaccccgttaaacgggtaacccgttttaacccgtaccgggttaatttacggggtacccggttacggggttaaccgggacccgggggttaaccggaacccggggtacccgg

SEQ ID NO: 177940 - DNA, 632 bp, Homo sapiens
  misc_feature: GYAE6OF02I15ZB.11.12.B01.1.454.CMB.1.raw
  modified_base (191)..(191): a, c, t, g, unknown or other
  misc_feature (191)..(191): n is a, c, g, or t
  modified_base (210)..(210): a, c, t, g, unknown or other
  misc_feature (210)..(210): n is a, c, g, or t
  modified_base (258)..(258): a, c, t, g, unknown or other
  misc_feature (258)..(258): n is a, c, g, or t
  modified_base (380)..(380): a, c, t, g, unknown or other
  misc_feature (380)..(380): n is a, c, g, or t
  modified_base (465)..(465): a, c, t, g, unknown or other
  misc_feature (465)..(465): n is a, c, g, or t
  modified_base (500)..(500): a, c, t, g, unknown or other
  misc_feature (500)..(500): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagtttggctgagcttgggtttccttgttgctaatttaaaggagtccagtgtgaggtgcgtntggtaggagtcgtggaggngcctgactcgagtcgtcggggggtccctaggacgtactcgtcctggtncgagccgtgtacgggttcaccgtcgacgtcaccgacctacagtgtagtcggtccgtcgaggcctccgagggaacggcgtggaggtcggtcttcgtttaacttacgagtcgtaggtacggtanactagtacttcgacgtacgacgtcgtagggacggccgtattaccactactctaccaggataccgaactaccgtaaggtacacgtnttacggttcaacgtaaattcaaacgactcgagaanacgtcgaatccggacctaggtccgtgttaacttcgtaggtcgacgtaaggcgtcgggaccggtacccggaacgtacgtttaaccgcgtacgtacgtcggaccggtaccggtaggacccggaaggtaccccgg

SEQ ID NO: 177941 - DNA, 629 bp, Homo sapiens
  misc_feature: GYAE6OF02FUIOU.11.12.B01.1.454.CMB.1.raw
  modified_base (420)..(420): a, c, t, g, unknown or other
  misc_feature (420)..(420): n is a, c, g, or t
  modified_base (451)..(451): a, c, t, g, unknown or other
  misc_feature (451)..(451): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctatttaaaggatccagtgtgaggtgcgtcgtggtggagttctggaggaggcctgatccaggtccgtggggggtccctgacgctctcctgtgcagtcctgtggttccaccgtcgacgtcacacctagatgacgttcggccgcgagctcgagggacggctggagtggcttcttattcagcgtgtaggtatagattacgtcgatacgacgtcggtggacgggtctagtccactatcctcgagtacgactaactcgaaagacncgtagttcgtttactaacgtaatacgaaccntacgtcgagtaccgcgaatacgggctaacgggtccgttaagttacgttagtcgggtgaacggtgtacgggtacgacccggggtaccctaaaccggttaacgttacccgttaacgagtttaaccggggtagtaaccgttccgggggaacccgggttaccggtacccggggtaaccccgg

SEQ ID NO: 177942 - DNA, 812 bp, Homo sapiens
  misc_feature: GYAE6OF02JNE1Z.11.12.B01.1.454.CMB.1.raw
  modified_base (244)..(244): a, c, t, g, unknown or other
  misc_feature (244)..(244): n is a, c, g, or t
  modified_base (761)..(761): a, c, t, g, unknown or other
  misc_feature (761)..(761): n is a, c, g, or t
  modified_base (769)..(769): a, c, t, g, unknown or other
  misc_feature (769)..(769): n is a, c, g, or t
tcagcgagagataccacgaccggtgctcgatttagtagtgtagattcgacggggctcgccctttggctttggagatggttttctcgatgagctctgggagaggagcccagcactagaagtcggcggttgtttccattcggtgatcagcactgaacacagaggacctcaaccagtgggtaggtttgggctaggacgtcgttgggttttcctcgttgtaccttacgttttaaggaggttgtaccgnggttcgtcgtaagggtcgtactaacggtgggttacggaggttcggtaggggggtacgggtaccggttcgggtacccgacggtccggttagggggtaaccgggttcccctagggtaccgtaaccgttcgttccgttacggttggaccgacggtcggtttcgtaggttacctttaccgtacccttaggaaggtacgtcgtaagtacgaacctagttacgaccgttaacggtccgggtcccgacggaccggtccgttaccgacgggtaaccgggtaacgggcggtaacggggtacggtacgggggtacgtacggtttaaagttacgggtaaggttacggggtttaacgaacggttagggttaaagggttaaacgttaaacgtttaaaacggttataagggtaggtaacggttaccggttaaggtccgggtaacgggtacgtacttactaccgtagtcacgtagacgtacttacgtaacgtacaaccggtcgtagtatacgagttaacggaatacggtaancggtaacncggtacgaacggtcgaccggtagtaccggttagttacgtaacg

SEQ ID NO: 177943 - DNA, 865 bp, Homo sapiens
  misc_feature: GYAE6OF02JP93V.11.12.B01.1.454.CMB.1.raw
  modified_base (214)..(214): a, c, t, g, unknown or other
  misc_feature (214)..(214): n is a, c, g, or t
tcagcgagagataccacgaccggtgctcgatttagtagtgtagatttgggtctgggagaggagcccgagcactgggattccgaggtgttccattcggtgatcagcactgaacacagaggactcaccatggagttttggctgagctgggttttccttgttgcttatttaaaggagtcctagtgtgaggtgcgtcgtgggtggagtcgttggaggnggcctgatccgagtccgtgggggtccctgacgactctcctgtgcagtcctcgtggttcaccgtcagtccgactaccctacgactgtacgttcggggtcccaccggacggtcgtccggtaacgggggaacggggtcgtacggggtaacggttcgggggttcctttaccggttttacgtttaacgacgggtcgtaaggtgggttaaccggttaactaagttaccgttacccggtacgtaacggtacccggttaccggttgggggaacgggggtccccttaacggtttaccccaaccggttaacgttccccgtaacccgtaaggtaccggtaaacccttaaaccggttaaccgtaaaccgggtaaaccctaccgggttaccgtttacggtttttaaccttaccgaaaaactttccggggaaaccttaccgtacgttaacggttaaccggaaccgggtcccggttaaaacgccggtaaccggtaacccgggtacggttaactttaacgttaccggtaggttaccggacgtaagggttacaacggggtttccgggaacccgaaaccgggttttaaaccgtccgttaaacccgtcgtaacgggttaccggacccggttttaaccgggaccggggttaccgaacggggttaaccccgg

SEQ ID NO: 177944 - DNA, 574 bp, Homo sapiens
  misc_feature: GYAE6OF02I5O6G.11.12.B01.1.454.CMB.1.raw
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (439)..(439): a, c, t, g, unknown or other
  misc_feature (439)..(439): n is a, c, g, or t
tcagcgagagataccacgaccggtgctcgatttagtagtgtagatttgggtcgtgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgacgactctcctgtgcagcctcgtggttcaccgtcagtcacactantgagttggtccncaggcctcgagggagggctggagtgggtctccttattacagcagtggtagactatacttcgcagtactcgtggagggcctatccacatctccagacgacaactcaagacacgtcttgttctactaaatcgtaacagcctagancgaccgatcgacgacgggtccttagttacgttacgtgtacgacgtaagaggtacggtcggggtaaccctaacggaaccgtttacacgggttactaacgtggtacccggtcggacggggtacccgaagggtacccg

SEQ ID NO: 177945 - DNA, 649 bp, Homo sapiens
  misc_feature: GYAE6OF02JJOTU.11.12.B01.1.454.CMB.1.raw
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggtttttccttgttgctattttaaaaggagtccagtgtgaggtgcgtctggtggagtctggaggaggcctggatccagccgtggggggtccctgacgactctcctgtgcagcctgtgggttcaccgtnagtcaacncctacntgtagttcgggtcccncgaggcctccgaggggaacgggctgggaggtgggtcttaccgttttaatttacgacgtcgtaggttggtaagtactagttacgtttccgactacggtacctccggtagggacggggggtccctaatttcccgaacctagttcctaccgaacgaacgtacaaacttacgtaaacgaacacgtcgtttacgtttaccttacaaagtacgaacacgacctaggacgacgccgagtcgacgtaccggtacgttagttacttacgtgtcgtgagtacgtaggccgggtaccaagtaaccggttacacgtacgtaggtacggaccgttcggcgggaccgaacgggtacccg

SEQ ID NO: 177946 - DNA, 633 bp, Homo sapiens
  misc_feature: GYAE6OF02F07WG.11.12.B01.1.454.CMB.1.raw
  modified_base (318)..(318): a, c, t, g, unknown or other
  misc_feature (318)..(318): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
  modified_base (504)..(504): a, c, t, g, unknown or other
  misc_feature (504)..(504): n is a, c, g, or t
  modified_base (522)..(522): a, c, t, g, unknown or other
  misc_feature (522)..(522): n is a, c, g, or t
tcagcgagagataccacgaccggtgctcgatttagtagtgtagatttgggttttccgttggttgctattttaaaagactccgtgagggccgattcaccatctccagagacaactctaagaacacgctgtttcttcaaatgaacagcctgagagccgatgacacggccgtgtattactgtgcgagagatcggggccacgaacgttactacgctatggacgtctggggccaagggaccacggtcaccgtctcctcacgtcctcaaccgtaacgggcccatccggtaccttccccgaggccgccctgccttcccgaggacnccgtaacctccgaagacgcacaggccggacccgtgggcctcggccgtagggtacaacgggaccttacgttaccggtactccgttccgtcggacttcggaacggtccggggtacttcgggaacgtaacgggccgaacgagttaacgngtctcgcncgaacactnaccggtntacgctaagtcgacgnagttcgtacgacgtcgtntacacgtatcacgacgtacgtcgtacgtcgtacgtcgtcgtacgtacgtacgtacgtacgtacgtactcgtacgtacgtcgtacgacgtacgtacgtacgtacgtacgtcg

SEQ ID NO: 177947 - DNA, 899 bp, Homo sapiens
  misc_feature: GYAE6OF02GMI1D.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgctaattttaaaggagtccagtgtgaggtgcgtctgggtggagtcgtgggaggcggcctgactccgagtccggtcggggggtccctgagacttcctccgtgtgcacgtcctcgtgggttccaccgtctagtccacctacctacatgtacgggtttcgggccgccgaggtccgtaccggaggggaacggggcgtgggtacggttcgggttcctttccttttagtttacgacggtacgtaggttaggtaacgtacgtaacttacgtttaccccggacgtaaccgtacccggttacgggtacggggtaaccggggggtccccgttaactttacccgaaacccgttaatttcccccgttaacccggaaagggtaacccggtaaaaccctaaacccgtttaaccgttaaaaaccgggtaaacccgtaccgggtttacccttttacggttttacccttaaaacggttaaaacgttaaccggaaaaccgtaccgggttacccggttaacggaacggtaaccggtacgtaacggttacggaaccgggttacccgggtaccgtttaacggtttaacgtttaccggttacggtccgggtaaccggaggtacgggttaccgggttaccgggggaaccccttaaaaccggggtttaacccggttaaccgttaccgggttacgttacgggttacgggttaacccgggttacgggtaacccgggggttacccggaaaccgggtaacccccggg

SEQ ID NO: 177948 - DNA, 874 bp, Homo sapiens
  misc_feature: GYAE6OF02I3JQJ.11.12.B01.1.454.CMB.1.raw
  modified_base (739)..(739): a, c, t, g, unknown or other
  misc_feature (739)..(739): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagttttggctgagtcgttgggttttccttgttgtacgttaattttaaaaggacgtccagtgtgaggtgcgttcgtggtggagtcgtggaggacggcctgactccgagtccggttcgggggtccctggacgtacctctcccgtggtcgcgacgtcccttcgttcggggtttcccaaccgttcgacgttacccaaccctaccctaaccgattgggtaacggtttcggggtccccgacccggtaagggtcccgttaccggaaaggggggaagggggtccggtaggggtaacgggttcgggtttacccgtttaccgtttttaacgtttaaccgacgtacgtaagggttacggtaacggttacctaacgtttaccgtacccgacgtaacgtcccgttaccgggtacgggaccggggtacccgtattacccgaacctacgtcccgtaacccgagaaaccgtaacctaaaccgtaccgtaaaagtacccgtaacgtccgttagtttttacccaaacgttaaacgtaacgaaccgtaaccgttccgaagtaacggacgtaccggtaaacgtccggtaaccgaccgggttccgttaacgttaacgtttaaacccggnggttacccgaagggtaccgtaagggtccggacccggggtcccttaaaaaccggttaccgtttaaccgaccggttaccgttaacggacgggttaaccgttcccggggaacgggtaacccggaacgggtacccccgg

SEQ ID NO: 177949 - DNA, 884 bp, Homo sapiens
  misc_feature: GYAE6OF02FMINB.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagtcgttgggttttccttgttgcttaagttttaaaaggagtccagttgtggaggtgtcgtcgtaggtgggtagtcgtgggagggacggtccgtagactccacggtcccggttcgggggggtaccctggacgtacctccgttccgtggtcgccgacgtccttcggttcggttaccgcccgttactacgtaccaacctaaccctacgtagtacggttaggttccggggtcccgaccggtacgggtaccgtaccgggaagggggtaacgggtccggtaggggtaggttcgggtttacctttaacccgttttaagtttaccggacgtacgtaggttaggtaacgttactaacgttaccggtcccgacggtacgttacccggtacccgggttaggggtaacccggggtaccttacgttacccgaaccttaaccgtccgtaaccggtaacggaacgtaaccctaaccgttaaaccgtaaaacggacccggttaaccgttcccggttttaattttacccgtaaagttaaaccgtaaaccggtacgtaaccggtccggttaacgacggtaccggtacgtaccgttaacggacccggtaccgggttaccgtttattaccgttacggtgtacgggtagaacggtacggtaccgggtaccccgggtaaccgtaaaccggttaacccgttaccggtaccgtacggttaggtccgggtacggtacggggtacccgggacgggtaaccgtacccggg

SEQ ID NO: 177950 - DNA, 706 bp, Homo sapiens
  misc_feature: GYAE6OF02FI0E7.11.12.B01.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
tcagcgagagataccacgaccggtgctcgatttagtagtgtagattcggcggggctgccctttggctttggagatggttttctcgatgagctctgggagaggagcccagcactagaagtcggcggtgtttccattcggtgatcagcactgaacacagagactcaccatggagtttgggctgagctcgggtttcctcgttgctcttttaagaggtntcagtgtnaggtgcaacgtggtcggagtcgtggggacgcgtggccagcctgggacggtccctggagacctcctcgtgtcgcgagccgtactggacttacgaccttcgaggacgtacttatggtaaccagtgccaacgttcggggtcccgaccaggccctaccgaggccgtaacggggctacggggaggtcggggtagccgtaagtttaacgtacggttaggttacgttagacggttgggtaaaagttttaaacttaaaacgttaccttaggttagggacgtacgttacccggtagggaacgggtccgtaacgttacctaaccgtacttaccgtaccgaagtacggaccctaacgttacccgaaacgaaccgtaggtttacacgttacgtacgaacctaaacggtaaccgtaacgtacggtaacccgttaggaaacggtaaccgggaaccggaaccgggtaaccggaccgggttaccttagggttttaaccg

SEQ ID NO: 177951 - DNA, 910 bp, Homo sapiens
  misc_feature: GYAE6OF02HOL5P.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtcgggggtccctgacgactctccgtgtgcacgcctcgtgggttccacgtcagtcaaccactacatggtagttcgggtcccgccgacgggtcctaccggaagggggaacggggcgtgggacggttcggggttcctttaccgtttttaagtttaaccgaggtaccgtaagggttagggttaacggttaaccctagttaccgtttacccggaccacgggtaacccgttccgggttggggaaccggggggtacccgtaacgttttacccgaaacccccgtaagtttccccgttaaccgaagggtaaacctaaaccctaaaaccgttacctaaaaaccgggaaacctacccgggtacttttacggtttttacccttttaaacgaaaacgttacgttaaaaccgacggttccccggtaaagggtaaccggaaccggtacccggtaagttaacccgggaaacccgtaccgggggttacccggtttaacgtttaaaccgtttacccgttcgggaacggttaacccggggtaaagggtacggggtaaccgggtttacccgggggggaaccccctaaaccgggttaaaccgttttaaacccggtacccggtacggtttaacgggtaccggggttaacccgggtttcgggtaacccggggggtaaccccgggtaaacgggtaaccccccgggg

SEQ ID NO: 177952 - DNA, 643 bp, Homo sapiens
  misc_feature: GYAE6OF02FJ3C0.11.12.B01.1.454.CMB.1.raw
  modified_base (189)..(189): a, c, t, g, unknown or other
  misc_feature (189)..(189): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (509)..(509): a, c, t, g, unknown or other
  misc_feature (509)..(509): n is a, c, g, or t
  modified_base (542)..(542): a, c, t, g, unknown or other
  misc_feature (542)..(542): n is a, c, g, or t
tcagcgagagataccacgaccggtgctcgatttagtagtgtagatttgggtctggggagaggagcccagcactgggattccgaggtgtttcccattcggtgatcagcactgaacacagaggactcaccatggagttttggctgagctgggttttccttgtgctatttaaaaggagtccagtgtgaggtncgtctaggtggagtctggaggaggcctgactccacgccggtggggggtccctggagacctctcctggtcgcgacgccttcgtgggttccaccgtcacgtccacacctanagtcgnggttcgggcccnccacggctccgagggacgggctgggaggttcggtctctttattacgngtcgagtggtactacatactccgntacgacgtccggnggaacggggccgtattccgactactccgtaccagacgtaacaccgtactaaacgaacgtacgtcttcgtttactacctaatacgaacacgccgttagacgtcgaccgtnaccggtacgaaccggtccttagtacgtttacgnggttcggccagggttagacggtccggggaaccctaaccggtaccgtttaaccacggtctaagttcgggaccggtccgtacgggggactaaccggggtaccc

SEQ ID NO: 177953 - DNA, 791 bp, Homo sapiens
  misc_feature: GYAE6OF02FV1MG.11.12.B01.1.454.CMB.1.raw
  modified_base (174)..(174): a, c, t, g, unknown or other
  misc_feature (174)..(174): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggtagttttggctgagctcgggttttcttgttgctattttaaaggngtccagtgtgaggtgcgtctggtggagtctgggaggaggcctagatccgacgccgtggggggtccctggacgactctccgtgtcgcagcctcgtgggttccaccgtcagtcaccacctacatggagttcgggtccgccgaggcctaccggaagggggtaacggggcgtaggggtacggttcggggttacctttccgtttttagtttaaccgacggttaccgtagggttacgggttaactaaccgtaattacggtttcccggactaacggtaccgttacccggtacggggaccggggtaccgttaacttacccgaaccgtaccgttaccctacccggtaaggaaccgaaaccttaaccgtaaccggttaaacgaaccgtaccgttccgtttacgtttacccgtaacctaaaaggtacggtaaaccgtcgtaccgtaggaacgaccggccgttaaagcgaaacccgtcgggtaccgttagtactttacgtcggtacgacggtaaggacgggtacggttacccgggaacccttaacgggtaacccgggtttaaccacggttaccgttacgggtacgggtacccggttcggaacgggggtacccgaaccggggtaccccgg

SEQ ID NO: 177954 - DNA, 796 bp, Homo sapiens
  misc_feature: GYAE6OF02IOZ6T.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggtagtttggctgagtcttgggttttccttgttgtcttaagttttaaaaggagtccaggtgtggtaggtggcgtcgtggtggtaggtcgttgggagggacggtcccgtaggtatcccgaacggtcccgggttcgggggggttcccctcggaaggtaccttccttccgttggtcgcgtacgtcccgtcgttcgggttccgaccgtcgaacgtcctaaccaccgtacagtcgaggttcggtcccgtcccgaggcctaccggaggggtaagggtcgtagggtacggttggtaccgtttcgttttaacgttacgaacggtaccgtaggtaggttacgtaaacgtacttacgttccgacgtcgtacccgttcggtagggtacggggtaccgtacgttaccctaaccgacgttcccgtacgtaacgacgtaaacctaaacgtaacgtaaacgaaccgtacgtcgttacgttactaacgtaaatacgtaacagtaccctaggacgtacgtaccgtacgtaacgtaaccgtcgggtacgtacgttaacttcgtcgccggtaagtaacggtatacgggtaccgggttaacccctaacggtaccgttaacccggttacgaaccgtttaaggtccggtacccggtaccgggtacgggaacccggtaacgggtaccccgg

SEQ ID NO: 177955 - DNA, 1012 bp, Homo sapiens
  misc_feature: GYAE6OF02GGSBV.11.12.B01.1.454.CMB.1.raw
  modified_base (172)..(172): a, c, t, g, unknown or other
  misc_feature (172)..(172): n is a, c, g, or t
  modified_base (209)..(209): a, c, t, g, unknown or other
  misc_feature (209)..(209): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagtttggctgagctgggttttccttgttgctatttaaaaggngtccagtgtgaggtgcgtctggtggagtcgtggaggnggcctgactccaggtccggtcgggggtccctgacgaccttctcctgcgcacgccttcgtcgggttccaccgtcacgtcacctacctacagtgtaggttccgggtcccgaccggtaggtcccgtacgggaacgggggtaacggggtacgtggggtacgggttcgggttacttttaccgttttaacgtttacgaacggtacggttaagggttacgggtaacgttaaccgtaacgtttaacctttccccgggaacgttaaccggttaacccggtttacccgggggtacggggtaaaccccggggggggttaccctttaaaccctttcccggtaaacccgttacccgtttacccggtaacccggtaaccggtaaaaccggttaaacccggtaaaccgtttaaacccgtaaaaccgggtaaaacccgttaacccggttttaccggttttaacccgtttttaacccggttaaacgttaaaaaccggtttaaccggaaaccggttaaccggtccccgggttaaggtaacccgggtacccggtaaccggttaaccggttcgggaaaccccgggttacgggttaaccggtttaacgtttaaaccgggtttaccgttaagggttcccggggtaacgttacggggtacgtaacccggggttacccgggggtaaaccccttaaacggggtttaaacccggttaaccggtttaaccccgggttaccggtttaaacgggttccccggggtttaaacccgggtttcccggggggaacccgggggttaacccccgggaacgggggtttaaccccccggg

SEQ ID NO: 177956 - DNA, 764 bp, Homo sapiens
  misc_feature: GYAE6OF02HMA4A.11.12.B01.1.454.CMB.1.raw
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtgggaggaggcctgactccgacggccggtcgggggggtcccctggacgtacctccttccgtggtcgcacggccttcgttcggggttccaccgtcgaacgtccaaccacctacaagtggtacggttcgggtcccgcccgaggccgtaccggaagggggaacggggcgtgggacggttcggttcctttccgttttaagtttacagtcgtaggttggtaagtactagttacgtccgcaacgtaccgtcggtagggacggggtccctaagttccaaccctacgttaccctaccgaaggaccgtaaaccctaaacgttaaccgaaaacgaaccgtaccggttcttttacggttttacctaaacgaaaacttacggaaaccgtaccgaccggtaggaaaccgacggccgtaagtaccggaccggtaccggtccggttaagtttaaccttacggtcggttagacgtaggaggtacgggtaccggggaccctaaccggttaacgttacccgaacgttcgtacgggtacggtaaccggttccgggtacggggtacccaacgggtacccg

SEQ ID NO: 177957 - DNA, 730 bp, Homo sapiens
  misc_feature: GYAE6OF02IXK8X.11.12.B01.1.454.CMB.1.raw
  modified_base (336)..(336): a, c, t, g, unknown or other
  misc_feature (336)..(336): n is a, c, g, or t
tcagcgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggagggtacggtccgtgactccgaggtccgtcgggggggtccctgacgactcctccgtgtcgcacgcctcgtcgggttccaccgtcgagtccaaccacctacatcgtacggttcgggtccgccgaggtccncggagggaacggggcgtaggacggttgggtcttaccgtttattacgagctagtggtagtactattacgtccgactacgacgttccggtggacggggtccgtacttaccgtactacgttccctaccgaaagtaacgaaccttaaacgtacttaaaacgggaaaccctacgttaccttcggtttttaaccttaacgaaaagttccggaaactacggcttacggtacggaacgtccgaaacgttcggaaacccgttaggtacccggttaaatttccgtaacggttcggtacggtaccagggacgtaaccggggtcccggaacggtaaccgttacgtaaaccgttcgaagtttacgggaacgtccgggtaggggtacccgagggtaccccgtaaccgg

SEQ ID NO: 177958 - DNA, 811 bp, Homo sapiens
  misc_feature: GYAE6OF02JD4N9.11.12.B01.1.454.CMB.1.raw
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (314)..(314): a, c, t, g, unknown or other
  misc_feature (314)..(314): n is a, c, g, or t
  modified_base (794)..(794): a, c, t, g, unknown or other
  misc_feature (794)..(794): n is a, c, g, or t
tcagcgagagataccacgaccggtgctcgatttagtagtgtagatttgggtcgtgggagaggagcccagcactgggagttccgaggtgttccattcggtgatcagcactgaacactagaggactcaccatggagttttggctgagcgtgggttttccttgttgctattttaaaggagtccagtgngaggtgcgtctggtgngtctggnggaggcctgactccgagccgtgggggtccctagacgtactctcctgtgtcgagccttcgtggttcaaccgtcagtccacgtacctactatggagttcgggtacccnccgaggtcctaccggtaggggaacgggtccgtagggtacggttccgggtctttaccgttttagttacgacgtccgtaaggttcggtacgtacctagttaacgtcccgggacctaaggtcccttcggtacgggtacgggggtaccctagtttaccaaccgtacgttccgtacctaacggtacaaaccccgttaaattaccgtaaaaggaaccctaccgggtctttacgtttaccctaaaggtaaacgtcggtaaaaccgtcggtaacccgttcgggtaaacggaccgttacccgaaacgttagaccccgggtaaccggtacggtttacttaaacggttacggttacggtaccgtaacccggggtgtacggttaccggggtaccccggggtaaaccgtaacccggtttaaacggtaccggtttacccgacgtttaacggggttaccggttacccgggttacgggtcccggggggaaaacccnccgggggttaaaacccc

SEQ ID NO: 177959 - DNA, 572 bp, Homo sapiens
  misc_feature: GYAE6OF02GLSLW.11.12.B01.1.454.CMB.1.raw
  modified_base (212)..(212): a, c, t, g, unknown or other
  misc_feature (212)..(212): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (430)..(430): a, c, t, g, unknown or other
  misc_feature (430)..(430): n is a, c, g, or t
  modified_base (464)..(464): a, c, t, g, unknown or other
  misc_feature (464)..(464): n is a, c, g, or t
  modified_base (471)..(472): a, c, t, g, unknown or other
  misc_feature (471)..(472): n is a, c, g, or t
  modified_base (476)..(478): a, c, t, g, unknown or other
  misc_feature (476)..(478): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (504)..(506): a, c, t, g, unknown or other
  misc_feature (504)..(506): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
  modified_base (555)..(555): a, c, t, g, unknown or other
  misc_feature (555)..(555): n is a, c, g, or t
tcagcgagagataccacgaccggtgctcgatttagtagtgtagatttgggttttccttgttgctattttaaaagactccgtgagggccgattcaccatctccagagacaactctaagaacacgctgtttcttcaaatgaacagcctgagagccgatgacacggccgtgtattactgtgcgagagagtgggcccagaacgttactacgctaanggacgtcgtggggccaagggaccacgggtcacgtctcctcgacncctccaacgaagggcccacgttcggtcctttccccgtcggccncccgtagcctccagggactccaccgtcccgaggacgcacaggcccgggacccgtggggctcgccgttggcaaaacgggtcttaccgtttaccgtaactcgttacgttccgagttacggacggtccgggtcncgggtaacaacgggtcgacgtagtcgtacgctgntacggtnngcgnnngcntgngtgngngancgntacanagnnngtcagacncgtngtgacncncncgacgngtgtaccgtcgtatcgactanacgtctacgtacgatcg

SEQ ID NO: 177960 - DNA, 539 bp, Homo sapiens
  misc_feature: GYAE6OF01BHKUQ.37.49.E05.1.454.CMB.1.raw
  modified_base (205)..(205): a, c, t, g, unknown or other
  misc_feature (205)..(205): n is a, c, g, or t
  modified_base (405)..(405): a, c, t, g, unknown or other
  misc_feature (405)..(405): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagccaccctgtctgtgtctccaggggaaanagccaccctctcctgcagggcctctcagagtgttagcggccacttagcctggtaccagcagaacctggccaggctccaggctcctcatctatgagcatccacagggccactggtactcccagccaggttcaggtggcaggtgggtctggagacagtaattcactctcaccatcggcacgcctgctagtctaggtaagttnttttcgacttagttttatttctgtcagtctagtacgtcttagtttcgccttcgattccgtacccgttcggaccgtaagggtaccacggtacgtgggaacgtaattaacgggcgtaacgtggtcggtcgtgaccc

SEQ ID NO: 177961 - DNA, 556 bp, Homo sapiens
  misc_feature: GYAE6OF01CY2XX.37.49.E05.1.454.CMB.1.raw
  modified_base (206)..(206): a, c, t, g, unknown or other
  misc_feature (206)..(206): n is a, c, g, or t
  modified_base (311)..(311): a, c, t, g, unknown or other
  misc_feature (311)..(311): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagccaccctgtctgtgtctccgaggggaaanagcccaccctctcctgcagggcctctcagagtgtagcggccattacgcctggtaccagcagaaacctggccaggctcccaggctcctcatctatgagcatccacngggccacgtggtactcccgagccaggttcaggtcggcaggtgggtctggagacagtaattcactctacaccatcggacagcctgctagtctagagtatttgntagttntattactgtacagtctagtagtgggtcgtaccgttcggtacccgggtttatttcgggttttcgggaccggtaacgggggaccctaaggtcggttagggaacgtacgtacgaacggtaacgtacgtggtcggctacgg

SEQ ID NO: 177962 - DNA, 530 bp, Homo sapiens
  misc_feature: GYAE6OF01AO023.37.49.E05.1.454.CMB.1.raw
  modified_base (334)..(334): a, c, t, g, unknown or other
  misc_feature (334)..(334): n is a, c, g, or t
  modified_base (372)..(372): a, c, t, g, unknown or other
  misc_feature (372)..(372): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagccaccctgtctgtgtctccaggggaaagagccaccctctcctgcagggcctctcagagtgttagcggccacttagcctggtaccagcagaaacctggccaggctcccaggcctcctcatctatggttcatcctcaagggccactggcactccccganaggttcagtggtcgtgggtctgggacagacttcactcncaccatcagcagactagagccggaagactctagctagtgtatttctgtcagcagtatggcagctcacctccggtacgttcggccgtacggggaccaagggtacggaaataccgaaacgacgttggtacgggaccttacggacctacccagtcgttacg

SEQ ID NO: 177963 - DNA, 549 bp, Homo sapiens
  misc_feature: GYAE6OF01AR5KC.37.49.E05.1.454.CMB.1.raw
  modified_base (208)..(208): a, c, t, g, unknown or other
  misc_feature (208)..(208): n is a, c, g, or t
  modified_base (415)..(415): a, c, t, g, unknown or other
  misc_feature (415)..(415): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagcccaccctgtctgtgtctccgaaggggaaancgccaccctctcctgcagggcctctcagagtgttagcggccacttagcctggtaccagcagaaacctggccaggcctccgaggctcctcatctatgagcactccacgagggcctacgtggtaactaccgagccaggttcaggtggcaggtgggtctaggagacagaacttcactctacacatcggcacgcctgcagtctagaagttntttcgacttagttttactttctgttcagtctagtacgtcttagttcggccctcgtactccgtaccgttcggaccgaagggtaccacggacgtgggaactaagttaacggccgtaacgttggtacggcgtgaccc

SEQ ID NO: 177964 - DNA, 560 bp, Homo sapiens
  misc_feature: GYAE6OF01DKL38.37.49.E05.1.454.CMB.1.raw
  modified_base (210)..(210): a, c, t, g, unknown or other
  misc_feature (210)..(210): n is a, c, g, or t
  modified_base (288)..(288): a, c, t, g, unknown or other
  misc_feature (288)..(288): n is a, c, g, or t
  modified_base (383)..(383): a, c, t, g, unknown or other
  misc_feature (383)..(383): n is a, c, g, or t
tcagtagtgtagatcacgaccggtgctcgatttagagcgactagcaacacacgaaagggggaggaactgctcagttaagacccagacggaaccatggaagccccagcgcagcttctcttcctcctgctactctggctcccagatatcactggaggaatagtgatgacgcagtcgccagcccaccctgtctgtgtctccgaaggggaaagngcccaccctctccctgcagggcctctcagagtgtagcggccacttagcctggtaccagcagaacctggccaggctccnggctcctcatctatgagcatccaccgaggccacgtggtactcccagcctaggttcagtgctaggtggtctggagacagtaacttcactctacacntcggcagcctgcagtctagtagtattttcgcttagttttacttcgtgtcagtcgtaacgttacgtcgttagtttcggcccttccggtattaccctaccgttaccggaaccgtaacgggacctaaccggtacgtaggaacgtattaaacggcgtaacttggacggtcgtcggtaaccc

SEQ ID NO: 177965 - DNA, 644 bp, Homo sapiens
  misc_feature: GYAE6OF01CHKT6.37.49.E05.1.454.CMB.1.raw
  modified_base (234)..(234): a, c, t, g, unknown or other
  misc_feature (234)..(234): n is a, c, g, or t
  modified_base (432)..(432): a, c, t, g, unknown or other
  misc_feature (432)..(432): n is a, c, g, or t
  modified_base (478)..(478): a, c, t, g, unknown or other
  misc_feature (478)..(478): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggcctccagatatcactggaggaatagtgatgacgcagtcgccagccaccctgtctgtgtctccgaaggggaaagcgcccaccctctcctgcgagggcctcncagagtgtagcgcctacgttacgccgtgtaccagacaagaaaccgtcggaccacggcctaccgaggtcccttcctacattctagtcgaacggcactcccgacgacgggcctacgtggtacctcccgagtccgtaggttccaggtcgacgtagggtcgggtctaggacgactaagtaacttccaacttccacaccgtanccgcacgcctgactagtcgtagtattgtttcgctttagttttcttntgtacagtattaagtattaacgttacgtcggttacccttacggtaaccggtcgggttaaccggttccggaaccggtaaacggggtaaaccctaaggggtaaccgtaaaacgtaccgtaaaaaccggtacggttacggttaggaccctacgaccctaaccgttacgg

SEQ ID NO: 177966 - DNA, 708 bp, Homo sapiens
  misc_feature: GYAE6OF01DRUPC.37.49.E05.1.454.CMB.1.raw
  modified_base (209)..(209): a, c, t, g, unknown or other
  misc_feature (209)..(209): n is a, c, g, or t
  modified_base (524)..(524): a, c, t, g, unknown or other
  misc_feature (524)..(524): n is a, c, g, or t
tcagtagtgtagatcacgaccggtgctcgatttagagcgactagcaacacacgaaagggggaggaactgctcagttaagacccagacggaaccatggaagccccagcgcagcttctcttcctcctgctactctggctcccagatatcactggaggaatagtgatgacgcagtcgccagcccaccctgtctgtgtctccgaaggggaaanacgccaccctctcctgcgaggcctctcagtagtgttacgcggcctattcgcctggtaccagacaacgaacctggaccctaggcctaccccgaggtcctacctcagttccaagtggacgtccactcccgaacgacgggcctacgtggtacctcccgaagccgtaggttacaggtcggctaggtcggtctagacgagtaagtaatccacttccgtacaccgtaagtcccgggactaccggtccttagaccgtaagttccgtaaggtaaacgtttacgtttttcgacttttaagtttttacgtttcctcggttaacgnggttaaccgtacggttaccgttaccgttttaaggtttccccgggacccctttaccggaactttccccggtaaccccggtttaccggaaaccggaaacggggtccctaaaggtaccggttaagggaaaccgtttaagtaaaccggaccggttaaacgttgggttccgggtactaccggtaacccc

SEQ ID NO: 177967 - DNA, 737 bp, Homo sapiens
  misc_feature: GYAE6OF01EZG7C.37.49.E05.1.454.CMB.1.raw
tcagtagtgtagatcacgaccggtgctcgatttagagcgactagcaacacacaaaggggggaggaactgctcagttaagacccagacggaaccatggaagccccagcgcagcttctcttcctcctgctactctggctcccagactaccaccgcagaaattgtgttgacacagtctccagccacccttgtctttgtctccgaggggagagacgcccacccttctcctgcgagggccagtcagaattgtagctagtcacgttacgcctacggtaaccaacaggacgaccgtcggacccaccgggaccccctacggtcctaccgtctacgttccttacgtcgtccgtcggttcccctttccccgacggtacgggtacccacggttcggaccctaccgtacccgtacgtaccggttaacgttcggacggttcgggcgtaggggttcggtacgtacggaacggtacctacgtacccgttacctaccgttacctacctaccgtactacgacgtactacggtacgtacgacgtcgttaagaagtttacgtttacgtacttacgtttatacgttccgttagtacctaacgaccgtacctaaccgtaccgttaccggttcggttaccggtaccggtccgggaaaccgtaacgggtaacccggttaaggttacccggttactttacccggtaacggtaaccgtcgggttacggtaccgtacgtcgtaaacctgttccgtgttacccg

SEQ ID NO: 177968 - DNA, 766 bp, Homo sapiens
  misc_feature: GYAE6OF01EM569.37.49.E05.1.454.CMB.1.raw
  modified_base (227)..(227): a, c, t, g, unknown or other
  misc_feature (227)..(227): n is a, c, g, or t
  modified_base (467)..(467): a, c, t, g, unknown or other
  misc_feature (467)..(467): n is a, c, g, or t
  modified_base (537)..(537): a, c, t, g, unknown or other
  misc_feature (537)..(537): n is a, c, g, or t
  modified_base (546)..(546): a, c, t, g, unknown or other
  misc_feature (546)..(546): n is a, c, g, or t
  modified_base (580)..(580): a, c, t, g, unknown or other
  misc_feature (580)..(580): n is a, c, g, or t
  modified_base (724)..(724): a, c, t, g, unknown or other
  misc_feature (724)..(724): n is a, c, g, or t
tcagtagtgtagatcacgaccggtgctcgatttagagcgactagcaacacaacgaaagggggaggaactgctcagttaagacccagacggaaccatggaacgcccagcgcagcttctcttcctcctgctactctggcctcccagatactcacgtggaaggtaatagtgatcgacgctacgtccgccacgccctaccttgtctggttcgtcctaccggaaggggaacnccgtaccctacccttcctccgtcgaccgacgggtcccttacgtacgagtacggttcggttacggccggtaccttaaccgttaccgcccgttagggtaacccacggaccgtaacgtaacccgtcggacccgacggccctcccgaacggtcccttccgtacacttctaacgcgtacgtcctaacgcccgaaccgtcgggtacctacgtacggtacctccggacgtcgtacggtcacggggtnccggtacggtcggtacgacggtacacgtaacgagtttcccatccgtacaccgtcgtcgtacacgtcgtanacgtacgtnttaacggtattttacgttgtactttaacgttttntcctaggaacttaccgggattacggttacccgtttgtttaacccgttccggtaacccttacggtaaccttcccggaacggtttaccccgaaacccgggaaacgggttcccctaaacggggttacgtacgggttaaccgttaaanaccgggttaccggaacgtttccgccggttaccacggttaccc

SEQ ID NO: 177969 - DNA, 742 bp, Homo sapiens
  misc_feature: GYAE6OF01C244A.37.49.E05.1.454.CMB.1.raw
  modified_base (205)..(205): a, c, t, g, unknown or other
  misc_feature (205)..(205): n is a, c, g, or t
  modified_base (730)..(730): a, c, t, g, unknown or other
  misc_feature (730)..(730): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagccaccctgtctgtgtctcgaggggaaancgcccaccctctcctgcgacgggtcctctcgagtaggtgttacggccggacctacgttacgccgtacggtaccaacgacgaaccggtaaaccgtcgggacccgaacggtaccctaccccgacggtccttcctacgtacttcctaagtcggaacggcctacgtcccgaaccggacggggaccctacggttacgggtacctcccgaacgtccgtaagggttccgaagggtcggacgtagggttcgggtacgtaggaacggtaacgtaaggtaactttccaccgttacctaaccgaacccgtaggttaccggacgtaacccggtccgttaggaaccttaggtaccgttagggtaacgtttacgttttcgacgtttagttttttacgtcgttagtactacgtacgtaacggttaccgtagtttacgttccggtacccttacgtacttcccgttaccggttccggaacggtaacggaccgtacggtacggttaggaacggttaagttaacggtacgtaacgtcgggtacncgtacgtacccg

SEQ ID NO: 177970 - DNA, 766 bp, Homo sapiens
  misc_feature: GYAE6OF01BCLNV.37.49.E05.1.454.CMB.1.raw
  modified_base (396)..(396): a, c, t, g, unknown or other
  misc_feature (396)..(396): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggcctcccagatatcacgtggaggaatagtgatggacgcagtccgccacgcccaccgtgtctgtgtccgtcgaaggggaagcgccaccctctcctgcgacggcctctcgagtagtgttacggccggacctacgttacgccgttacggtaccacgaccgaacgtaaacccgtcggaccgacggtccctcccgacggcctaccgtacgtacttcgtagtcggaacggcctaacgtacccgaaccgacgggccctagttcggtaacnccccgtagtacccgtaggttacgagggtcgcggtagggttcgggtacgtaggaacgaacgtaacgttaaccgttcctaacgttccgtaaccgtacccgtaacggtccgggaaccgaccgtcccgtaacgtcgtaaacggttacgtaaggttaaagttttcgtttacgtacttttaagttttacctttcgtacggtactacggtaacttacggttaccgtttacgtttaccggtttaccggtacccttaccggtaacttccccggtaccgttaaacccggggaaccgtaaccggggaaccttaccggacggttaggtaaacgttaacgggttaacggacgttacggtaggtttacggacccgttggaaccc

SEQ ID NO: 177971 - DNA, 600 bp, Homo sapiens
  misc_feature: GYAE6OF01D2LBA.37.49.E05.1.454.CMB.1.raw
  modified_base (207)..(207): a, c, t, g, unknown or other
  misc_feature (207)..(207): n is a, c, g, or t
tcagtagtgtagatcacgaccggtgctcgatttagagcgactagcaacacacaaaggggggaggaactgctcagttaagacccagacggaaccatggaagccccagcgcagcttctcttcctcctgctactctggctcccagatatcactggaggaatagtgatgacgcagtcgccagcccacctgtctgtgtctccgaggggaaancgccaccctctcctgcagggcctctcagagtgttagcggccacttacgcctggtaccagcaacgaaacctggaccaggcctcccaggctcctacatcatggagcactccaccgacgggcctacgtggtactcccagcccaggtttcaaggtcggacaggtgggtactggacgaaccgagtaaacttccaaccgtcctacaacccgtatccggggcacgcccttgactagtcttagggaaacgttattttcgtacttaacgtttttatttcttgtcacgcagttacgctttacgttcgacctccgtaatccctaccgtttcgaaccgtaagggacctacggacgttagggaacgaagtttaaacggacgttaacgtggtggtccgtcgtaaccg

SEQ ID NO: 177972 - DNA, 525 bp, Homo sapiens
  misc_feature: GYAE6OF02IKZTT.37.49.E05.1.454.CMB.1.raw
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagccaccctgtctgtgtctccaggggaaagagccaccctctcctgcagggcctctcagagtgttagcggccacttagcctggtaccagcagaaacctggccaggctcccaggctcctcatctatgaggcatccaccagggccactggtatcccagccaggttcagtggcagtggtctgagacagattcactctcacatcggcagcctgcagtctgaagtattttgcttagtttatttctgtcagtctagtacgtcttagtttcggccttccgtactcctaccgttcggacctaacgggaccaaccggacgtggacgtagttaacggcgtaacgttggtcggtctggaccg

SEQ ID NO: 177973 - DNA, 550 bp, Homo sapiens
  misc_feature: GYAE6OF02I296M.37.49.E05.1.454.CMB.1.raw
tcagtagtgtagatcacgaccggtgctcgatttagagcgactagcaacacgacaaagggggaggaacgtgctacagttaagacccagacggaaccatggaagccccagcgcagcttctcttcctcctgctactctggctcccagatatcactggaggaatagtgatgacgcagtcgccagccaccctgtctgtgtctccaggggaaagagccaccctctcctgcagggcctctcagagtgttagcggccacttagcctggtaccagcagaaacctggccaggctcccaggctctcatctatgaggcatccaccagggccactggtactcccagccaggttcagtggcagtgggtctgagacagaattcactctcacatcggcagcctgcagtctagaagtattttgcttagttttactttctgtacagctagttacgtcttagtttccgccttccgatcccgtaccttccgggaccgtaacgggtaccaaccggtactacgggaacgtaagtttaacggacggtaacgttcggtcggtccgtacgtaccg

SEQ ID NO: 177974 - DNA, 518 bp, Homo sapiens
  misc_feature: GYAE6OF02IW25I.37.49.E05.1.454.CMB.1.raw
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagccaccctgtctgtgtctccgaggggaaagagccaccctctcctgcagggcctctcagagtgttagcggccacttagcctggtaccagcagaaacctggccaggctcccaggctcctcatctatgaggcatcccacgagggccactggtactcccagccaggttcagtggctaggtggtctgagacagaattcactctcacatcgcagcctgcagtctagaagtattttgcttagtttatttctgtctagctacgtacgtcttatttcggcccttcgatcctaccttcgaccaagggacacgtacgtaggagtagttaacgcgtaacgtggtacggctgacc

SEQ ID NO: 177975 - DNA, 583 bp, Homo sapiens
  misc_feature: GYAE6OF02JSRIF.37.49.E05.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (430)..(430): a, c, t, g, unknown or other
  misc_feature (430)..(430): n is a, c, g, or t
tcagtagtgtagatcacgaccggtgctcgatttagagcgactagcaacacgacaaagggggaggaactgctcagttaagacccagacggaaccatggaagccccagcgcagcttctcttcctcctgctactctggctcccagatatcacgtggagaaatagtgatgacgcagtctccagccaccctgtctgtgtctccgaggggaaagacgccacctctcctgcagggccagtcagagtgttagcagcaacttgcctggtaccagcagaacctggccaggctcccaggcctccncatctagtggtntccactcccaccgtacgggccctacggtcgtacctcccagtcccgaggtttcaggtgggcaggtgggtctaggggacaggtcgttccactcctacaccatccagcagcctgcagtctgtaagtntttcgcttagtttattcgtgtactacgtacgtaagtattaactttacgtacggtccttaccggtacgtcgggtacgttcgggtaccgtaacgggtaaccgaagggtacggtaaagtaccgtaaacgtacgtggtacggtaccttagcctaacg

SEQ ID NO: 177976 - DNA, 674 bp, Homo sapiens
  misc_feature: GYAE6OF02IQHF4.37.49.E05.1.454.CMB.1.raw
  modified_base (306)..(306): a, c, t, g, unknown or other
  misc_feature (306)..(306): n is a, c, g, or t
tcagtagtgtagatcacgaccggtgctcgatttagagcgactagcaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacctctcctgcagggccagtcagagtgttagcagcaacttagcctggtaccagcaagaaacctggcaggctacccaggcctcctcatcctatggtancaactccaccgagggccaacgtggtactcccgaagcctagggttacaggtcggactagggttggggtccttggggaacctaggtacggtttacccacgtccttaccaaccacgttacaacggccacggtccgtgtaccgtagtccgtacgggtaaagttactttttacggacgttaacgtttttacgttttcgtcggtttaacacggtacttaaggtttaacttaaacgttttaccgtacggtacccttacgttaccgggtacggttaaccggttaccggacccgggtaaagggtaacccgtaaggggtaacgtaaacgttaaccgtaaacgtaacgttacgggtacgtacggacgtaccgtactacg

SEQ ID NO: 177977 - DNA, 676 bp, Homo sapiens
  misc_feature: GYAE6OF02G3J65.37.49.E05.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
tcagtagtgtagatcacgaccggtgctcgatttagagcgactagcaacacacaaagggggaggaactgctcagttaagacccagacggaaccatggaagccccagcgcagcttctctccctcctgctactctggctcccagatatcactggaggaatagtgatgacgcagtcgccagcccaccctgtctgtgtctccgaggggaaacncgcccaccctctcctgccaggcctctcagngttgttacgcgccattcgcctggtaccagcaacgaacctggccaggcctccgagcctcctcatctagtggacgtcacgtcccgacgacgggccacgtggtacctccccaggcctaggttcaggtcggacgtagggtgggtactaggaacgtaacgtaagtaactttccaacttcctaccaaccgtacgtacccgggcaaccggtccttaggaccgttaggttaccgtaggtaacgtttacgtttttacgacgttttagttttacgtttccgtaggttaccgtacgtacgttacgttacgttactttacgtttcggcccttacggtacttcccgtaaccgttaccgggaaccgtaacgggtacccgtaacgttaccggtaggtaacgttaacgtaacggtaccggttaacgttacgggtccggtacgttcggtaacccg

SEQ ID NO: 177978 - DNA, 758 bp, Homo sapiens
  misc_feature: GYAE6OF02JZED9.37.49.E05.1.454.CMB.1.raw
  modified_base (140)..(140): a, c, t, g, unknown or other
  misc_feature (140)..(140): n is a, c, g, or t
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
tcagtagtgtagatcacgaccggtgctcgatttagagcgactagcaacacacaaaggggaggaactgctcagttaagacccagacggaaccatggaacgccccagcgcagcttctcttcctcctgctactctggctccanatatcactggaggaatagtgagtcgacgcagtcgccagcccacctgtctgtcgtctccgaaggggaaanacgtcccaccctctccgtgccgagggccagtcagtagtgttagcagcacttgcctgacngacacgaactggccaggcctcccaggtccctcctnacgttcaggttcggtacnctaacctcccggaaacggtccgggaccctacgtagggtaactccccgaggccctaagggttcaggtcgggaccgtaggttcgggtacgtacggggaactacgggttcgttacctacctaccgtaccgtaaccgtaacgttcgaccgggtacaaccggttcccgtaaaggtccgtaagtttaccggtaacggttaaccgttttaagtttttccggatttacggtttttaactttcgtaaacggttcctaacgtaccgtttaaagtttaaaccgttaccgttttacgtaccgggttccccttaacggttaacgggttcccggtaacggttaccggtaaacccggttaaacggggaacccgtttaaagggtaaaccgaaacggtttacccgtaaaacggttccggtaggttcccgtaacgtaccgggttaccctaaccgg

SEQ ID NO: 177979 - DNA, 834 bp, Homo sapiens
  misc_feature: GYAE6OF02IGOJ3.37.49.E05.1.454.CMB.1.raw
  modified_base (209)..(209): a, c, t, g, unknown or other
  misc_feature (209)..(209): n is a, c, g, or t
  modified_base (351)..(351): a, c, t, g, unknown or other
  misc_feature (351)..(351): n is a, c, g, or t
tcagtagtgtagatcacgaccggtgctcgatttagagcgactagcaacacacaaagggggaggaactgctcagttaagacccagacggaaccatggaagccccagcgcagcttctcctccctcctgctactctggctcccagatatcactggagaatagtgatgacgcagtcgccagcccaccctgtctgtcgtctccgaaggggaaancgccacccctctccgtagccgacgggccttctcaggtagttgttacgccggctactttacggccgttaggtaaccagccgaacggaaaccctgggacccagggaccctccccgaaggtcccttacccgtactataccttagnggacggacctaacctcccgaaccggaacggggcccctaacggttacggtaacctccccgaggtacccgtacgggttttccgagggtacgggaccgtagggttggggttcctagggaaactaaccgtaaagggttaaactttccgtaaccctttaccctaacctaaacccggtacgttacccggggaccaaccggttccgttacgacccgtaaggtttacccgtaaggttaacgtttacggttttttacggactttttaaaccgtttttttacgtttccggttaaccgtttacgtaaccggttaccgttaaccggttacggtttaccgtttaaccggttttccgggacccgtttaccgaccgtttaacccgtacccgtttaacccggaacgggtaaccgggtaaacgtaccggtacgttaaccggttaaaggttaacgttaaccggtaccggttaaacgttggtaccggtccgtaacgtacccg

SEQ ID NO: 177980 - DNA, 818 bp, Homo sapiens
  misc_feature: GYAE6OF02HMLWB.37.49.E05.1.454.CMB.1.raw
  modified_base (209)..(209): a, c, t, g, unknown or other
  misc_feature (209)..(209): n is a, c, g, or t
tcagtagtgtagatcacgaccggtgctcgatttagagcgactagcaacacacaaagggggaggaactgctcagttaagacccagacggaaccatggaagccccagcgcagcttctcttcctcctgctactctggctcccagatatcactggaggaatagtgatgacgcagtcgccagcccaccctgtctgtcgtctccgaaggggaaancgcccaccctctccgtgccgacgggccctctcgaggtagttcggttacggccggacctaacgtttacgccgtacggtaccagctaacgaaccgtcggacccgtaggccctaccccgacggtcccttcccgtactaacttcttacgtggaacggtcctaaccgttaccccgaacggaccggggtaccctaacggttaccgggttaacctaccccgaaggacccgttaggggtttccaagggtcggacttaagggttcgggtatacgggaagtaacgtaggtaaactttcgaccttcctacgaacccgtcgtaccggaccacggtccgtggactaacggttccgtaaggttaacgtttacgtttttacgaacgttttaacgttttttacgtttaccgttacgttaccgttacggtacgttaacggtaccgtttaccgtttaacggttttccggtaaccgttcccgtaaccgtttaccccgttaaccgggtttaccccggaacccgggttaaacgggtaacccgtaaccggttaaccggtaagggttaaacgtaacggtttaacggaccgggttaaccggttacgggttacggttacccgttacggaacccg

SEQ ID NO: 177981 - DNA, 512 bp, Homo sapiens
  misc_feature: GYAE6OF01DONSV.49.24.C02.1.454.CMB.1.raw
  modified_base (472)..(472): a, c, t, g, unknown or other
  misc_feature (472)..(472): n is a, c, g, or t
tcagagtcgagagacacgaccggtgctcgatttagtacagatcgttagggaaaggggaaaggccctgaggaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaagctgcctcaccatcacggggcccaggcagatgatgaatgtagattattactgtgtgctgtatctgggtggtggtntttttcggtgttcggcggagggaccaagctgccgtctacg

SEQ ID NO: 177982 - DNA, 588 bp, Homo sapiens
  misc_feature: GYAE6OF01DHYIQ.49.24.C02.1.454.CMB.1.raw
  modified_base (516)..(516): a, c, t, g, unknown or other
  misc_feature (516)..(516): n is a, c, g, or t
tcagagtcgagagacacgaccggtgctcgatttagtacagatcgttagggtaaaggggtaaagggccctaggaggaaaacgaaaccccacgctgggtaagcctcgacgaaccaacggtacgccttcgattccgaggtcgtcccccaccactcggccgtggatcgactgcttctcctcggaccgtcccttggcttatcggagtcaagggtgtggtaactctcagactgtggtgacccgaggaggccaagtcgttgtcaggtggtccccgggggggacagtcacactcacttgtggcttgagctctggctcagtctcaacttggttactaccccagctggtaccagcacgaccccaggccaggcctccacgcacgctcatgtacgatacaaatagtcgctcttcgtggggttccctggactcgcttctctggcctcatccttagggaacaagctgccctcaccactccgacggggcccaggcagatgatgaatgtagtattattactgtgtgtctgtntcgtgggtggttggttcgtttttggtggtttcgggcgggacgggtaccgaagtctacggcccgtcgtaccgg

SEQ ID NO: 177983 - DNA, 614 bp, Homo sapiens
  misc_feature: GYAE6OF01BX2LP.49.24.C02.1.454.CMB.1.raw
  modified_base (468)..(468): a, c, t, g, unknown or other
  misc_feature (468)..(468): n is a, c, g, or t
tcagagtcgagagacacgaccggtgctcgatttagtacagatcgttagggaagggaaaggccctgaggaaaacaacccagctggaagcctgagaacacgtagccttcatgagtgtcccaccatggcctggatgatgacttctcctcggactccttgccttatggatcaggtgtggaaatctacagactcgtggtcgacccaggacgccctatccgttgtcaggtgtcccggggggacagtcgacactcgacttgtggccttgaggcttcgtggctcctaggtctcaacgtcggttactaccccagccgtcggtacacgacgacgaacccgaggccacggcctccaccgctacgctacagtcgaacgaataacgaaaagtgtccgtcctcgttacgtcgggtccctagtaactccgacttctcgtcggtctctacgtcgttagggaacctaagcttgccctcaccgtanccgggaccgggaccgagctagatgatgaatggtataatttattacgtgtgttcggccttgtagtccgtgggtggttcggttgttttacggtgggtttcggacgggtacggaaccgtaacggtcgaccgtacccgtcccgtaaccgg

SEQ ID NO: 177984 - DNA, 531 bp, Homo sapiens
  misc_feature: GYAE6OF01EI51L.49.24.C02.1.454.CMB.1.raw
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcacgaccccaggccaggcctccacgcacgctcatgtacgatacaaatgtcgctcttctgggtccctgatcgcttctctggctccatccttgggaacaagctcgccctcaccatccgaccggggcccaggcagatgatgaatgtagtattattactgtgtgtctgtatcgtgggttggtggttctttttcggtggttcgggcggacgggtaccaggctcggcccgtcgtacg

SEQ ID NO: 177985 - DNA, 512 bp, Homo sapiens
  misc_feature: GYAE6OF01D4MHZ.49.24.C02.1.454.CMB.1.raw
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatagtcgctcttctggggtccctggatcgcttctctggctccatccttgggaacaagctgccctcaccatcgacggggcccaggcagatgatgaatgtgattattactgtgtgctgtatcgtgggtggtggtnttttcggtgttcggnggaggcagctgccgtctacg

SEQ ID NO: 177986 - DNA, 543 bp, Homo sapiens
  misc_feature: GYAE6OF01B3UKC.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgactcgcttctctggctccatcctggaacaagctgccctcaccatccgacggggcccaggcagatgatgaatgtgattattactgtgtgtctgttatcgtgggttggttggtcgtttttcggtggtttcgggcgggtacgggtaccaaggtccgtcggtacccggtccgtaccgg

SEQ ID NO: 177987 - DNA, 549 bp, Homo sapiens
  misc_feature: GYAE6OF01BRQB6.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttactaccccagctggtaccagcagaccccaggccaggctccacgcacgcttatgtacgatacaaatagtcgctcttctggggtccctgatcgcttctctggctccatccttgggaacaagctcgcccctcaccatccgacggggcccaggcagatgatgaatgtagtattattactgtgtgctgtatcgtgggttggttggttcgtttttggtggtttcgggcgggtacgggaccgtaaggccgttaggacccgttccgtacgtcccg

SEQ ID NO: 177988 - DNA, 550 bp, Homo sapiens
  misc_feature: GYAE6OF01A6AKB.49.24.C02.1.454.CMB.1.raw
  modified_base (360)..(360): a, c, t, g, unknown or other
  misc_feature (360)..(360): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcagaccccaggccaggctccacgcacgctcatgtacgatacaaatagtcgctcttcnggggtccctgatcgcttctctggctccatccttgggaacaaagctcgccctcaccatccgacgggggcccaggcagatgatgaatgtgattattactgtgtgctgtatgtgggttgggttcggttgtttttcggtgggtttcgggcgggtacgggtaccgaaggtcgtacggacccgttcccgtaaccgg

SEQ ID NO: 177989 - DNA, 528 bp, Homo sapiens
  misc_feature: GYAE6OF01EXIJX.49.24.C02.1.454.CMB.1.raw
  modified_base (299)..(299): a, c, t, g, unknown or other
  misc_feature (299)..(299): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccngcagaccccaggccaggctccacgcacgctcatgtacgatacaaaatgtcgctcttctggggtccctgatcgcttctctggctccatccttagggaacaagctgccctcaccatcgacggggcccaggcagatgatgaatgtgattattactgtgtagtctgtatcgtggggttggtggtctttttcggtgttcgggcggagggaccaggcctggacccgtcctaccgg

SEQ ID NO: 177990 - DNA, 590 bp, Homo sapiens
  misc_feature: GYAE6OF01DYVS6.49.24.C02.1.454.CMB.1.raw
  modified_base (359)..(359): a, c, t, g, unknown or other
  misc_feature (359)..(359): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggggacagtcacactcacttgtggcttgagctctggctcagtctcaacttggttacctaccccagctggtaccagcacgaccccaggccaggcctccacgcacgctcatgtacgataacaaatagtcnctcttcgtcgggtccctgactcgcttctctggcttccattccgttagggaactaaacgctcgccctcaccactccgaccggggcccaggcagatgatgaatgtagtattattacgttgttgtgtcttgtagttcgttgggttgggtttcggttcgttttttcggttcgggtttccgggcgggtaacggggtaaccgtaacggtccgttacggtacccgtcccgttaaccgg

SEQ ID NO: 177991 - DNA, 522 bp, Homo sapiens
  misc_feature: GYAE6OF01EB19H.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaaatagtcgctcttctggggtccctgatcgcttctctggctccatccttgggaacaaagctgccctcaccatcacgggggcccaggcagatgatgaatgtgattattactgtgtgctgtatctgggtggtggtctttttcggtgttcgggcggagggaccaagctgaccgtcctaacg

SEQ ID NO: 177992 - DNA, 562 bp, Homo sapiens
  misc_feature: GYAE6OF01EEY1A.49.24.C02.1.454.CMB.1.raw
tcagagtcgagagacacgaccggtgctcgatttagtacagatcgttagggaaaggggaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggcctccacgcacgctcatgacgatacaaatagtcgctcttctggggtccctgatcgcttctctggctccatccttgggaacaagctgccctcaccatccgaccggggcccaggcagatgatgaatgtgatttattactgtgtgtctgttatcggttggggttgggttggttcgttttttcggtggtttccggggcggggtaacggggtacccgaaaggtccttacggacccgttcccgtacccgg

SEQ ID NO: 177993 - DNA, 543 bp, Homo sapiens
  misc_feature: GYAE6OF01C4ZWZ.49.24.C02.1.454.CMB.1.raw
  modified_base (423)..(423): a, c, t, g, unknown or other
  misc_feature (423)..(423): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaacttggttacctaccccagctggtaccagccacgaccccaggccaggcctccacgcacgctcatgtacgataacaatagtcgctcttcgtggggtccctgactcgcttctctcggctcctatccgtgggaacaagctcgccctcaccnctcgaccggggcccaggcagatgatgaatgtagtattattacgtgtgtgcttgtatcgtgggtggttggttcttttcggtggttcgggcgggtacggaccaggctcggcccgtcgtaccg

SEQ ID NO: 177994 - DNA, 554 bp, Homo sapiens
  misc_feature: GYAE6OF01AOZZS.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggggacagtcacactaacttgtggcttgagctctggctcagtctcaactggttactacccagctggtaccagcagaccccaggcccaggcctccacgccacgctcatgtacgatacaaatagtcgctcttcgtggggtccctgatcgcttctctggctccatccttgggaacaaagctcgccctcaccatccgaccgggggcccaggcagatgatgaatgtagatttattactgtgtgctgtatcgtgggtggttggttcgtttttggtggttcgggcgggtaagggacccgtaaggctacggtacccgttccgttaccggtaccg

SEQ ID NO: 177995 - DNA, 522 bp, Homo sapiens
  misc_feature: GYAE6OF01BYXCM.49.24.C02.1.454.CMB.1.raw
  modified_base (477)..(477): a, c, t, g, unknown or other
  misc_feature (477)..(477): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcaccactcacggggcccaggcagatgatgaatgtgattattactgtgtgctgtatctgggtggtggtnttttcgtgttcggtcggagggtaccaaggctgccgtccgtaacgg

SEQ ID NO: 177996 - DNA, 520 bp, Homo sapiens
  misc_feature: GYAE6OF01C222S.49.24.C02.1.454.CMB.1.raw
  modified_base (234)..(234): a, c, t, g, unknown or other
  misc_feature (234)..(234): n is a, c, g, or t
  modified_base (478)..(478): a, c, t, g, unknown or other
  misc_feature (478)..(478): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggtacctaccccagcctggtaccagcagaccccaggccaggcctccacgcacgctcatgtacgatacaaatgtcgctcttcgtgggtccctgactcgcttctctgctccatcctggaacaagctcgccctcacatccgacggggccaggcagatgatgaatgtgtattattactgtgtgtctgtatcgtgggtggttggtnttttcggtgttcgggcggacgggtacagctcgccgtcgtacg

SEQ ID NO: 177997 - DNA, 517 bp, Homo sapiens
  misc_feature: GYAE6OF01AQLZY.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggacaagctgccctcaccatcacggggcccaggcagatgatgaatgtgattattactgtgtgctgtatcgtgggtggtggtctttttcggtgttcgggcggagggaccaggctgccgtcgtacg

SEQ ID NO: 177998 - DNA, 813 bp, Homo sapiens
  misc_feature: GYAE6OF01DH3CR.49.24.C02.1.454.CMB.1.raw
tcagagtcgagagacacgaccggtgctcgatttagtacagatcgttagggaaaggggaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaacttcggttacctaccccagctggtaccagcacgaccccaggccaggcctccacgcacgctcatgtacgataacaaatagtcgctcttcgtcgggtccctgtactccgtctttctcgtcggtcctcctacgttcccgtttaacggggaaacctaaaacggtcccttaccggtacccccttaccgaaacccctaacgttaccccgggaacccgggggggacccccaaacggggaccgaaacggtacgttacggtaaacgttacggtaaagttacgggttaggttaaacgtttttaaacgttttaaccgttgggtttacgggtttacggtaccgttttaggtttaacggtttccgggtttgggggggtttcggggttttcggggttttcccggtttttttttccgggggtttccggggtttttaccccgggggggtaacccggggggtttaaaccggggggtaaaccccggttaaaacggggttccccggtttacccggggttaaaccccccgggtttcccccggtttaaaccccggg

SEQ ID NO: 177999 - DNA, 533 bp, Homo sapiens
  misc_feature: GYAE6OF01CMV4P.49.24.C02.1.454.CMB.1.raw
  modified_base (483)..(483): a, c, t, g, unknown or other
  misc_feature (483)..(483): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggcctccacgcacgctcatgtacgatacaaatagtcgctcttctggggtccctgactcgtcttctctggctccatccgttaggaacaagctcgccctcaccatcgaccggggcccaggcagatgatgaatgtgattatactgtgtgctgtatcgtgggtggtggttnttttcggtggttcgggcggtacgggtaccaagctcggtccgtccgtaccg

SEQ ID NO: 178000 - DNA, 519 bp, Homo sapiens
  misc_feature: GYAE6OF01CK645.49.24.C02.1.454.CMB.1.raw
  modified_base (379)..(379): a, c, t, g, unknown or other
  misc_feature (379)..(379): n is a, c, g, or t
  modified_base (429)..(429): a, c, t, g, unknown or other
  misc_feature (429)..(429): n is a, c, g, or t
  modified_base (474)..(474): a, c, t, g, unknown or other
  misc_feature (474)..(474): n is a, c, g, or t
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggcctccacgcacgctcatgtacgataccaaatagtcgctcttctggggtccctgactcgcttcnctggctccatcctggaacaagctcgcctcacatcacggggccaggcagangatgaatgtgtattattactgtgtgctgtatcgtgggtggtggtnttttcggtggttcggcggaggaccgaagntcgccgtccgtaccgg

SEQ ID NO: 178001 - DNA, 587 bp, Homo sapiens
  misc_feature: GYAE6OF01CEA5S.49.24.C02.1.454.CMB.1.raw
  modified_base (356)..(356): a, c, t, g, unknown or other
  misc_feature (356)..(356): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggacagtcacactcacttgtggcttgagctctggctcagtctcaactggttacctaccccagctggtaccagcacgaccccaggccaggcctccacgcacgctcatgtacgataacaatagtcnctcttcgtcggggtccctgactcgtctttctcgtcggtcctcctacttcccgttagggaacctaaacgcctcggcccctacacccacgtccgacccgggggcccagggccagatcgagtgaatgtgtatttattacgtgtgtgtcttgttagtcgtggggttggttcggttcgtttttcggtggtttcgggcgggtacgggtaccgtaggtcgtcggtcccgttccgtacg

SEQ ID NO: 178002 - DNA, 537 bp, Homo sapiens
  misc_feature: GYAE6OF01CHH9K.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgacgatacaaatagcgctcttctggggtccctgatcgcttctctggctcatccgttggaacaagctgccctcaccatccgacggggcccaggcagatgatgaatgtagtattattactgtgtgcttgtatcgtgggtggttggtcttttcggtggtttcgggcgggtacgggacccgtaagcctcggacccgttcgtaaccgg

SEQ ID NO: 178003 - DNA, 578 bp, Homo sapiens
  misc_feature: GYAE6OF01B26ZN.49.24.C02.1.454.CMB.1.raw
  modified_base (236)..(236): a, c, t, g, unknown or other
  misc_feature (236)..(236): n is a, c, g, or t
  modified_base (338)..(338): a, c, t, g, unknown or other
  misc_feature (338)..(338): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggganagtcacactcacttgtggcttgagctctggctcagtctcaaactggttacctaccccagtctggtaccagcacgaccccaggccaggcctccacgcacgctnatgtacgataacaaatcgtcgcttcttcgtcggggtccctgactcgctttctctcggctccctatccgttagggaacaagtctcgccctcaccacgtcgaccggggccccaggcagatgatgaatgtagtattattactgttgtgtctgtattcgtgggttgggttcggttcgtttttcgggttcgggttccgggacgggtacggggaccgtagaccgttcggaccccgttcgtaacccg

SEQ ID NO: 178004 - DNA, 555 bp, Homo sapiens
  misc_feature: GYAE6OF01BMMY6.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggcctccacgcacgctcatgtacgatacaaatagtcgctcttctggggtccctgatcgcttctctggctccatccttgggaacaagctgccctcaccagtccgaccgggggcccaggcagatgagtgaatgtagtatttagttactgtgtgctgtatcgtgggtggttcggttgtttttcggtggttccgggcgggtacgggtaccgtaaggccgttacggtcccggtccgttaacccgg

SEQ ID NO: 178005 - DNA, 546 bp, Homo sapiens
  misc_feature: GYAE6OF01CTWFB.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttacctaccccagctggtaccagccacgaccccaggccaggcctccacgcacgctcatgtacgataacaaatagtcgctcttcgtggggtccctgactcgtcttctctggctccatccgttgggaacaagctgccctcaccatccgacggggcccaggcagatgatgaatgtagtattattactgtgtgtctgtatcgttgggtggttggttcgtttttggtggttcgggcgggacgggtaccaaggctacgtcccgtcgtaccg

SEQ ID NO: 178006 - DNA, 549 bp, Homo sapiens
  misc_feature: GYAE6OF01CNDFB.49.24.C02.1.454.CMB.1.raw
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccggggggganaggtcacactcacttgtggcttgagctntggctcagtctcaactggtacctacccagctggtaccagcacgaccccaggccaggctccgacgcacgctcagtcgtacgataacaaatacgtcgactcgttcgtcgggtccctgactcgcttctctggcctcatccgtaggaacaagctcncctcacactcgacgggccaggcaggntgatgtatgtagtattattactgtgtgtctgtagtcgtgggtggttcggttcttttcggtggttcgggcggtacgggtaccaaggtccgtcggtacccgtcgtaccgg

SEQ ID NO: 178007 - DNA, 544 bp, Homo sapiens
  misc_feature: GYAE6OF01A0NDL.49.24.C02.1.454.CMB.1.raw
  modified_base (233)..(233): a, c, t, g, unknown or other
  misc_feature (233)..(233): n is a, c, g, or t
  modified_base (491)..(491): a, c, t, g, unknown or other
  misc_feature (491)..(491): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggganagtcacactcacttgtggcttgagctctggctcagtctcaactggttactaccccagctggtaccagcacgaccccaggccaggctccacgcacgctcatgtacgataacaaaatagtcgcttcttcgtcggggtccctgatcgtctttctctggctccatccgttagggaacaagctcgccctcacctatccgacggggcccaggcagatgatgaatgtagattattactgtgtgtctgttatgtgggtgtgggttnttttcggtgttcgggcggagggtaccaggtcgtacgtcccgttccgtaaccgg

SEQ ID NO: 178008 - DNA, 534 bp, Homo sapiens
  misc_feature: GYAE6OF01BEZXE.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctgggtccctgatcgcttctctggctccatcctggaacaagctgccctcaccactcgacggggcccaggcagatgatgatgtagattattactgtgtgctgtatcgtgggttggtcggttcgtttttcggtggttcgggcgggtacgggacctaggcctcggtcccgtccgtaccgg

SEQ ID NO: 178009 - DNA, 530 bp, Homo sapiens
  misc_feature: GYAE6OF01EEDJ5.49.24.C02.1.454.CMB.1.raw
  modified_base (351)..(351): a, c, t, g, unknown or other
  misc_feature (351)..(351): n is a, c, g, or t
  modified_base (494)..(494): a, c, t, g, unknown or other
  misc_feature (494)..(494): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgtgtcagtggtccccgggggggacagtcacactcacttgtggcttgagctctggctcagtctcaactggttactacccagctggtaccagcagaccccaggccaggctccacgcacgctcatgtacgataacaaatgtcnctcttctcggggtccctgactcgcttctctggctcatcctgggaacaagctcgcctcaccatcgacggggccaggcagatgatgaatgtagtattatactgtgtgctgtatcgtgggtggtggttcgttttcggtggttcggngggaacgggtaccaaggtctcggccgtccgtaccgg

SEQ ID NO: 178010 - DNA, 580 bp, Homo sapiens
  misc_feature: GYAE6OF01DER0P.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaacttggttacctaccccagctggtaccagcacgaccccaggccaggcctccacgcacgctcatgtacgatacaaatgtcgcttcttcgtcggggtccctgactcgtcttctctcggcctccacttccgttagggaaacctaacgtcctcgccctcaccacgtccggaccggggcccaggcagatgatgaatgtagtatttattacgttgtgtgtcgttgtagttcggttgggttggttcggtttcgtttttcggtggttccgggcgggtacgggtaccacggtcgtcggtccgtccgtaccg

SEQ ID NO: 178011 - DNA, 522 bp, Homo sapiens
  misc_feature: GYAE6OF01BVI1G.49.24.C02.1.454.CMB.1.raw
  modified_base (437)..(437): a, c, t, g, unknown or other
  misc_feature (437)..(437): n is a, c, g, or t
  modified_base (483)..(483): a, c, t, g, unknown or other
  misc_feature (483)..(483): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggcctccacgcacgctcatgtacgataacaaatagtcgctcttcgtgggtccctgactcgctttctctggctccatcttagggaacaagctgccctcaccatcgacggggcccaggcagangatgaatgtgattattactgtgtgctgtatcgtgggtggttcggtnttttcggtgttcggcggaggaccagctcgccgtctaccg

SEQ ID NO: 178012 - DNA, 561 bp, Homo sapiens
  misc_feature: GYAE6OF01AUHYB.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaacttggttacctaccccagctggtaccagccacgaccccaggccaggcctccacgcacgctcatgtacgatacaaatgtcgctcgttcgtcgggtccctgtactcgtcttctcgtcggctccactccgttaggaactaacgcctcgccctcaccacgtccgacggggcccaggcagatgatagaatgtagtattattactgtgtgtctgtagtgttgggtggttcggttcgttttcggtggttcgggcggtacgggtaccgacgtcgtcggtccgtccgtacg

SEQ ID NO: 178013 - DNA, 533 bp, Homo sapiens
  misc_feature: GYAE6OF01EZ61J.49.24.C02.1.454.CMB.1.raw
  modified_base (498)..(498): a, c, t, g, unknown or other
  misc_feature (498)..(498): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatcccttgggaaccaagctgccctcaccatccgacggggcccaggcagatgatgaatgtgattattactgtgtgctgtatctgggttggttggtctttttcggtgttcgggnggtacggggacctaaggctcgacccgtcctaccgg

SEQ ID NO: 178014 - DNA, 543 bp, Homo sapiens
  misc_feature: GYAE6OF01C9SYE.49.24.C02.1.454.CMB.1.raw
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcacgaccccaggccaggcctccacgcacgctcatgtacgataacaaatagtcgactcttcgtcggggtccctgactcgcttctctggctccatccttggaacaagctgccctcaccntcgacggggcccaggcagangatgaatgtagtattattacttgtgtgtctgtatcgtgggtggttcggttcgtttttcggtggttcgggnggacgggtaccaaggcctacgccgtccgtaccg

SEQ ID NO: 178015 - DNA, 533 bp, Homo sapiens
  misc_feature: GYAE6OF01E1JUR.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcaccatcgacgggggcccaggccagatgatgaatgtgattattactgtgtgctgtatcgtgggttggtggttctttttcggtggttcgggcgggagggaccaagctcggtacccgtccgtaccg

SEQ ID NO: 178016 - DNA, 546 bp, Homo sapiens
  misc_feature: GYAE6OF01AY0BF.49.24.C02.1.454.CMB.1.raw
  modified_base (237)..(237): a, c, t, g, unknown or other
  misc_feature (237)..(237): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggganagtcacactcacttgtggcttgagctctggctcagtctcaactggttacctaccccagctggtaccagcacgaccccaggccaggctccacgcacgctcatgtacgatacaaatagtcgctcttcgtcggggtccctgactcgcttctctggtcctccattccgttagggaaccaagctcgccctcaccacgtccgaccggggcccaggcagatgatgaatgtgtattatactgtgtgctgtatcgtgggtggtggttcgttttcggtggttcgggacgggacgggtacagcgtcgtccgtccgtaccg

SEQ ID NO: 178017 - DNA, 811 bp, Homo sapiens
  misc_feature: GYAE6OF01CZ6VU.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggacgccatcgttgtcaggtcggtccccgggggganagtcacactcacttgtggcttgagctctggctcagtctacaacgtcggttacctacccagcctcggtaccacgccacgacccccgaggccgacggcctaccgacgccacgctcagtacgtaacgaactaactaaagttacgtccgtacttcgttccgtcggggtcccctggtacttccgtcctttcgtcgtcggtcccttaccgtacgttacccgttacggggaaacctaaacggtccttaccgtcccccttacccgtaacccgtacgtaccccgggaaccccggggggaccccgaacgggacccgtaacggtacgttacggtaagttaacgtaaagttacggtttaagttaacgtttttaacgtttaacgttggtttacggttcggttaccgtttaggttaacggttcgggttttgggggttacggggtttttcgggttttaccgggttttttttccgggttcggggtttttacccgggggtaccgggggttaacccggggttaacccggttaaccgggttacccggtttaacccgggttaacccccgggtttaccccggtttaacccgggg

SEQ ID NO: 178018 - DNA, 553 bp, Homo sapiens
  misc_feature: GYAE6OF01ENFU4.49.24.C02.1.454.CMB.1.raw
  modified_base (235)..(235): a, c, t, g, unknown or other
  misc_feature (235)..(235): n is a, c, g, or t
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (380)..(380): a, c, t, g, unknown or other
  misc_feature (380)..(380): n is a, c, g, or t
  modified_base (462)..(462): a, c, t, g, unknown or other
  misc_feature (462)..(462): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccgggggganagtcacactcacttgtggcttgagctcgtggctcagtctcaacttggttacctaccccagctggtaccngcacgaccccaggccaggcctccacgcacgctcatgtacatacaatgtcnctcttcgtcgggtcctgatcgcttcncgtgctcctatccttgggaacagctgccctcacatccgaccgggccaggcagactgatagaatgtactattatcgtagtgtntcgtgtagttcgtagggttggttcggttagttttcggtggttccggacgggtacgggtaccgaaggtcctacggtacccgtcgtaacccgg

SEQ ID NO: 178019 - DNA, 597 bp, Homo sapiens
  misc_feature: GYAE6OF01AYS7W.49.24.C02.1.454.CMB.1.raw
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (452)..(452): a, c, t, g, unknown or other
  misc_feature (452)..(452): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacaggtcacactcacttgtggcttgagctctggctcagtctcaactggttacctacccagctggtaccagccacgaccccaggccaggctccacgcacgctcatcgtacgatacaaatgtcnctctcgtcgggtccngatcgtctttctcgtggcctccactccgttaggaacaagtcctcgaccctcaccacgtccgaccggggcccacggcagngtagatacgaagttgtatatttacgttagttagtgtcgtcgttggttagttcggttgggttcgggtttcggttccgtttttcggttcgggttcgggtcgggtacgggtaccgtacggtccgtccggtacccgttcccgtacccgg

SEQ ID NO: 178020 - DNA, 610 bp, Homo sapiens
  misc_feature: GYAE6OF01BC1F2.49.24.C02.1.454.CMB.1.raw
  modified_base (237)..(237): a, c, t, g, unknown or other
  misc_feature (237)..(237): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccgaggagccatcgttgtcaggtcggtccccgggggganagtcacactcacttgtggcttgagctctggctcagtctcaactggttaccacccagctcggtaccagcacgaccccaggccaggcctccacgcacgctcatcgtacatacaaatgtcgtctcgttcgtcgggtccctgactccgtctttccgccggtcctccgacttccgttagggaacaaacgctccgcccctaccaccacgtcccggaccggggcccagggccagactgatagaatgtatacgttattacgttgtgtcgtcgttgtacgttcggttggggttcgggttcggtttcggtttttacggtcgggtttccggggacgggtaacgggtaccgtaacggtcgtaccggtacccgttcgtcgtacccg

SEQ ID NO: 178021 - DNA, 582 bp, Homo sapiens
  misc_feature: GYAE6OF01EQR58.49.24.C02.1.454.CMB.1.raw
  modified_base (305)..(305): a, c, t, g, unknown or other
  misc_feature (305)..(305): n is a, c, g, or t
  modified_base (495)..(495): a, c, t, g, unknown or other
  misc_feature (495)..(495): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactggttacctacccagtctggtaccngcacgaccccaggccaggcctccacgcacgctcatcgtacgataacaaatgtcgcttcgttcgtcgggtccctgactcgtcttctctcggcctcctattccgttacgggaactaacgtctcgccctccaccacgtccggaccggggcccacggcagatcgatagaatgtatattacttacgttgtgtgtnttgtagttcgtgggttggttcggttcgtttttcggtcgggttcgggcgggtacggtaccgacggtcgtcggtcccgtccgtaaccgg

SEQ ID NO: 178022 - DNA, 560 bp, Homo sapiens
  misc_feature: GYAE6OF01A85MX.49.24.C02.1.454.CMB.1.raw
  modified_base (236)..(236): a, c, t, g, unknown or other
  misc_feature (236)..(236): n is a, c, g, or t
  modified_base (318)..(318): a, c, t, g, unknown or other
  misc_feature (318)..(318): n is a, c, g, or t
  modified_base (480)..(480): a, c, t, g, unknown or other
  misc_feature (480)..(480): n is a, c, g, or t
tcagagtcgagagacacgaccggtgctcgatttagtacagatcgttagggaaagggaaaggccctgaggaaaacaaacccagctgggaagcctgagaacacgtagccttcatgagtgtccccaccatggcctggatgatgcttctcctcggactccttgcttatggatcaggtgtggaatctcagactgtggtcgacccaggagccatcgttgtcaggtcggtccccggggggganagtcacactcacttgtggcttgagctctggctcagtctcaacttcggttacctaccccagcctggtaccagccacgaccccnggcccgaggctccacgcacgctcatcgtacgatacaaatgtcgctcttcgtcggggtccctgactcgtcttctctggcctccactccgttaggaacaagctcgccctcaccactcgaccggggcccaggccagactgatgaatggtatattattactgtgtntctgttatcgtgggttgtggttcttttcggttgttcgggcgggacgggtaaccgtacggccgtcgtcccgtcgtaaccgg

SEQ ID NO: 178023 - DNA, 547 bp, Homo sapiens
  misc_feature: GYAE6OF01D4U3X.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttcgtcggggtccctgactcgctttctctggcctccatccttagggaacaagctgccctcaccactccgaccggggcccaggcagatgatgaatgtgtatttattacgtgttgtgtcttgtatcgtgggttggtgggttcttttcggtggttcgggcgggacgggaccaaggcctcgtcccgtccgtaccgg

SEQ ID NO: 178024 - DNA, 749 bp, Homo sapiens
  misc_feature: GYAE6OF01CT0OV.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttgtggcttgagctctggctcagtctcaacttcggttacctaccccagctggtaccagccacgaccccaggccaggcctccacgcacgctcatgtacgataacaaatgtcgctcgttcgtcggggttccctgactccgtctttcctcgttcggccttacctacgttcccgtttacggggaaacctaaacggtccgtacgtcccctaccgaacccgaacgttccccgggaacccgggggggtacccccgaacggggacccgaacggtaacgtacggtaacgttaggtaaacgtttagggttaacgttaacgtttttacgtttaaccgttaggtttaggttcggttacgtttcggtttaacggtttccgggtttaggggggtttcggggtttcgggttttccggttttttttcggggttcgggtttccgggggtaccggggtaacggggtaacccgtaacgggtaccgttacccgggtaccccgttcccggttaacccggg

SEQ ID NO: 178025 - DNA, 615 bp, Homo sapiens
  misc_feature: GYAE6OF01D2IIB.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaacttggttacctaccccagctggtaccagccacgaccccgaggccaggcctccacgcacgctcatgacgataacaaatgtcgcttcttcgtcggggtccctgactcgtctttctcgtcggcctccacttcccgttagggaaaccaaagtcctcgcccctaccaccactccggaccggggccccaggcagatgatgaatgtagtatttattacgttgttgtgtcgttgttattcggttggggttgggttcgggtttcgttttttcgggttcgggtttccggggtcggggtaacggggtacccgtaacggtccgttacgggtacccgttcccgtaaccggg

SEQ ID NO: 178026 - DNA, 587 bp, Homo sapiens
  misc_feature: GYAE6OF01AJTS8.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctctggctcagtctcaactggttacctaccccagcctggtaccagcacgaccccaggccaggcctccacgcacgctcatgtacgatacaaatagtcgctcgttcgtcgggtccctgactcgtcttctcgtcggtcctcctacttccgttagggaaccaaagtcctcgcccctccacccacgtcccggaccgggggccccgacggccagatgagtagaagtgtagtatttattactgttgtgtcgtgtagtcgttgggtggttggttcgtttttcggtggttcgggcgggacgggtaccgaggtccgtcggtaccgttccgtaccgg

SEQ ID NO: 178027 - DNA, 563 bp, Homo sapiens
  misc_feature: GYAE6OF01CNCRW.49.24.C02.1.454.CMB.1.raw
  modified_base (294)..(294): a, c, t, g, unknown or other
  misc_feature (294)..(294): n is a, c, g, or t
  modified_base (490)..(490): a, c, t, g, unknown or other
  misc_feature (490)..(490): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactggttacctacccngctggtaccagccacgaccccaggccaggcctccacgcacgctcatgtacgataacaatacgtcgctcttcgtcggggtccctgactcgtctttcgtctggccttcccattccgttagggaacctaagcctcgccctcaccactccgaccggggcccaggcagatgatgaatgtagtattattactgtgtgctgtntcgtgggtggttggttcgttttcggtcggttcgggcgggtacgggaccgaggtctcggtcccgtccgtaccgg

SEQ ID NO: 178028 - DNA, 554 bp, Homo sapiens
  misc_feature: GYAE6OF01B52S7.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganagtcacactcacttgtggcttgagctctggctcagtctcaactggttactacccagctggtaccagcagaccccaggccaggcctccacgcacgctcatgtaccgataacaaatacgtcgcttcttcgtggggtccctgatcgcttctctggcctcctactccgttagggaacaaacgtcttcgccctacaccacgtccgaccggggcccaggccagatgaatgaattgtgtaatttattactagtgtgtctgtatcgtgggtggtggttcgttttcggtggttcgggcggaggtaccgaagctcgccgtcctaaccgg

SEQ ID NO: 178029 - DNA, 698 bp, Homo sapiens
  misc_feature: GYAE6OF01EBWE6.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggacagtcacactcacttgtggcttgagctctggctcagtcctcaactggttacctacccagctggtaccagcacgaccccaggccaggcctccgacgccacgctcatgtacgatacaaatgtcgctcttcgtcgggtccctgactcgtctttctcgtcggtcttccacgttccgttagggaaacctaacgtccgttaccgcccctacgaccctacgtcccggacccgggggtcccaacgggcagagtagacgtaggaacttggttagttaattttaacgtttacgttcggttagttcggttccgtttaggttacgttccggggttgggggttttccggggtttcgggttttcccggtttttttcggggttccgggttttccggggggtaccggggttaaccgggggtaacccggtaacgggttaccccggttaccgggtttacccccggttcccgtttaacccggg

SEQ ID NO: 178030 - DNA, 667 bp, Homo sapiens
  misc_feature: GYAE6OF01B1L62.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacacgtcacactcacgttggtggtcttgagctcgtggctcagtctcaaacttcggttacctacccagtcctcggtaccagccaacgaccccgaggcccgacggcctcccgacgccacgctcatgtacataacaatagtcgtctcttcgtcgggtccctgactcgtctttcgtctcggtcctctacttccgttacggaactaagtcctacgtcccctacaacccacgtccggacccggggtcccgagggcctaaggagtagaacgttagtaagttcggttagttaacgtttaacttacgttggttaggttcgtacgttacggtttagtccgggtttgggggttaggtttcgggttttacggtttttcgggtgggtttcccgggtacgggtaacgggtaccgaggtccgtaccgttcccggtccgttaacccgg

SEQ ID NO: 178031 - DNA, 935 bp, Homo sapiens
  misc_feature: GYAE6OF01AIX59.49.24.C02.1.454.CMB.1.raw
  modified_base (242)..(242): a, c, t, g, unknown or other
  misc_feature (242)..(242): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccattcgttgtcaggtcgggtccccgggggganagtcacactcactttggtggcttgagtcttcgtggctcgtagtcctacaacgtttcggttaacctaccccgagtccgtacggtaacccaggccaaccggacccccgaggcccacggtccctacccgaccgccaccgtcctacacttcggtaaccgaactaaaccaaaacgttacggtcccgtacctttccgtttccggttcccgggggttccccttggtaaccgtttcccggtccttttccgttccgttacgggtccctttacccgtaccgtttacccggtttaacggggaaaaccgtaaaccggtcccttaccccggtacccccttacccgaaccccgtaaccgttaccccggggaaccccggggggtacccccggaaccgggaccgtaacggtaacggttacggtaacgttaacggtaaacgttacgggtttaacgtttaacgttttaaccgttttaaccggtttcgggtttacggtttacggttacccggtttaggttaaccggttttcccggggttttaggggggtttaccggggtttttccggggtttttcccgggtttttttttacccggggttccggggttttacccgggggtaaccggggggttaaacccggggtaaaccccggttaacgggttaccccggtttacccgggttaaccccccggtttaccccggttaaaccccggg

SEQ ID NO: 178032 - DNA, 614 bp, Homo sapiens
  misc_feature: GYAE6OF01D1BUW.49.24.C02.1.454.CMB.1.raw
  modified_base (237)..(237): a, c, t, g, unknown or other
  misc_feature (237)..(237): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggganagtcacactcacttgtggcttgagctctggctcagtctcaacgttggttacctaccccagtctcggtaccagcacgaccccgaggcccaggcctccgacgcacgctcatgtacgataacaaatacgtcgctcttcgtcgggtccctgactcgtcttcgtctcggcctccacttccgtacggaactaagctacgccctcaccgtacgtccggaccggggcccaggaccagatgagtagagtgtagtattagttacgtggttgtgtacgttgtagttcggtggggttcggttcggttttccgtttttcgggttcgggttccggggacgggtaacggggtacctacggtaccgttcgggtaccccgttccgtaacccggg

SEQ ID NO: 178033 - DNA, 590 bp, Homo sapiens
  misc_feature: GYAE6OF01AXK8M.49.24.C02.1.454.CMB.1.raw
  modified_base (236)..(236): a, c, t, g, unknown or other
  misc_feature (236)..(236): n is a, c, g, or t
  modified_base (388)..(388): a, c, t, g, unknown or other
  misc_feature (388)..(388): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganagtcacactcacttgtggcttgagctctggctcagtctcaactcggttacctaccccagctggtaccagcaacgaccccaggccaggcctaccacgcacgctcatgtacataacaaatgtcgtctcttcgtcgggtccctgactcgctttcncgtgctcactcctagggaaacaagctcgccctacgacacgtccggaccggggcccaggcagtacgtagatagaactgtagtatttagttacttggtgtgtctgtagtcggttggggttcggttcggtttcgtttttggtcgggtttaccgggcgggtaacgggtaaccctaaggtccgtacgtacccggttccgtaaccggg

SEQ ID NO: 178034 - DNA, 619 bp, Homo sapiens
  misc_feature: GYAE6OF01DOCKH.49.24.C02.1.454.CMB.1.raw
  modified_base (331)..(331): a, c, t, g, unknown or other
  misc_feature (331)..(331): n is a, c, g, or t
  modified_base (384)..(384): a, c, t, g, unknown or other
  misc_feature (384)..(384): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccggggggacagtcacactcacttgtggcttgagtctctggctcagtctactaacgttggttaacctacccagtctcggtaccagcacgacccaggccaggtccncacgcacgctcatacggaacataccaaatcgtcgtctcttcgtcggggtcccnggactcgtcttctacgtgcctcattccgtaggaactaagctcgccctcacacgtccggacggggtccacggcaagtcgtgagtagacgtgtagtagtttaattacgttggttgtcgttcgttaggttacgtcggttggggttcggtttcgggtttcgtttttacgggttcggttccggggacgggtaacgggtaacctaacggtcggttaccggtaccggttcccggtaacccgg

SEQ ID NO: 178035 - DNA, 564 bp, Homo sapiens
  misc_feature: GYAE6OF01ED7BQ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggggacagtcacactcacttgtggcttgagctctggctcagtctcaacttggttacctaccccagcctggtaccagccacgaccccaggccaggcctccacgcacgctcatgtacaatacaaatgtcgcttcttcgtcgggttccctgactccgctttctcgtggccttccatccgttagggaactaaagctcgccctacaccactccgaccggggcccaggcagatgatgaatgtatatttattatgtgtgcttgtattgtgggttggttggttcgtttttcggtggttcgggcgggacggtaccaaggtccgtcggtacccgtccgtacgg

SEQ ID NO: 178036 - DNA, 596 bp, Homo sapiens
  misc_feature: GYAE6OF01BJRIP.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactcggttacctaccccagcctggtaccagccacgaccccaggcccaggcctccacgcacgctcatcgacgataacaaatcgtcgctctcgtcgggtccctgactcgtcttctcgtcggcctccagtccgttaggaacaacgcctcgccctacaccacgtccggaccggggcccaggccagactagatagtaatgtagtatttagtacttgtgtcgtcttcgtagtcggttgggttgggttcggtttcgttttcgggtcggtttccggggacgggtacgggtaccgaacggtcgttacggtacccgtccgttaaccgg

SEQ ID NO: 178037 - DNA, 631 bp, Homo sapiens
  misc_feature: GYAE6OF01DCXRA.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctcgtggctcagtctacaacttcggttacctaccccagcctcggtaccagaccaaccggaccccacggcccacggccctacccacgccacgctcatacgtacaataacaaatagtcgcttcgttcgtcgggtccctgactcgtcttctctcggcctcctactccgtaggaacaacgtcctccgccctacaccctacgtcccggaccggggacccgacggcgagagtgagtagtaagtgtagttatttagttactgttagtcgtcgttgttagttccggttggggttggtttcggtttcggtttttcggttcgggttacggggacgggacgggtaccgtacggtccgttacggtcccgttccggtaccgg

SEQ ID NO: 178038 - DNA, 765 bp, Homo sapiens
  misc_feature: GYAE6OF01DMAA2.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacgttgtggcttgagctctggctcagtctcaacttggttaacctacccagctggtaccagcacgaccccaggccaggcctccacgcacgcctacatgtacgaataacaaatcgtcgcttcgtttcgtcggggttccctgtactcccgtctttcctcttcgggccttaccctacgtttacccgtttacggggaaaacctaaacggtccctacggtccccctaccgaacccgtaaccgttcccgggaacccgggggggacccccaacggggaccaagggtacttacgggtaacttaggaaagtttggttaacggttaaatttttaacgtttaccgtttaggtttggttcggttacgtttacggttaacgtttcgggtttggggggtttcggggttttcgggtttcccggttttttttccggggtttcggggtttccgggggtaccgggggtaaaccggggtaacccggtaaacggttccccggttaacggttcccccggttaacccggtttaacccggg

SEQ ID NO: 178039 - DNA, 563 bp, Homo sapiens
  misc_feature: GYAE6OF01CNXG2.49.24.C02.1.454.CMB.1.raw
  modified_base (259)..(259): a, c, t, g, unknown or other
  misc_feature (259)..(259): n is a, c, g, or t
  modified_base (404)..(404): a, c, t, g, unknown or other
  misc_feature (404)..(404): n is a, c, g, or t
  modified_base (474)..(474): a, c, t, g, unknown or other
  misc_feature (474)..(474): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgtttatggatcaggtgtggaatctcagactgtggtgacccaggagccatcgttgtcagtggtccccgggggggacagtcacactcacttgtggcttgngctctggctcagtctcaacttggttacctaccccagcctggtaccagccaacgacccccgaggcccaggcctcccacgccacgctcatgtaacgatacaaatagtcgctcttcgtcggggtccctgactcgcttctctggctccntccttagggaacaagctcgcccctcaccactccggaccggggcccaggcagatgatgatgtatattattntgtgtgtctgtgtcgtgggtggttggttcgtttttggtcgggttcgggcgggtaggaccgtaaggcttacggacccttccgtcgtaccg

SEQ ID NO: 178040 - DNA, 555 bp, Homo sapiens
  misc_feature: GYAE6OF01AKR0M.49.24.C02.1.454.CMB.1.raw
  modified_base (317)..(317): a, c, t, g, unknown or other
  misc_feature (317)..(317): n is a, c, g, or t
  modified_base (387)..(387): a, c, t, g, unknown or other
  misc_feature (387)..(387): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacaggtcacactcacttgtggcttgagctctggctcagtctcaactggttacctaccccagcctggtaccagcacgaccccnggccaggcctccacgcacgctcatgtacgatacaaatgtcgctcttcgtcgggtcctgactcgtctttcnctcgctccattccgtaggaacaagtcctcgccctcaccactccggaccggggcccacggcagatgatgatgtagtattattacgtgtgtgtcgtgtagtcgtgggttggttggttcgttttcggtggttccgggcgggtacggacgacgtcgtcgtcccgtcgtaccg

SEQ ID NO: 178041 - DNA, 621 bp, Homo sapiens
  misc_feature: GYAE6OF01DQ35J.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctcgtggctcagtctcaacttcggttacctaccccagctcggtaccagcaccgaccccaggccaggcctccacgccacgctcatgtacgataacaatgtcgcttcttcgtgggtccctgtactccgtcttcgtcgtcggtcctcctactccgttacgggaaactaacgctccgtccctaccacctacgtaccgaccgggggtccccagggcctaggacgtgactgaattgtagttaatttattacgttgttgtgtcgttagttatcggttggggtggtttcgggttcgtttttcggtcggttcggggtaccggtacggggtaaccgtaacggtcgttccggtacccgttccgtaacccgg

SEQ ID NO: 178042 - DNA, 563 bp, Homo sapiens
  misc_feature: GYAE6OF01AW8W5.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganagtcacactcacttgtggcttgagctctggctcagtctcaactggttacctaccccagctggtaccagcacgaccccaggccaggcctccacgcacgctcatcgtacgataacaaatagtcgctcttcgtcggggtccctgactcgtctttctctcggctcctatccgttaggaacaacgctcgccctcaccacgtccgaccggggcccacggacagactgatgaatgtagtattattactgtgtgtcttgtagtcgtgggttggttggttcgttttcggtcggttcgggcgggacgggtaccgaggtcgtcggtacccgtcgtaccg

SEQ ID NO: 178043 - DNA, 567 bp, Homo sapiens
  misc_feature: GYAE6OF01CSKT4.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaacttggttacctaccccagcctggtaccagcacgaccccaggccacggcctccacgcacgctcatgtacgatacaaatagtcgctcttcgtgggtccctgatcgtcttctctcggctccatccgttgggaaccaagctcgccctcaccatccgaccggggcccaggcagatgatgaagtgtagtattattacttgtgtgcttgtactcgttgggtcggttggttctttttacggttggttccgggacggggtacgggtacccgaaggcttcggtcccgttccgtaccgg

SEQ ID NO: 178044 - DNA, 613 bp, Homo sapiens
  misc_feature: GYAE6OF01A7DZ7.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganagtcacactcacgttgtggcttgagtctctggctcagtctcaactcggttacctacccagtctcggtaccagcacgaccccgaggccacggcctaccgacgcaccgctacgactgtaacgataacaaatacgtcgactcgttcgtcggggtccctgacttcgtcttccgtctcggtcctcctattccgttacgggaactaacgtcctcgtccctacgtaccacgtccgaccggggccctacgggctagacgtcgagtacgtaagtcgtagtaatttacgtacgttgtgtacgtcttagtacgtcgttgggttcggtggttcttttcggttcggttcgggtacggacgggtaccgaacggtctcggtccgtcgtaccgg

SEQ ID NO: 178045 - DNA, 589 bp, Homo sapiens
  misc_feature: GYAE6OF01A93Z3.49.24.C02.1.454.CMB.1.raw
  modified_base (238)..(238): a, c, t, g, unknown or other
  misc_feature (238)..(238): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttgtggcttgagctctggctcagtctcaactggttactacccagctggtaccngcacgacccagccaggctccacgcacgctcatnacgatacaaatagtcgctcttcgtggggtccctgactcgcttctctcggctccatccgttaggaacaagctcgccctcaccatccgaccggggcccacggccagactgactagaacgtgtacgtatttacgttaactgttgtgtcgttgttacttcggttggggttggttcggtttacgtttttcgggttggttccgggcggggtaacgggtacccgtaagggccgttcggtacccgttcccgttaacccggg

SEQ ID NO: 178046 - DNA, 874 bp, Homo sapiens
  misc_feature: GYAE6OF01B4ATH.49.24.C02.1.454.CMB.1.raw
tcagagtcgagagacacgaccggtgctcgatttagtacagatcgttagggtaaggggtaaagggccctgaggaaacaaaccccgagcctgggaagtcctcgtagaacacgtaagccttcgatcgagtgtccccaccactcggccgtggatgatgcttctccgtccggactccttgcgttagtggtattcgaggtgtggaatctcagacctgtggtcgacccgacggacgccctagtccgttggtccgacgtcggtccccggggggtactacgtcaccacgtctacgttcgtacggtccttggacgtctcgtggctacgaacgtcctcgtaaccgttcggttaacctaccccgtaagtcccgtacggtaacccgacggaccgaaccggaccccccgaagggtccccgaacggggtaccctaccccgaaccgtaaccgtaccgtaccgttaccgtaacgttacggtaaccggtaacgtaaaccgtaaagttacgtaccgtacctttccgttacggtccggggttccccttaggtaccggttccgtacccgtttaccgtccggttcggtacccttacccgtacgttaccgttaacgggaaactaacggtccgtaccggtacccgtacgacccgtacggtaccgggaccggggtaccctacggtacgtaacgttacgtagtacgtaggtagttacggtacgtaacgtttacgttacgttggtacgttcgtaccgtttacggttacggtttcgggttacgggggttcggttacggggttttcccgtttttacgggtcggggttaccggggtaacggggtaacccggtaaaccggtaacgggttacccggttaccggtaccccgggttccgtaacccggg

SEQ ID NO: 178047 - DNA, 574 bp, Homo sapiens
  misc_feature: GYAE6OF01BKDXI.49.24.C02.1.454.CMB.1.raw
  modified_base (235)..(235): a, c, t, g, unknown or other
  misc_feature (235)..(235): n is a, c, g, or t
  modified_base (378)..(378): a, c, t, g, unknown or other
  misc_feature (378)..(378): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtgtccccaccatggcctggatgatgcttctccgtcggactccttgcttatggatcaggtgtggaatctcagactgtggtgacccaggagccatcgttgtcagtggtccccgggggganagtcacactcacttgtggcttgagctctggctcagtctcaactggttacctaccccagctggtaccagcagaccccaggccaggctccacgcacgctcatgtacgatacaaatgttgctctctcggggtccctgatcgcttcncgtgctccatccttagggaacaagctcgccctcaccagtccgaccggggcccaggcagatcgatgaagtgtagtagttattacgtgtagtgtctgttactgtggggttggttggtttccgtttttcggttcggtttccggggtacgggtacgggtaacccgaagggtccgttacggtacccggttccgtaacccgg

SEQ ID NO: 178048 - DNA, 627 bp, Homo sapiens
  misc_feature: GYAE6OF01EWHY2.49.24.C02.1.454.CMB.1.raw
  modified_base (304)..(304): a, c, t, g, unknown or other
  misc_feature (304)..(304): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctctggctcagtctcaactggttacctaccccagctggtaccngcacgccccaggccaggcctccacggcacgctcatgacgatacaaatgcgctcttcgtgggtccctgactcgctttctctggctccattccgttaggaacaacgctcgccctacaccacgtccgaccgggggcccagggcagacgtagatagaagtgtagtattaattacttaggttgtcgtacgttgttaacgttcggttggggtttgggttcgggtttaccgttttttcgggtttcgggtttaccggggtaccggggtaaacggggtaacccggtaaacgggtccggttaccgggtaaccccggttcccgttaaacccggg

SEQ ID NO: 178049 - DNA, 561 bp, Homo sapiens
  misc_feature: GYAE6OF01A7VOC.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggggacaggtcacactcacttgtggcttgagctctggctcagtctcaactggttacctaccccagctggtaccagcacgaccccaggccaggcctccacgcacgctcatgtacgataacaaatagtcgctcttcgtcggggtccctgactcgcttctctggcctccatccgttaggaacaagctcgccctcaccactccgaccggggcccaggcagatgatgaatgtgtattattactgtgtgtctgtagtcgtgggttggttcggttgttttcggttggttcgggtacgggtacgggtaccgacggtacgtcggtcccgtccgtaccgg

SEQ ID NO: 178050 - DNA, 600 bp, Homo sapiens
  misc_feature: GYAE6OF01EBYI4.49.24.C02.1.454.CMB.1.raw
  modified_base (498)..(498): a, c, t, g, unknown or other
  misc_feature (498)..(498): n is a, c, g, or t
  modified_base (521)..(521): a, c, t, g, unknown or other
  misc_feature (521)..(521): n is a, c, g, or t
  modified_base (567)..(567): a, c, t, g, unknown or other
  misc_feature (567)..(567): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccattcggttgtcaggtcgggtccccgggggggacacggtcacactcacttgtcggtcttgagtctcgtggctcagtctactaacgttcggttacctacccagccttacggtaccacgccgaaccggaccccgacgggcccacggcctacccgaccgcacgctacgatacgtacgaataacaaatcgtcgcttcgttcgtcgggtcctgctcgtcttctcgtcgctcctacgtccgttacggaactaacgtctcgaccctcaccgacgtccgaccggggccacggcagntgatgatgtatattattcgtgtntgtcgtagtgttggtgggttggttcgtttgtttcggtggtacgggnggtacggtacgtagtcgtacgtccgtcgtaccg

SEQ ID NO: 178051 - DNA, 585 bp, Homo sapiens
  misc_feature: GYAE6OF01EKNVH.49.24.C02.1.454.CMB.1.raw
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganagtcacactcacttgtggcttgagctcgtggctcagtctcaactggttactaccccagctggtaccngcacgaccccaggccaggcctccacgcacgcncatgacgataacaaatagtcgctcttcgtcggggtccctgactccgtctttcctctcggtcctcctacgtccttacgggaacaagtctcgacccctacacccacgtccggaccggggtcccacgggacagacgtgacgtgtaacgtgtagtatttattacgtgtgtgtctgtattcgtgggttggttcggttctttttcggtcggttcgggacgggtacgggtacgtacgtcggtcgtccgtccgtaccgg

SEQ ID NO: 178052 - DNA, 662 bp, Homo sapiens
  misc_feature: GYAE6OF01EORDH.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcgaggtcggtccccgggggggacacggtcacactcacttgtggcttgagctcgtggctcagtctcaacttggttacctacccgagtcctcggtaccagccaaccggacccccaggcccaggcctacccgaccgccaccgcctacacgtacgtaacgaataactaaagtacgtccgcttccgttccgttcggggtcccctagtacttccgtctttccgtcgtcggtcctccctacgttcccgttaagggaaccaacgtccttaccgcccctacaacccgtacgtaccggacccggggcccgacggacgagtacgtgagtagtaagttgtagtatttagttacgttgtgtgtcgttgtagttcggtgggttgggttcggtttcgttttcggtcgggttccgggtacgggacgggtaccgacgtccgtcggtacccgtccgtacccgg

SEQ ID NO: 178053 - DNA, 733 bp, Homo sapiens
  misc_feature: GYAE6OF01CMH1E.49.24.C02.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (327)..(327): a, c, t, g, unknown or other
  misc_feature (327)..(327): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcagtcggtcccgggggganagtcacnctcacttgtggcttgagctcgtggcctcagtctacaacttcggttaacctaccccgagtcctcggtaccacgccaacgaccccnggccagcctccacgctacgctcatgaacgatacaatgtctctcttcgtcgggtcctgtacgtccgtctttccgtcgttcggccttcctacgttccgttacgggaacctaaacgtcctaccgtccccttacctaacccgacgttacccgggaacccgggggccccgaacgggtacgacgtaacgtagtaagttacggtaaacgttaggttacggttaacgtttaacgtttaccgttaggtttacggttcggtacgtttaggtttacggttccggtttgggggttcgggttttaccgggttttcggtttttttcccgggttggggtttaccgggtaaccgggggttaacgggtaacccggttaacggtcccggtttaccggtaccccgggttacccgttaaccccggg

SEQ ID NO: 178054 - DNA, 619 bp, Homo sapiens
  misc_feature: GYAE6OF01DKB2H.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaacttggttacctaccccagctggtaccagccacgacccaggccaggcctccacgcacgctcatcgtacgataacaaatagtcgtctcttcgtcggggtccctgactcgtcttctctggcctcctacttccgtagggaacaaagcctcgtccctaccaccacgtccggaccgggggcccagggcaagagtagagtagaagttgtagttatttattacgttgttgttgtcttgttagtcggttggggttgggtttcgggtttcggttttttcggttcgggtttccggggacgggtaacgggtaaccgtaacggtccgttaccggtcccgttcccgtaacccgg

SEQ ID NO: 178055 - DNA, 594 bp, Homo sapiens
  misc_feature: GYAE6OF01BW5KG.49.24.C02.1.454.CMB.1.raw
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganagtcacactcacttgnggcttgagctctggctcagtctcaacttggttacctaccccagtcctacggtaccagccacgaccccaggccaggcctccacgccacgctcatcgtacgataacaaatagtcgacttcttcgtcgggtccctgactcgtcttctcgtcggctccagttccgttagggaactaacgtcctcgccctacaccagtaccggaccggggcccaggcagatgatacgaatgtagtatttagttacgttgtgtcgtcgtgttagtcgttaggggttgttcggtttcgttttcgggtggttcgggacgggtacggtaccgtaggtccgtaccggtcccgtccgtaccgg

SEQ ID NO: 178056 - DNA, 527 bp, Homo sapiens
  misc_feature: GYAE6OF01D3EEV.49.24.C02.1.454.CMB.1.raw
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttactaccccagctggtaccagcacgaccccaggccaggcctccacgcacgctcatgtacgataacaaatagtcgctcttcgtcggggtccctgactcgctttctctggcctccatccgttgggaacaagctcgccctcaccatccgacggggcccaggcagatgatgaatgtagtattattactgtntgctgtntcgtgggtggtgtcttttggtgtcggnggacggcagctcgtccgtcgtacg

SEQ ID NO: 178057 - DNA, 575 bp, Homo sapiens
  misc_feature: GYAE6OF01BWNHM.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttgtggcttgagctctggctcagtctcaactggttacctaccccagctggtaccagcacgaccccaggccaggcctccacgcacgctcatgtaacgataacaaatgtcgcttcttcgtcggggtccctgatccgtcttctcgtcgcctccatccgttacgggaacaaagtcctcgcccctcaccacgtccggacccggggcccacggccagagtgagtgaatggtagtattattacgtgtgtgtcttgtagtcggttgggttggttcggtttcgttttcggtggttcgggcgggtacgggaccaggcgtcgtcccgtcgtaccgg

SEQ ID NO: 178058 - DNA, 660 bp, Homo sapiens
  misc_feature: GYAE6OF01BYZG1.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcggtcccggggggacacgtcacactcacttggtggtcttgagtctctggctcagtctcaactcggttacctaccccagctcggtaccacgcacgaccccaggcccaggcctccacgccacgctccatcgtaacgataacaaatacgtcacttcgttccgtcggggttccctgtacgtccgtctttctcgtggtcctccgtacttccgttagggaaacctaaacgtcctccgaccctaccaaccgtaccgtaccgaaccgggggccccacggccgaacggtacgtagtaagtagtaagttgtagtaatttacttacgtgttaggtgtcgtagttcgttggttggggttgggttcggtttcggttttttcgggtcgggtttccggggacgggtacggggtaccgtacggtccgtacggtaccccggttccgttaacccgg

SEQ ID NO: 178059 - DNA, 555 bp, Homo sapiens
  misc_feature: GYAE6OF01AWU5L.49.24.C02.1.454.CMB.1.raw
  modified_base (237)..(237): a, c, t, g, unknown or other
  misc_feature (237)..(237): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (474)..(474): a, c, t, g, unknown or other
  misc_feature (474)..(474): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgcaggtcggtccccggggggganaggtcacactcacttggtggcttgagctcgtggctcagtctcaactggttaccacccagcctggtaccagcacgaccccgaggccaggctccacgccacgctacntcgacatacaaatcgtcnctcttcgtcgggtcctgatcgtcttcgtctggcctcattccgtaggaacaacgctcgccctcacacgtccgaccgggcccaggcagntgatacgatgtnattattcgtgtagtntctgtacgtcgtggggtgttggtttcgttttcggtggttcggacggtacgggactaaggtcctacggtaccgtccgtacgg

SEQ ID NO: 178060 - DNA, 647 bp, Homo sapiens
  misc_feature: GYAE6OF01C7NJ9.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacaggtcacactcacttgtggcttgagctcgtggctcagtctcaactcggttacctacccagtcctggtaccagaccacgaccccaggccaggcctccacgccacgctcatcgtacgatacaaatcgtcgtctcgttcgtcgggtccctgtactcgtcttctcgtcggtcctccacgttccgttaagggaaccaacgtctccgcccctacaacctacgtccgggacccggggacccagggacaacgtataggactagtaagttgttacgtatttaagttacgttggttagtcgtcgttgttacgttccggttaggggttcgggtttcggtttccgtttttcgggtcgggtttcggggaccgggtaacgggtaccgtacgggtaccgtaccggtacccgttcccgtaacccgg

SEQ ID NO: 178061 - DNA, 582 bp, Homo sapiens
  misc_feature: GYAE6OF01EY8IU.49.24.C02.1.454.CMB.1.raw
  modified_base (492)..(492): a, c, t, g, unknown or other
  misc_feature (492)..(492): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtgcttgagctctggctcagtctcaactggttacctaccccagctggtaccagccacgaccccaggccaggcctccacgcacgctcatgacgataacaaatgtcgctcttcgtcgggtccctgactcgtcttctcgtggtcctcctacttccgttagggaacaacgtcctcgcccctcacctacgtccggaccggggcccaggacagagtgatgaagtgtagtatttattactgtgtgtntgtagtcggtgggttggttcggttcgtttttcggtcgggttcgggtcgggtaacgggtaccgtaggtccgtcggtacccgtccgtaccgg

SEQ ID NO: 178062 - DNA, 544 bp, Homo sapiens
  misc_feature: GYAE6OF01A7B32.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatgtcgctcttctgggtccctgatcgcttctcgtggcctccactccgttagggaacaagctcgccctcaccatccgacggggcccaggcagatgatgaagtgtagtatttattacttgtgtgctgtatcgtgggtggttggttcttttcggtggttcgggtcggacgggtaccaacggtcgtcggacccgtccgtaccgg

SEQ ID NO: 178063 - DNA, 1061 bp, Homo sapiens
  misc_feature: GYAE6OF01C9I8T.49.24.C02.1.454.CMB.1.raw
tcagagtcgagagacacgaccggtgctcgatttagtacagatcgttagggaaagggggaaaaggcccgtgaggaaaacaaaccccagctgggaagcctggagaacacgtagccttcatgagtgtccccaccatggcctggatgatgcttctcctcggactccttgcttatggatcaggttgtggaatctcagactggtggtcgacccgagggtacgcctagttccggtttgtccgtagggttcgggtaccccccggggggggggactaacgggttaccaaccgtaaccgttaccgtaaccgtttttcgggttaccggggtttccttttagggaaccggttcccgttccggtttacgggggtccctttaccccggtaaacgggtttcccttaacccgtaaaacccgttttaccggggtttttaaaccccgttaaccccccccggtaagggttacccgtttacccggggttaaaccccgaaccggttaaccccggtaaccccggtaaaccccccggaccggggtaccccggtaacccggggaccccggttacccccggaacccgggtcccgtaaccccggtaccgttaccgtaacgttaacgggttaaaccggttaacttaaaccgtaaaaacgttaacgggttaccgttaccgtttaccgttttccggggtttaccggggttcccgttacggtaaccggttccggtttcctttaccggttccgtttccgggtaccctttaccccggttaacgtttacccgggttaaccggggtaaaacctaaccgtacccgttacccggtaccccttacccgaaacccgttacggtacccggggtaaccccggggtacccgaaccggacgacgtaacgtacgtaacgttagtaacgttaggttaacttaagtttaacttagttcggttaggtacttacggttacgttacgtccgggttaggggttcgggtttacggttttcggtttttcgggttcgggttaccggggtacggggtaaccgggtaaccggtaagggttcccggttacggtccccggttaaccggttacccggg

SEQ ID NO: 178064 - DNA, 785 bp, Homo sapiens
  misc_feature: GYAE6OF01CPKUI.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatccgttgtcaggtcggtccccggggggganagtccacactcacttgtggcttgagtctctggctcagtctacaacttcggttacctaccccagcctggtaccagcacgaccccaggccaggcctccacgcacgctacatgtaacgataacaaatagtacgtctcgtttcgtcggggtcccctggtacttccggtctttcgtccgtagggcccttacccgtacgtttacccggtttaggggaaaacctaaacggtcccttacccggtacccccttacaaaccccgtacgttacccggggaacccggggggacccccaaacggggccgtaacggtaacgttacggtaaacgttaggtaaagttcgggttaacgtaaacgttttaacgtttacgttgggtttaggttcggtaccgttttggttaacgttccgggtttggggggtcgggttttcgggtttcccggttttttttcggggttccgggttttaccgggggtaccggggtaaacgggggtaccccgtaaagggttccccgggtttaaccggttaacccccgggtttcccggttaaaccccgggg

SEQ ID NO: 178065 - DNA, 759 bp, Homo sapiens
  misc_feature: GYAE6OF01AJ8SA.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactggtggtcgacccgaggagccagttcgttgtctaggtcgggtccccgggggggacacgtccaccactctacgttggtggtcttggacgtcttcgtggtcctctaggtcctactaacttcggttacctaccccgagtccgtacggtaccagtccgaccgaccccgacggccgacggcctcccgacgcaccgctacactgtacaactacaaagtcgtacgtcttcgttcgtcgggtccctgacgttccgtactttccgtcgtacgggtccttacccgtacgttcccggttaacgggtaacctaacggtccctaccgacccctaccgaccctacggtacccgggacccgggggacccgaacggcgaaggtagtacggtacgtaggtaagttggtacgtttaactttagtttaacgttcggttacgtcgttacggttgttacggttcgggttacggggtttgggtttacgggttttccgttttttcggggttcgggtttcccggggacggggtaacccgggttaaccggacgggttaccgtacccggggttacccgttcccgttaacccggg

SEQ ID NO: 178066 - DNA, 708 bp, Homo sapiens
  misc_feature: GYAE6OF01A18EH.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtgacccaggagccatcgttgtcaggtcggtccccggggggganagtcacactcacttggtggcttgagctcgtggcctcagtctcaacttcggttacctacccagcctcggtaccagccacgaccccaggcccaggccctaccgaccgccaccggcctacagttcgtaacgaactaacaaaagttacgtccgtcttccgtttccggtccgggggttcccctggtaccgttccgtccttttccgtccgtggtcccttcccgtacgttcccggttaacggggaaacctaaacgtcccgtcccgtaccccctacctacccgtacgtacccgggaccccggggggccccgaacgggaccacgggtacttggaacgttagtaagttcgttagtacttttaacgttcgttgtggttcgtcgttggttacgttcggttggggttcgggttggttttccgttttgggtcggtttcgggcgggtacggaccgtacggtccgtacgtcccggttccgtacgg

SEQ ID NO: 178067 - DNA, 649 bp, Homo sapiens
  misc_feature: GYAE6OF01BIOQ6.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactcggttacctaccccagctggtaccagccacgaccccaggccaggcctccacgccacgctcatcgtacataacaaatacgtcgcttcttcgtcggggtccctgtactccgctttccgtcgtcggtcctcctacgttcccgttagggaaaccaacggtcctccgaccccttccaccgtacgtcccgggaccgggggcccacggccagtacgtagagtagaagttgttagttaatttaagttacgttgttcgtcgtgttacgttagttcgggttggggtttcgggttcggttttccggtttttcgggtcgggttaccggggacgggtacgggtaacctacggtccgtccggtacccggttcccgtaaccgg

SEQ ID NO: 178068 - DNA, 700 bp, Homo sapiens
  misc_feature: GYAE6OF01DC1B6.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtaggccgttcatgagtgtccccaccatggcctggactgatgcttctcctcggacttccttgcttatggatcaggtgtggaatctcgagacgtggtggtcgacccagggagccatcgttgtcaggtcggtcccggggggacaggtccacactcacgttgtcggtcttgagtctcgtggcctacgacgtctaccaacgttcggttaacctaccccgtagtcgtacggtacccagaccaaccgtaccccgaggtacccgaacggaccctacccgaaccgccgaaccgtcctaccacgttacgtaaccgtaataacgtaaattacgtcgtcttaccgttcggttcgggtccctgtacttcggtccttcgtcgttcgtccttacacgttccgttaggaaactaagcctaccgaccctaccgaccacgtccgggaccgggcccaggcagtactgagtcgaattggtagttaagtttatacgttgttacgtgtcgttacgttacgtcggttagggttcggtttacggtttcgtttttggttcgggttacgggacgggtaacgggtaccgtacgggtccttaccggtcccgttacgtacccgg

SEQ ID NO: 178069 - DNA, 709 bp, Homo sapiens
  misc_feature: GYAE6OF01BCN83.49.24.C02.1.454.CMB.1.raw
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccgaggacgccatcgttgtcaggtcgggtccccggggggacacgtcacactctacgttggtggcttgagtctcgtggctcagtcctctaacttcggttacctacccagtctcggtaccagacacgaccccnggccaggccnccacgcaccgctcactgtaacgaataacaaatgtctcttcttcgtccgggtcctgtacttccgtccttcgtcgtaccggtccttacctacgttcccgttaacgggaaactaacgtccctcgtacccctacgaccctacgtccccgggaccggggtacccgacggtaccagtacgtacgtaagttaggaaacgtttacgtaagttaactttaacgtttagttcggttcggtttagtccggtttaggttacggtttcgggtcgggggttttgggttccggtttttcggtttttcggggttcggttaccggggtaccggggtaaacgggtaccgtaacggtcgtttacccggccccgttccgtacccggg

SEQ ID NO: 178070 - DNA, 871 bp, Homo sapiens
  misc_feature: GYAE6OF01DFTRG.49.24.C02.1.454.CMB.1.raw
tcagagtcgagagacacgaccggtgctcgatttagtacagatcgttagggaaagggaaaaggccctgaggaaaacaaacccagctgggaagcctgagaacacgtagccttcatgagtcgtccccaccatggcctggatgatgcttctcctcgactccttgcttatgatcaggtgtggaatctcagactggtggtcgacccgaggacgccagttcggttgtcgaggtcgggtccccggggggacacgtcacactctacttgtggtcttgagtctcgtggcctgacgtctacctaacgttcggttacctaccccgagtccgttcggtaaccacgaccaaccggaacccccgagggacccgaacgggcccctacccgaccgccgaaccgtcctacgtaacgtacggttaaccgaaacttaaaccgtaaaacgtttacggtcccgtcgtttccgtttccgggtttaccggggtccccttgtaccgttcccgtccgttttcgtccgttaccgggtccttacccgttacgttacccggttacgggaaacgtaaacgtcccgtacccgtaccctaccacccgtaccggtacccgggacccgggggtaccccgacgggaccgtaacggtaacgtacgtaacgttaaggttaaacgttgggtttaacgttacgttttaacgtttaacggttgttcgggtttcgttacggtttacggttttaggttccggggtttacgggggtttcggggttttccgggtttttacggttttttccggggttccgggttttacccgggggtaaccggggtaaccggggttaaccccggtaacgggttacccggtttcccggggttaaccccgttaccccggttaacccggg

SEQ ID NO: 178071 - DNA, 799 bp, Homo sapiens
  misc_feature: GYAE6OF01D3PI6.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtcgtccccaccatggcctggatgatgcttctcctcggactccttgcttatggatcgaggtgtggaatctcagactggtggtacgacccgagggacgcctattcggtttgtcgagggttccgggtccccgggggggacacggtccacactcacttggtcggcttgagctcgtggctcagtcctactaacgttcggttacctaaccccagcttacggtaccagccgacggccccgaggcccacggcctcccaccgcacgtctacagttacgtaacgtaataaaccaaagttacgtccgtacttccgtttcggtccggggtccccttaggtacttccggccttttcgtccgttcgggtacccttaccctacggtttacccgttacggggaaaacctaacggtcccgttacctccccgtaaccctaaccgtaccggttaccccgggaaccccggggggccctaacgggacgtaacggtaacgtacggtaagtaacggtaagtttaggtagttaacttttaacgtttcgttaggttcgttcggtacgtttggttacggttgggtttcgggggtttcgggtttcgggtttttccgttttttacggggtcggggtttccggggtaccggggtaacggggtacccgtaacggtaccgtttaacccgggtccccggttccgtaaccccggg

SEQ ID NO: 178072 - DNA, 564 bp, Homo sapiens
  misc_feature: GYAE6OF01A9M44.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggctccacgcacgctcatgtacatacaaatagtcgctcttctcggggtccctgactcgctttctctggcctccattccttgggaacaagtctcgccctacaccactcgacggggcccaggcagatgatgaatgtactattacttactgttagtcgtactggtattccgtggggttcggttgggttcgtttttcggtggtttcgggcggaacgggtacccaaggtccgtcggtacccgtcgtaaccgg

SEQ ID NO: 178073 - DNA, 596 bp, Homo sapiens
  misc_feature: GYAE6OF01BU12N.49.24.C02.1.454.CMB.1.raw
  modified_base (359)..(359): a, c, t, g, unknown or other
  misc_feature (359)..(359): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactcggttacctaccccagctggtaccagccacgaccccaggccaggcctccacgcacgctcatgtacatacaaatcgtcnctcttcgtcggggtccctgactccgtcttctcgtcggtcctcctattccgttagggaacaagtcctcgccctcaccacgtccggaccggggcccaggcagatagatagaagtgtagtatttatacgttgtgtgtcgttgttagttcggttggggttggttcgggtttcgttttcggtcgggttaccgggtcgggtaacgggtaccgtacggtcgtccggtacccggttccgtaccgg

SEQ ID NO: 178074 - DNA, 568 bp, Homo sapiens
  misc_feature: GYAE6OF01CG29Y.49.24.C02.1.454.CMB.1.raw
  modified_base (357)..(357): a, c, t, g, unknown or other
  misc_feature (357)..(357): n is a, c, g, or t
  modified_base (426)..(426): a, c, t, g, unknown or other
  misc_feature (426)..(426): n is a, c, g, or t
  modified_base (457)..(457): a, c, t, g, unknown or other
  misc_feature (457)..(457): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctctggctcagtctcaactggttacctaccccagcctggtaccagcacgaccccaggccaggcctccacgcacgctcatgacgataacaaatgtcnctcttcgtcggggtccctgactcgtcttctcgtggctccatccgttagggaacaagctcgccctcaccntcgacggggcccaggcagatgatgaatggtntattattactgtgtgtctgtatcggttgggttggttcggttcgtttttcggtcgggtttccgggacgggtaacgggtacctaaggccgtacggtacccgttccgtaaccgg

SEQ ID NO: 178075 - DNA, 584 bp, Homo sapiens
  misc_feature: GYAE6OF01C7O0A.49.24.C02.1.454.CMB.1.raw
  modified_base (434)..(434): a, c, t, g, unknown or other
  misc_feature (434)..(434): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagtctctggctcagtctcaacttcggttaacctaccccagcctaggtaccagcacgaccccaggccaggcctccacgcacgctcatgtacataacaaatagtccgctcttcgtcggggtccctgactcgtcttctctggctcctatccgttagggaacaagctcgccctacaccncgtccgacggggcccaggcagatgatgaattgtagtattattacgtgttgtgtcttgttacgtggttggggtggttcggttcgtttttcggttcgggttccgggacgggacgggtaccgaaggtccgttacggtcccgttccgtacccgg

SEQ ID NO: 178076 - DNA, 578 bp, Homo sapiens
  misc_feature: GYAE6OF01EX6JM.49.24.C02.1.454.CMB.1.raw
  modified_base (305)..(305): a, c, t, g, unknown or other
  misc_feature (305)..(305): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactggttacctaccccagctggtaccngcacgaccccaggccaggcctccacgcacgctcatcgtacgatacaaatagtcgctcttcgtcgggtccctgactcgtcttctctggctccatcccgttagggaacaacgctcgccctcaccagtccgaccggggcccaggcagatgatgaatggtagtattattacgttgtgtgcttgtagttcgtgggttggttcggttgtttttcggtcgggttccgggacgggtacgggtaaccgtaggcccgttacggtacccgttcccgttaaccgg

SEQ ID NO: 178077 - DNA, 653 bp, Homo sapiens
  misc_feature: GYAE6OF01CGNWO.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggagccatcgttgtcaggtcggtccccggggggganagtcacactcacttgtggcttgagctctggctcagtcctacaacttcggttaacctaccccagctcggtaccagccacgaccccgaggccaggcctccacgccacgctcatgtacataacaaatgtcgtctcttcgtgggtccctgatcgtctttctctggcctcctacttccgttacgggtaaacgaaacgactcgtccctaccaaccacgtaccggaccgggggacccgacggacgacgaagtacgtagtagtaagtagttagtaagtttagtttaacgttgttggtgtcgttgttagttcggttgggttgggtttcgggtttcgtttttcggtttcgggtttcgggtcggggtacgggaaccggtttttttttttaacggaccgttacggtacccggttcccgtaacccgg

SEQ ID NO: 178078 - DNA, 665 bp, Homo sapiens
  misc_feature: GYAE6OF01CZIT1.49.24.C02.1.454.CMB.1.raw
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcggtccccggggggganacgtcacactcacttgtggtcttgngtctcgtggctcacgtctactaaacgttcggttaacctacccagtcctcggtaccagccacgaccccgaggccgacggcctccgacgcaccgctacagtacgtacgaataacaatacgtccgtcttcttcggtcgggttccctgtactcgtctttcctcgtcggcctccacgttccgttagggaacctaacgcctaccgccctaccacccgacgtcccggaccggggcccacggcaagactgaagtagaacgtgtagttaacttagttacgttgttgtgtcgttgttagttcggttggggttcgggttcggttttcggtttttcgggttcgggttaccggggtacgggtaaccgggtaaccgtaacggtcccgttacgggtacccggtcccggttaaccgg

SEQ ID NO: 178079 - DNA, 631 bp, Homo sapiens
  misc_feature: GYAE6OF01EFW5W.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccattcgttgtcgaggtcggtccccgggggggacagtcacactcacttggtggcttgagctctggctcagtctcaacttcggttaacctaccccagctacggtaccagcacgaccccaggccaggcctccacgcacgctcatgtacgataacaaagtcgtcgctcgttcgtcgggtccctggactcgtcttctcgtcgccttccattcccgtaggaaacctaagcctcgcccctacgaacctacgtccggacccgggtcccaggccagtatgatagtaacttgtagtagttttacgttacgttgttgtcgtcgttgttagttcggtgggttggttcggttttcggtttttacgggtgggttaccgggacggggtacgggtaacccgtacggtacccgttaccggtacccggttccgttaacccgg

SEQ ID NO: 178080 - DNA, 567 bp, Homo sapiens
  misc_feature: GYAE6OF01AEM96.49.24.C02.1.454.CMB.1.raw
  modified_base (487)..(487): a, c, t, g, unknown or other
  misc_feature (487)..(487): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacacgtcacactcacttgtggcttgagctctggctcagtctcaacttggttacctaccccagctggtaccagccacgaccccaggccaggcctccacgccacgctcatcgtacgatacaaatagtcgcttcttcgtcggggtccctgactcgtcttcgtctggcctcctatccgtaggaacaacgcctcgccctcaccactccggaccggggcccacggcagatgatgaatgtagtattattcgtgtgtgntgtagttcgtgggtcggttgttcgttttcggtcggttcgggcgggacgggtaccgagcgtccggtcccgttccgtaccgg

SEQ ID NO: 178081 - DNA, 607 bp, Homo sapiens
  misc_feature: GYAE6OF01CB5OV.49.24.C02.1.454.CMB.1.raw
  modified_base (367)..(367): a, c, t, g, unknown or other
  misc_feature (367)..(367): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacagtcacactcacttgtggcttgagctctggctcagtctcaacttcggttacctacccagtctacggtaccagccacgaccccgaggccacggcctccgacgcacgctcatgtacgataacaaatacgtcncttcgttcgtcgggtcctgactcgtcttcgtcgtggtcctcctacttccgttacgggaacaacgtctcgccctacaccacgtccggaccggggccaggcagagtgatgtaatgtagtattattacgtgttgtcgtgtgttacgttcggttgggttggtttcggtttcgtttttcgggttcgggttccgggtacgggtacgggtaccgtaacggtccgtacggtacccgttccgtaaccgg

SEQ ID NO: 178082 - DNA, 808 bp, Homo sapiens
  misc_feature: GYAE6OF01DOHWL.49.24.C02.1.454.CMB.1.raw
  modified_base (244)..(244): a, c, t, g, unknown or other
  misc_feature (244)..(244): n is a, c, g, or t
tcagagtcgagagacacgaccggtgctcgatttagtacagatcgttagggaaagggaaaggccctgaggaaaacaaaccccagctgggaagcctgagaacacgtagccttcatgagtcgtccccaccatggcctggatgatgcttctcctcggactccttgcttatggatcgaggtgtggaatctcagactggtggtcgacccgaggacgcctatcgttgtcgaggtcgggtccccgggggganacgtcactactctacgttggtcggtcttggacgtccgttcgtcgggcctacgtacggttcctacgtaaccgttcggttaaccctaccccgaggtccgtacggtaccacgaccgaaccgaccccgagggcccacggtccctccgaaccgcaccgtcctacgtagtacggtaacgaactaacgtaaaagtccggtccgtcttccgtttacggtccggggtaccctggtacttccgtctttcgtacgtcggtcctaccgtacgttaccgttaacgggaaccgaacgtccgtacccgtacccttaccgaacccgtacggttacccgggacccggggaccctaaccgggacgtaaaccgggtacgttaaggtaccgttaaggtaacgtttacggttacggttaaactttttacggttaaccgtttggttcgttacgtaccggttagtttacggttccggttgggggtttaccggttcggttttacggtttttcggtccggggtttacgggaaccggggtacggtacccgtacggttaccgtacccggttcccgtaacccggttacccgg

SEQ ID NO: 178083 - DNA, 579 bp, Homo sapiens
  misc_feature: GYAE6OF01A9QGP.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccggggggacagtcacactcacttgtggcttgagctctggctcagtctcaactggttactacccagctggtaccagcagaccccaggccaggctccacgcacgctcatgtacgactacaaatagtcgcttcttcgtcggggtccctgtactccgtctttctcgtggcctccatccgttagggaacaagctcgccctcaccacgtccgaccggggcccaggcagacgtgactgaattcgtagtaactttagttacttggtgtgtctgttattcgtgggttggttgggttctttttcggtcggtttacgggcgggaacggggtacctaacggccgttacgtacccggttccgtaccgg

SEQ ID NO: 178084 - DNA, 608 bp, Homo sapiens
  misc_feature: GYAE6OF01CWS31.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctctggctcagtctcaacttcgttacctacccagctcggtaccagcacgacccgaggccgaggcctccacgccacgctcagtacgtaacgactaacaaatacgtcgtcttcgttcgtcggggttccctgtactccgtctttctcgtcggccttcctacgttccgttagggaaacaacgtcctcgccctacacccacgtccggaccggggcccaggcagactgatgaatgtacgtattattacgtgtgtgtcgtgtagtcggtgggtggttcggtttcgtttttcgggtcgggttccgggacgggtaacgggtacccgaacggtcgtaccggtcccgttccgtaccgg

SEQ ID NO: 178085 - DNA, 603 bp, Homo sapiens
  misc_feature: GYAE6OF01A60UK.49.24.C02.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (486)..(486): a, c, t, g, unknown or other
  misc_feature (486)..(486): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacngtcacactcacttgtgcttgagctctggctcagtctctaactcggttacctacccagctcggtaccagccacgaccccnggccacggcctccgacgcacgctcatgtacgataacaaatgtcgcttctcgtcgggtccctgtactcgtcttctcgtcggtcctcctacttccgttacggaactaaacgtcctcgccctacctacctacgtaccggaccggggcccacggcagcgtagatagatagtntagttattacgttgtgtgtcgtgtcgtcggttggggttcgggttcggtttcgttttcgggttcggttcgggtacgggtacgggtaccgtaacgtccgtacggtcccgttccgtaccg

SEQ ID NO: 178086 - DNA, 805 bp, Homo sapiens
  misc_feature: GYAE6OF01BGITQ.49.24.C02.1.454.CMB.1.raw
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgcctattcgttgtcgtacggttcgggtcccccggggggggatacggtccaacctaccttccgtacgtttggtggtcctttggacgtcctcgtggccttcagttcctactaacgttcggttaccctaccccgagtccgttacggtaccacggaccaaccggacccccgagggccccacgggccctcccgaaccgccaaccggtcctactagttacgtaaccgaacttaaaccaaagttacgtccgtccttccgtttcgtccggggttccctggtacttccgttctttccgtccgttacggtcccttccgtacgtttcccggttaagggaaacctaacgtcccgttacccgtaccccttaccgaacccctacggtccccgggaaccccgggggtacccgaacgggaccctaggtaacgtggtaacgttacggtaagttacggttaagttaacgtttttaacgtttacggttgtttcggttgttccgttaggtttacgttcgggttaggggtttcggttcggtttttcggttttcgggttcgggtcgggtacgggaacgggtaccgtacggtcggttaccggtcccggttaccgtacccgg

SEQ ID NO: 178087 - DNA, 689 bp, Homo sapiens
  misc_feature: GYAE6OF01AHPIM.49.24.C02.1.454.CMB.1.raw
  modified_base (331)..(331): a, c, t, g, unknown or other
  misc_feature (331)..(331): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacagtcacactcacttgtgcttgagctcgtggctcagtctcaactcggttacctacccagctcggtaccagccacgaccccaggccaggcctaccncgcacgctcatgtacgataacaaatgtcgtctcttcgtcgggtccctggtactccgtctttccgtcgtcggtccttccgtacttcccgttagggaaacctaacgtccgtccgcccctaccaacccgtacgtcccgggacccgggggtaccccagggacccgaagtacgtcggaacgttaggtaagttcggttaagttaagttttacgtttacgttgttggttcgttacgttagttacgtttccgggttggggtttacgggtttcgggtttcggttttttcgggtcggggtttaccgggacggggtaccggggtaacccgtacggttacccgttacggtcccggttccggttaacccgg

SEQ ID NO: 178088 - DNA, 569 bp, Homo sapiens
  misc_feature: GYAE6OF01A5WZ7.49.24.C02.1.454.CMB.1.raw
  modified_base (360)..(360): a, c, t, g, unknown or other
  misc_feature (360)..(360): n is a, c, g, or t
  modified_base (450)..(450): a, c, t, g, unknown or other
  misc_feature (450)..(450): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaacttggttacctaccccagctggtaccagcacgaccccaggccacggcctccacgcacgctcatcgtacgatacaaatgtcnctcttcgtcgggtccctgactcgtcttctcgtgcctccattccgtaggaacaagctcgccctcaccacgtccgaccggggcccaggcagntgatgatgtgtattatcgtgtgtgtctgttagtggttggggttggttcggttcgttttcggttggttccggggacgggacgggtaccgtaacggtccgtacggtcccgtccgtaaccgg

SEQ ID NO: 178089 - DNA, 548 bp, Homo sapiens
  misc_feature: GYAE6OF01C4MJ8.49.24.C02.1.454.CMB.1.raw
  modified_base (420)..(420): a, c, t, g, unknown or other
  misc_feature (420)..(420): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtccacactcacttgtggcttgagctctggctcagtctcaactggttacctaccccagctggtaccagcacgaccccaggccaggcctccacgcacgctcatgtacgataacaaatagtcgctcttcgtggggtccctgactcgtcttctctggctcactcctggaacaagctgccctcaccntcgacggggcccaggcagatgatgaatgtagtatttatattgtgtgcttgtatcgtgggtggttggttcgtttttcggtggttcgggcgggtacgggtaccgaagtccgtcggcccgttccgtaaccg

SEQ ID NO: 178090 - DNA, 691 bp, Homo sapiens
  misc_feature: GYAE6OF01DCM4L.49.24.C02.1.454.CMB.1.raw
  modified_base (241)..(241): a, c, t, g, unknown or other
  misc_feature (241)..(241): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtcgtccccaccatggcctggatgatgcttctcctcggactccttgcttatggatcaggtgtggaatctcagactggtggtgacccgaggacgccatcgttgtcgaggtcgggtcccgggggganagtcacactcacgttgtgctgagctcgtggctctagtctacaacttcggttaccaccccgagcgttacggaccacgacgaccgaaccccgaggcccaggccctaccgacggccacgcctacatcggtaaccattaacaaatcgtccgtactcgtttcgccgggtccctgtactcgtccttctcgacggtcctccgtacgttaccggttaacgggaaacctaacggtccctaccgtacccctaccaaccctacggtaccgggaccccgggggacccacgggacacggtagtacggataacgtaacgtggttagttatttaacgttactaggtgttagccgttaggttcgttcgggtagggtttcggttcggtttccgttttttcgggttccggggtacgggtccgggaacgggtaacccaggtccgttaccggtcccgtccgttaaccggg

SEQ ID NO: 178091 - DNA, 576 bp, Homo sapiens
  misc_feature: GYAE6OF01BA4T8.49.24.C02.1.454.CMB.1.raw
  modified_base (490)..(490): a, c, t, g, unknown or other
  misc_feature (490)..(490): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttggtggcttgagctctggctcagtctcaactggttacctaccccagctggtaccagcacgaccccaggccaggcctccacgccacgctcatgtacgaatacaaatagtcgcttcttcgtcggggtccctgactcgcttctcgtcggcctcctacttccgttagggaacaacgctcgcccctcaccacgtccggaccggggcccaggcagatgagtgatgtagtattattactgtgtgtntgtagtcggtgggtggttcggttcgttttcggtggttccgggacgggtacgggtaccgtaggtccgtcggtcccgttccgtaccgg

SEQ ID NO: 178092 - DNA, 727 bp, Homo sapiens
  misc_feature: GYAE6OF01DOM1R.49.24.C02.1.454.CMB.1.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtccacactcacttgtggcttgagctcgtggctcagtctcaactggttacctacccngctcggtaccagcacgaccccaggccacggccnccgacgcacgctacagtacgtacgaataaccaaattacgtaccgtcttcttttacggtcggggttcccctaggtacttccgtctttcgtcgttcggccttacctacgtttacccgttacgggaaaccgtaaacggtcctaccgtaccccgttactaacccgtaccgtaccggtaaccggggaccgaccccgtaacgggaccgtaaggaacgtacgtaagtacgtaaagttacggtttaagttaattttacgtttaacttggttacggttcgtacgtttacgttagtttcgggtttagggggtttcgggtttacgggttttcggttttttacgggtcggggtttccgggacggggtaacggggtaacctaagggtccgttaccggtacccgttacccgg

SEQ ID NO: 178093 - DNA, 751 bp, Homo sapiens
  misc_feature: GYAE6OF01EM0C8.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggactccttgcttatggatcaggtgtggaatctcagactggtggtcgacccgaggacgcctatcggttgtcgaggtcgggtccccgggggggacacgtcacactcacgttgtggcttgacgctcgtgctcacgtctactaacgttcggttaaccacccctagcctacggtaccacggaccaaccggacccccgacggccgacggccctacccgacgccgaccgtcctacgtaacgtacgtacgaactaacgtaaaacttcggtcgtccgttacgttccggtcggggtccctggtacttccgtctttcctcgtcggtcctacctacgttccgttacgggaactaacgtctccgccctaccaccgtacgtacccggaccggggcccacggacgagagtacggtagtaacgttaagtaggttagttaagtttacgtttacgttcgggttggtacgtacgttaggttacgttcgggttaggggttttcgggtttcgggttttcggttttttcggggttccgggtttacggggtaccggggtaaacgggtacccggtaacggttacccggtaccggttaaccccggttcccgttaacccgggg

SEQ ID NO: 178094 - DNA, 668 bp, Homo sapiens
  misc_feature: GYAE6OF01D2GWQ.49.24.C02.1.454.CMB.1.raw
  modified_base (236)..(236): a, c, t, g, unknown or other
  misc_feature (236)..(236): n is a, c, g, or t
  modified_base (365)..(365): a, c, t, g, unknown or other
  misc_feature (365)..(365): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggganagtcacactcacttgtggcttgagctctggctcagtctcaacgttcggttaacctaccccagctcggtaccagcacgaccccaggccaggctccacgcacgctacatcgtaacgataacaaaatgtccncttcttcgtacggggttccctgtactcgtcttctcgtggtcctctactccgttaggaactaagctcgccctacacctacgtaccggacccggggacccacggaccgaagtacgtagaagtaggtaacttggtataatttaacgtttacgttggttagttcgtcgtttagttacgttcgggtttagggggttcgggttttcgggtttcggttttttcgggttcggggtttaccggggtaccgggtaccggggtaaacccgtaacgggtacccggttaccggttacccggtcccgttaacccggg

SEQ ID NO: 178095 - DNA, 733 bp, Homo sapiens
  misc_feature: GYAE6OF01C2QUH.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggacgccatcgttgtcgaggtcggtccccgggggggacagtccaacactcacgttgtggcttgagtctcgtggctcagtctacaacgttcggttacctaccccgagtccgtaggtaacccagccgaacgacccccgaggccacggcctccacgccacgctcatcgtaacgaataacaatagtccgtcttcgttcgtcggggtccctgactcgtcttctcgtcggtcctcctacttcccgttaagggaacctaaacggtcctccggtacccctaccgaaccgtacgtccccgggaacccggggggacccctaacgggaccgaacgtagtaacggtaagttacggtaagttaggtttaaggttaacgttttaacgtttaaccgttgggttcgtacggttacgttcggtttacggttcgggtttgggggttcggtttcgggtttcggttttttcgggttcgggttccgggtaccggggtaacgggtaaccggtaacggttccgttaccgggtacccgttcccggttaacccgg

SEQ ID NO: 178096 - DNA, 564 bp, Homo sapiens
  misc_feature: GYAE6OF01CMD25.49.24.C02.1.454.CMB.1.raw
tcagagtcgagagacacgaccggtgctcgatttagtacagatcgttagggaaaggggaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtcccgggggggacagtcacactcacttgtggcttgagctctggctcagtctcaactggttacctaccccagctggtaccagcagaccccaggccagctccacgcacgctcatgtaacatacaaaatagtcgcttcttcgtcggggtccctggatcgctttcgtctggctccatcctagggaacaagctgcctcacatcgacggggccaggcagatgaatgaagtgtgtattatttactgtgtacgtcttgtattcggttgggtgggttggttcgtttttcggtcgggtttacgggcgggtaacgggacccgtaaggccgttacggcccggttccgtaacccgg

SEQ ID NO: 178097 - DNA, 828 bp, Homo sapiens
  misc_feature: GYAE6OF01CXJLB.49.24.C02.1.454.CMB.1.raw
  modified_base (240)..(240): a, c, t, g, unknown or other
  misc_feature (240)..(240): n is a, c, g, or t
tcagagtcgagagacacgaccggtgctcgatttagtacagatcgttagggaaaggggaaaggccctgaggaaaacaaacccagctgggaagcctgagaacacgtagccttcatgagtcgtccccaccatggcctggatgatgcttctcctcggactccttgcttatggatcaggtgtggaatctcagactgtggtcgacccaggacgccagtcgttgtcaggtcggtccccggggggganacggtcaaccactctacttggtggcttgagtctcgtggctcgacgttctacgtaacttcggttacctaccccgagtccgtaggtaacccgacgaccgaaccgacccccgacggacccacggccctacccgacgaccgaccgtctactaacgttaggtaaccaaattaaccgtaaaaaacgttcggtaccggtaccttttacccggtttccggttccggggggttacccccttaggtaaccgtttcccgtccgttttccgttccggttccgggtacccttccccgtaaccgtttaccccggttttaagggggaaaaccctaaaccggtccccgttacgggccccccttaaccgaaccccgtaaccgggtacccgggaccccgggggacccgaacgggaccgtaaggtacgtaggaagttaggtaattagggtagttacgtttaacgttagttgggtacgttcgtcgttaggtacgttccgggttggggtttggttcgggtttccggtttttacgggcgggtttcccggggacgggtaacgggtacccacggttacccgttacccgggtacccggttccgttaacccggg

SEQ ID NO: 178098 - DNA, 625 bp, Homo sapiens
  misc_feature: GYAE6OF01BW8XR.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcggtccccgggggggacacgtcacactcacttgtggcttgagctctggctcagtctcaactggttacctaccccagcgtcggtaccagccacgaccccgaggccaggcctccacgcaccgctcatcgtaacgataacaaatacgtcgtcttcgttcgtcggggtccctggactcgtcttctcgtcggtccttctacttccgttaggaacaacgtcctcgccctacaccctacgtcccggaccggggcccacggacgagtacgtagagtagaagtgtagttatttacgttacgttgtgtcgtcgttgtacgttcggttgggttggttcgggttttcgttttcgggttcgggttcggggtacgggtacgggtaaccgacgtccgtccggtcccgttccgtaccgg

SEQ ID NO: 178099 - DNA, 581 bp, Homo sapiens
  misc_feature: GYAE6OF01E34NT.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggacagtcacactcacttgtggcttgagctctggctcagtctcaactcggttaactaccccagccgtggtaccagcacgaccccaggcccaggcctccacgccacgctcatgtacgatacaaatagtcgcttcttcgtcggggtccctgacttcgctttctcgtcggcctccgtatccgttagggaacgtaacggtcgacccctcaccacgtccggaccggggcccaggcagatgatgaagtgtatattatacttgtgtgtctgtattcggtggtggttggttcgtttttcggtcggtttcgggcgggtaacggtaccgtacggtcgtacgtcccgttcgtaccgtccg

SEQ ID NO: 178100 - DNA, 587 bp, Homo sapiens
  misc_feature: GYAE6OF01D80NY.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggggacagtcacactcacttgtggcttgagctctggctcagtctcaactggttacctaccccagctggtaccagcacgaccccgaggccaggcctccacgcacgctcatgtacgataacaaatacgtcgctcgttcgtggggttccctgactcgtctttctcgtcggcctcctattccgttagggaacaacgtcctcgccctacaccacgtccggaccggggcccaggcagatgatagaattgtagtattattacgtgtgtcgcttgtagtggttgggtggttcggttcgtttttcggtcggttaccgggacgggtaacgggtacctaaggtccgtacggtcccgtccgtaaccgg

SEQ ID NO: 178101 - DNA, 724 bp, Homo sapiens
  misc_feature: GYAE6OF01BQBZF.49.24.C02.1.454.CMB.1.raw
  modified_base (258)..(258): a, c, t, g, unknown or other
  misc_feature (258)..(258): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccggggggacagtcacactcacttgtgcttgngctctggctcagtctcaactggttactacccagcctaggtaccagcacgaccccgaggccacggctccgacgcaccgctcatgtacgataacaaagtagtcgtctacgttcgtcgggtccctgtactcgtctttctcgtcggtctccgtacgttacccgttagggaacctaaacgtccgttccgaccccgttaccaaccgacgttacccgggaaccggggggtacccccgaagggacgtaacggtacgtacggaacgttacggtaaacgttagggttacgtaaacgttttaacgtttaaccggttggtttaggttcgttacgtttaggttacgtttccgggttgggggtttcgggtttcgggtttccggtttttttaccgggttcggggtttaccggggtaccgggtaaacggggtaacccttaacggtacggtttaccggtaaccccggtttccgttaacccggg

SEQ ID NO: 178102 - DNA, 633 bp, Homo sapiens
  misc_feature: GYAE6OF01CJS2M.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacacgtcacactcacttggtggcttgagtctctggctcgagtctcaacttcggttacctaccccagtctacgggtaccacggcaacgaccccaggccacggcctccacgcacgctcatgtaacataaccaaatacgtcgcttcttcgtcggggtccctgtactcgtcttcctcgtcggccttccacgttccgttacgggaactaacgcctacgccctacacctacgtaccggaccggggtacccagggacagactagatagaatgtagtattattacgttagtggttgtcgttgttcgtacggttgggttgggtttcggttcggttttttacggtcgggtttcgggacgggtacgggtaccgtaacggccgttaccggtacccgtccggtaacccgg

SEQ ID NO: 178103 - DNA, 618 bp, Homo sapiens
  misc_feature: GYAE6OF01DZ7C0.49.24.C02.1.454.CMB.1.raw
  modified_base (239)..(239): a, c, t, g, unknown or other
  misc_feature (239)..(239): n is a, c, g, or t
  modified_base (405)..(405): a, c, t, g, unknown or other
  misc_feature (405)..(405): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcggtccccggggggganagtcacactcacttgtgcttgagctctggctcagtctcaacttggttacctaccccgagctcggtaccagccacgaccccgaggccaggcctccgacgccacgctcagtcgtacgataacaaagtacgtcgacttcgttcgtcggggttccctgactcgtctttcncgtcgctcctatccgttaggaactaacgctacgcctacactaacgtccggaccgggtcccagggcaagcgtagatacgaattgtagtatttacttattgtagtgtgttgtagttcggtgggttggttcggtttcgtttttacgggtcggttccggggacgggtaacgggtacccgtaacggtccgttaccgggtaccggttcccgttacccgg

SEQ ID NO: 178104 - DNA, 580 bp, Homo sapiens
  misc_feature: GYAE6OF01A56BW.49.24.C02.1.454.CMB.1.raw
  modified_base (349)..(349): a, c, t, g, unknown or other
  misc_feature (349)..(349): n is a, c, g, or t
  modified_base (399)..(399): a, c, t, g, unknown or other
  misc_feature (399)..(399): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtcgtccccaccatggcctggatgatgcttctcctcggactccttgcttatggatcaggtgtggaatctcagactgtggtgacccaggagccatcgttgtcagtcggtcccgggggggacaggtcacactcacttgtggcttgacgctctggctcagtctcaactcggttacctaccccagcctcggtaccagccacgaccccgaggccacggcctcccacgccacgctcatnacgataacaaatcgtacgtctcttcggtcgggtccctgactcgtctttcnctcggtcctcctatccgttacgggaacaacgtcctcgcctccaaccacgtccgaccggggcccaggcaacgatgagtgaatgtgattattattgtgtcgtctgtgtcggtgggttggttggttcgttttcggtggttcgggacgggtacgggtacgtaggacgtcgtcccgtccgtaaccg

SEQ ID NO: 178105 - DNA, 685 bp, Homo sapiens
  misc_feature: GYAE6OF01AR4UH.49.24.C02.1.454.CMB.1.raw
  modified_base (421)..(421): a, c, t, g, unknown or other
  misc_feature (421)..(421): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccattcgttgtcaggtcgggtcccggggggactacggtcacactcacgtttggtggcttgagtctcgtggctcgagttctctaacgttcggttaacctaccccagtcctacggtaccacggccaccgaccccgaggcccgaggcctacccacgccacgctcatgacaataacgaaatcgtcgtcttctcggtcgggtcctgactcgtcttcncgtcgtcctctacttccgtacgggaactaacgtcctcgcccctacacccgtacgtacccgggaccggggccctagggaccaggtactaggacgttacggaagtttgttaacgttaagtttaactttacgttggttagtcgttccgttaaggttacgttcgggttaggggtttggtttcgggttttccggtttttcgggtcgggtttccggggaccgggtacgggtaaccgtacggtaccgtacggttcccgttccggtaaccgg

SEQ ID NO: 178106 - DNA, 524 bp, Homo sapiens
  misc_feature: GYAE6OF01ALFE1.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcactggttactaccccagctggtaccagcagaccccaggccaggctccacgcacgctcatgtacgatacaaatagtcgctcttctggggtccctgatcgcttctctggctcatcctgggaacaagctgccctcaccatcgacggggcccaggcagatgatgaagtgtgtattattactgtgtgtctgtatcgtgggtggttggtcgttttgtcggttcggcgggaggaccgaggcctgccgtccgtaccgg

SEQ ID NO: 178107 - DNA, 598 bp, Homo sapiens
  misc_feature: GYAE6OF01C5UL6.49.24.C02.1.454.CMB.1.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (336)..(336): a, c, t, g, unknown or other
  misc_feature (336)..(336): n is a, c, g, or t
  modified_base (475)..(475): a, c, t, g, unknown or other
  misc_feature (475)..(475): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcgactccttgcttatggatcaggtgtggaatctcagactgtggtgacccaggagccatcgttgtcaggtcggtccccgggggggactaggtccacactcacttgtggcttgngctntggctcagtctcaacttggttacctacccagctggtaccagcacgacccaggccaggcctccacgcacnctcatacgtaacgataaacaaattacgtcgtactcttcgtcgggtccctggctcgtcttctcgtcggcctccagttccgtagggaaaccaagctcgccctacacctacgtccggaaccggggtcccgaggcacgtaganaggtataacgttggtatatttagttnttggtagttncgttacgttgtcggttgggtcggttcggttgtttttcggtcggtcgggtacggacggaccgaacgtcgtacggccgtccgttaccgg

SEQ ID NO: 178108 - DNA, 788 bp, Homo sapiens
  misc_feature: GYAE6OF01D8X8K.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactggtggtgacccaggagccattcgttgtcgaggtcgggtcccgggggganagtcacgactctacgttgtggcttgacgtctcgtggcctcagttcctactaacgttcggttaacctaccccagtccgttacggtaaccacgaccgaaccgaccccgaggcccacggccctacccgacgccacgtcctacgatacgtaacgaataaacaaagtcgtcgtcttcgttcggtcgggtccctagtcttccgtctttctcgtcggtcccttaccgtacgttacccgttaacgggaaacctaacggtcccgtaccgtacccctacgaacccgtacgttcccggggaacccggggtacccgacgggtaccgaggaacgttaggaacttaaggtaacgtttaggttacgtttaacgtttaaacgttacgtttacggttacggttacggttcgtttaacgggtttcggtttccggggtttggggtttcggggttttcgggttttcccggttttttcggggttcgggtttaccgggggtaccgggggtaacgggtaacccgtacgggttacccgttaccgggtaaccccggtttcccggttaacccggg

SEQ ID NO: 178109 - DNA, 756 bp, Homo sapiens
  misc_feature: GYAE6OF01B0TZX.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccatcgttgtcgaggtcgggtccccggggggacacgtcacactcacgttgtggtcttgagctcgtggctcagtctactaacgttcggttaacctaccccgagtccgtacggtaccacgaccgaccgaccccgacggccgacggcctcccgacgccaccgctcatgtaacgaataacaaatcgtacgcttcgttcgtcgggtcctgtactcgtcttctcgtcgtcctcctacgttccgttacggaactaacgtccgtaccgtcccctaccgaccgtacgtacccgggacccgggggacccgacggaccgaagtacgtacggtaagtaacggtaagtttacggttaacgtttaacgttttaacgtttacgtttaggttacggttacgtacgtttacggttacggtttcggggtttagggggtttcgggttttcgggttttccggtttttttcggggttccggggtttacgggggtacccggggtaaacggggtaaccccgtacgggttacccggtttacccggtaccccggttacccggttaacccggg

SEQ ID NO: 178110 - DNA, 534 bp, Homo sapiens
  misc_feature: GYAE6OF01B8HYJ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggggacagtcacactcacttgtggcttgagctctggctcagtctcaactggttactaccccagctggtaccagcagaccccaggccaggctccacgcacgctcatgtacgatacaaatagtcgctcttctcggggtccctgatcgctttctctggctccatccttggaacaagctgccctcaccatcgacggggcccaggcagatgatgaatgtgatttattactgtgtgcttgtatcgtgggtggtggttgttttcggtggttcgggtcggacgggtaccaaggtcgtcggtccgtccgtaccgg

SEQ ID NO: 178111 - DNA, 833 bp, Homo sapiens
  misc_feature: GYAE6OF01C7HWD.49.24.C02.1.454.CMB.1.raw
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccatcgttgtcaggtcggtccccgggggganagtcacactcacttgtggcttgngtctcgtggctcacgtcctactaacgttcggttaaccctaccccgagtccgtacgggtaccagaccaccgaccccgacggtccacggtcctcccgacggccaccgctacatacgtacgaactaacaagttacgtccgtcttcgtttcggtcgggtaccctgacgttcgtcctttcgtcgtcggccttaccctacgttacccggttacgggaaaaccgtaacgtcccgttcccggtaccccctacctaaccccggtaacggtacccccgggaaccccgggggggtaccccaacggggacctaacgggtaacgttacgggtaaaccgtttaaggtaaaccggtttgggtttaacgtttaacgttttaaacgtttacggttggtttacggttcgttacggttttaccggttaaggttccggggtttgggggtttttcgggttcgggttttttacccgggttttttcggggttcgggtttaaccggggggtaacggggtacccggggtaaacccggttaacggtccccgggtttaaccggttaccccgggttttccccggttaaaaccccgggg

SEQ ID NO: 178112 - DNA, 587 bp, Homo sapiens
  misc_feature: GYAE6OF01BXNQ1.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggggacacgtcacactcacttgtgtcttgagctcgtggctcagtctcaacttcgtacctacccagctcggtaccagcacgaccccaggccaggcctccacgcaccgctcatcgtacgataacaaatcgtctctcttcgtcgggtcctgacttcgcttcgtctgcctctactccgtaggaacaacgctacgccctcaccacgtccggaccggggacccacggacagactgatagtaagtgtagtatttattacgttgtgtcgtgttacgttgttcgggtgggttgggttcggtttcgttttcggttcggtcgggcggtaacgggacctacggtcgtacggtcccgttcgtaacccgg

SEQ ID NO: 178113 - DNA, 823 bp, Homo sapiens
  misc_feature: GYAE6OF01DZAIR.49.24.C02.1.454.CMB.1.raw
tcagagtcgagagacacgaccggtgctcgatttagtacagatcgttagggaaaggggaaaggccctgaggaaaacaaacccagctggaagcctgagaacacgtagccttcatgagtcgtccccacatggcctggatgatgcttctcctcggactccttgcttatggatcgaggtgtggaatctacgagactggtggtacgaacccgagggacgccctagttcgtttgtaccgtagggttccgggggtacccccgggggggggaatacggtaccaaccgtaccttccgtaaccgtttgggtcggtccgtttggacggtccttccgttggccttcgtaacgtccttactaaccgttcggttaaccctacccccgtaggtcgttcggtaaccgacgaccgaaccgacccccgaggaccctaccgggtccctaccccgacgaccaccgcctaccgtaataccggtaaccgtaactaaacgaaaaacgttcgtccgtacctttcggtttccgggtaccggggttaccctaggtacgttccgtcctttcgttccgtacggtccttacctacgttacccggttaacgggaactaaccggtcccgtcgtcccctaaccgaccgtaccgtacccggggaccggggacccgacgggacctaggacgtacgtagtacggtaagtagtataagttagttacttggtcgtagttcgtgttacgttcgggttgggttacgggtttcgggtttcgtttttacgggtcgggtttccggggtaccgggtaaacgggtacgtacccgggtacggtcccggtaacccgttccgttaacccgg

SEQ ID NO: 178114 - DNA, 670 bp, Homo sapiens
  misc_feature: GYAE6OF01EN2BZ.49.24.C02.1.454.CMB.1.raw
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgacccgaggagcctagtcgttgtcgaggtcgggtccccgggggggacacgtcacactcacttggtggcttgngctcgtgctcngtctactaacgttcggttaacctacccgagtccgtcggtaaccacgaccaccggaaccccgacggcccacggccctccgaccgccacgcctcacgtacgtaacgaactaactaaagttcgtaccgtcttaccgtttcgtccggggttccctaggtacttccgtctttcgtccgttcggtccttccgtacgttccgtacgggtaaactaacgtcctccgtaccctactaccacgtccgggaccggggaccgacggcacgtagtgagtagtaagtgtagttatttagttacgttgtgtgtcgttgtagttcggtgggtttcggttcggtttcggttttcggtcgggttcgggtcggtacgggtactacggtacgtcgtccgtccgtaccgg

SEQ ID NO: 178115 - DNA, 694 bp, Homo sapiens
  misc_feature: GYAE6OF01A6IIB.49.24.C02.1.454.CMB.1.raw
  modified_base (350)..(350): a, c, t, g, unknown or other
  misc_feature (350)..(350): n is a, c, g, or t
  modified_base (519)..(519): a, c, t, g, unknown or other
  misc_feature (519)..(519): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggagccagtcggttgtcgaggtcggtccccgggggggacacggtccacacgtctacgttggtggtcttgagctcgtggctcagtctcaacttcggtacctcccgagtctacggtacacgcgaccgacccgcggccgacggcctcccnccggacaccgccacgtacgtagttaccgaactaacctaaagtacgtacgtcctcgttacgtcggggtacctcgtacgtcgtcgttctcgtcgtctccgtacttcgttacgggaactaacgtactcgtcccgtctacccacgtcgggacccgggtacccggacgacggtntacgtagtaacgtacgtaacgtacgttaggtaacgtttactttaacggttcgttgtaccggttagtcccgttagttaccgggttgggttggggttaccgttttcgttttcgggtttcgggtccgggtacggggacgggtacgacggttcggtaccggtccgtccccgttaaccgg

SEQ ID NO: 178116 - DNA, 684 bp, Homo sapiens
  misc_feature: GYAE6OF01BND29.49.24.C02.1.454.CMB.1.raw
  modified_base (245)..(245): a, c, t, g, unknown or other
  misc_feature (245)..(245): n is a, c, g, or t
  modified_base (438)..(438): a, c, t, g, unknown or other
  misc_feature (438)..(438): n is a, c, g, or t
  modified_base (522)..(522): a, c, t, g, unknown or other
  misc_feature (522)..(522): n is a, c, g, or t
  modified_base (576)..(576): a, c, t, g, unknown or other
  misc_feature (576)..(576): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttccttgcttatggatcgaggtgtggaatctcagactgtggtgacccgaggacgccattcgttgtcgaggttcgggtccccgggggganacgtcacactctacgttggtggtcttggacgtccgttcgtcgggtccttcgtaacgttccttaccgtaacgtttcgggtttaaccctacccccgtaggtccgttacggtaacccaggacccaaccggacccccgaggccccgacggcctacccgacgccaccgtctcagtacgtaacgataaccaagtcgtcncttcgttacggtcggtccctgtactcgtcttcgtccgtggccttccgtattccgttaaggaacaacgtctcgaccctcaaccgngtcccgggaccgggccaggcagatagatagtatgtatatttatacgttgtcgtntacgttgtacggttggttgggttgtttcggtttcgttttacgggttcggtacggggtacgggaacggtaccgtaacggttccgtaccggtacccggttaccgtaccgg

SEQ ID NO: 178117 - DNA, 799 bp, Homo sapiens
  misc_feature: GYAE6OF01AKXIQ.49.24.C02.1.454.CMB.1.raw
tcagagtcgagagacacgaccggtgctcgatttagtacagatcgttagggaaagggaaaaggccctgaggaaaacaaacccagctgggaagcctgagaacacgtagccttcatgagtgtccccacatggcctggatgatgcttctcctcggactccttgcttatggatcgaggtgtggtaatctcgagtacgtgtggtcgacccgtaggagacctagttcgttgtaccgaggtcggtcccccgggggggatacgtccaacgacctccgtaacgttggtacggtcttcggacgtcgttcgtcggctcgtacgtctacgtaacgttcgttacctacccgagtccgtcggaccacgacctaccggacccgacggaccgacggcctccgaccgccgacgtcctactacgtcgtaacgtagtaacctaaacgtcgtacgtcgttcgttacgtcggtcccgtgacttccgtacttccgtacgttcggtccttaccgtacgttaccgttacggaaacgtaacgtacctcccgtaccctaccgtaccgtaccgtacccgggtacccggggaccgtaccggcgtaacgacgtacggacgttaacggtacgtacggttaagtaaccgtttagtttaaccgttggtttacgtacggtttactggtttaccggttacggtttcggggttttacgggtttccgggttttcggttttttccggggtcggttttaccgggggtaacccggttaaccggggttaccgtaaccgggttaccgtttacccggttccggttaccccggtttaacccgg

SEQ ID NO: 178118 - DNA, 556 bp, Homo sapiens
  misc_feature: GYAE6OF01AORIT.49.24.C02.1.454.CMB.1.raw
  modified_base (238)..(238): a, c, t, g, unknown or other
  misc_feature (238)..(238): n is a, c, g, or t
  modified_base (407)..(407): a, c, t, g, unknown or other
  misc_feature (407)..(407): n is a, c, g, or t
  modified_base (424)..(424): a, c, t, g, unknown or other
  misc_feature (424)..(424): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttgtggcttgagctctggctcagtcctcaacttcggttacctacccccagcctggtacccagccacgaccccaggccaggcctccacgcacgctcatgtacgataacaaatacgtcgctcgttcgtcggggtccctgactcgcttctctggcctacntcgtaggaacaagctcnccctcaccatccgaccggggcccaggcagatgatgaatgtgtattattcgtgttgtgtctgtatcggtagggtggttcggttcgttttggtcggttacggcgggacgtaccgagtcgtacgccgtccgtacg

SEQ ID NO: 178119 - DNA, 786 bp, Homo sapiens
  misc_feature: GYAE6OF01DMIWA.49.24.C02.1.454.CMB.1.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtaggaatctcagactgtggtgacccaggacgccatcgttgtcagtcggtccccgggggganagtcacactcgacttgnggcttgagctctggtctcagtctcaaacgttcggttaacctaaccccagtctggtaccagaccacgaccccgaggccaggcctccacgccacgctacatcgtacgaataaccaaatacgtacgtctccgttcgtcggggttccctggtactccggtctttccgtcgttcggccttcctacgttcccgttacggggaaacgtaaacgtaccgtccgtacccttaccaaccctacgttaccgggaacccgggggtaccccgaacggaccgtaaggtaacgttaggaagtttacggtaaagttggttaacggttaaacgtttttaacgtttaacggtttcggtttacggtttacggttacggttaacggtttaaggttccgggttggggggtttacggggttttcgggtttaccggttttttttcggggttacgggttttacccgggggtaccggggggttaaaccggggttaacccggtaaaccgggttcccggttaaccgggttaacccccggtttcccggttaaaccccggg

SEQ ID NO: 178120 - DNA, 574 bp, Homo sapiens
  misc_feature: GYAE6OF01BLI9S.49.24.C02.1.454.CMB.1.raw
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccggggggggacagtcacactcacttgtggcttgagctctggctcagtctcaacttggtacctaccccagctggtaccagcacgaccccaggccaggcctccacgccacgcctcatgacgatacaaatgtcnctctcgtcgggtccctgtactcgctttcnctggctcctatccgttaggaacaagctcgccctacaccgactccgaccggggcccaggcagntgangaatgtagtattattacgtgtgtgcgttgtacttcggtgggttggttcggtttcttttcggtcggttccgggtacgggtacgggtacccgtaggtccgtacggtacccggtccgtaaccgg

SEQ ID NO: 178121 - DNA, 775 bp, Homo sapiens
  misc_feature: GYAE6OF01BOP5Z.49.24.C02.1.454.CMB.1.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcgtactccttgcttatggatcaggtgtggaatctcagactgtggtgacccaggacgccatcgttgtcgaggtcggtcccgggggganagtcacactcacgttgtggcttgagctcgtggctcagttcnctaacgttcggttacctacccagctcggtaccagcaacgaccccgaggccaggcctccgacgccacgcctacatcgtaacgataacgaaatacgtctcttcttcgtcgggtccctgactcgtctttcgtctcggccttcctacgttcccgtttaacggggaaactaaacggtcccttaccgtaccccgttaccgaacccctacggtaccccggggaacccggggggtacccccgaacggggacccgtaaggaacgttaggaaccgttaaggttaacgttagggttacgttaaacgtttttaactttaccggtttgggtttacggttcggttacgtttaggttacggtttccgggttaggggggtttcgggtttacggggttttccgtttttttcggggttcggggtttacccgggggtaacggggttaaccggggtaaacccgttaacgggtacccggtttacccgggtaccccgggtttcccgttaaaccccggg

SEQ ID NO: 178122 - DNA, 698 bp, Homo sapiens
  misc_feature: GYAE6OF01DYJ0L.49.24.C02.1.454.CMB.1.raw
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacacgtcacncctcacttggtggcttgganctctggctcagtctacaacgttggttacctacccgagctggtaccagccacgaccccaggccacggcctcccgacgccacgctacactaggtacaataacaaatacgtccgtacttcgttcgtcgggtccctgactcgtcttctctggtcctctacttccgtaggaacaagtcctgtcccctacctaccgacgtacccgggaccggggtaccccagggaccaggtactaaggtagtaagtaagttcggttaaggttaacttttaagttacggttggttcgttggtccgtttaggttagttccgggtttagggttcggggtttcgggttttaccgttttttggggttccgggtttccgggggtaacggggtaaccggggtaacccggttaaacggtccgttaacccgggtcccggtttcccggtaaacccggg

SEQ ID NO: 178123 - DNA, 764 bp, Homo sapiens
  misc_feature: GYAE6OF01CKRKE.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccagggacgccatcgttgtcaggtcggtccccgggggggacagtcacactcacttgtggcttgagctctggctcagtctcaacttcggttacctacccgagctcggtaccagcacgaccccgaggccacggcctccacgcacgctcatcgtaacgataacaaatcgtcgtcttcttcgtcgggtcctgtactcgtctttcgtcgtcggtcctcctacgttccggttaacgggaaacctaaacgtccgttacgtacccctacgtaaacccgtacgttacccgggaacccggggggtaccccgacgggaccgtaacggtacgtaacggtaacgtaggtaaacgtttgggttacgttaaagttttaacgtttaacgtttagggttacggttacggttacgttaggtttacggttacgggtttgggggtttacgggttttcggggttttccggttttttttcggggttcggggtttacccgggggtaccggggtaaaccggggttaacccggtaaacgggttcccggttaaccccgggttaaccccggttccccggttaaaccccgggg

SEQ ID NO: 178124 - DNA, 600 bp, Homo sapiens
  misc_feature: GYAE6OF01A58H4.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttggtggcttgagtctcgtggctcagtctcaacttggttacctaccccagctggtaccagcacgaccccaggccaggcctccgacgcacgctcatgtacgatacaaatgcgctcttcgtcgggtcctgactcgcttcctgtcgctcctagtcccgtagggaacctaagcctcgccctaccaccgacgtccggaccggggcccaggcagatcgatagtaagttgtagtagttattacgttgttgtagtcgttgtacgtcggttaggggttcggttcggtttcgtttttcggtcggttcggggtacgggacgggtacgtaacggtaccgtcggtacccgttccgtaacccgg

SEQ ID NO: 178125 - DNA, 870 bp, Homo sapiens
  misc_feature: GYAE6OF01D9WXA.49.24.C02.1.454.CMB.1.raw
  modified_base (212)..(212): a, c, t, g, unknown or other
  misc_feature (212)..(212): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatggatcgaggtgtggaatctcgagtactgtggtcgacccgaggaacnccgagttacggttgtcgtagggtcgggtaccccgggggggactaggtcccacgtccgtacctaccgttggtcggtctttcggagtccgtcgtcggtctcgtacgtcctacgtaacgttccgggttaacctaacccccgagtccgttacgggtaacccacggtaccgaccgaaccccccgaggaccccgacgggtaccctaccggaacccgccgaccgtacccgtacctaagttaccggtaaaccggtaaaccttaaaccgtaaaaagtaccggttcccgtaccttttaccggttcccggtcggggttacccttaaggtcgtttaccgtcctttccgttcgttcggtcccttacgtaccgttaccgttaacgggaactaacggtctcccggtaccctaccaccgtacgtcccgggaacccggggtcccgaacggtcgaacgttacgtaggacgttaacggtaagttcggtaacgttagttttaaccgttaggtttcggtaacgttaggttaccgtttggttaacggttcgggtttagggttcggggtttaccgttttcgggttttttaccggttcggggtttccggggaaacgggttaccgggtaaacccgttacggttaaccccggtccggttaaaccccgttcccggttaaacccgg

SEQ ID NO: 178126 - DNA, 856 bp, Homo sapiens
  misc_feature: GYAE6OF01A4I5D.49.24.C02.1.454.CMB.1.raw
  modified_base (240)..(240): a, c, t, g, unknown or other
  misc_feature (240)..(240): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagcctagtcgttgtcaggtcggtccccgggggganagtcacactctacttgtggtcttgagtctcgtggctcagttcctactaacgttcggttaacctaccccgagtccgttacggtaaccacggcctaaccggacccccgtagggaccccgacgggtaccctacccgaccgtcgaaccgtctacctagttacgtaaccgtaaacttaaccgaaaagttcggtccgtactttccgtttacggtcggggttccccttaggtaccttccgtcctttcgtccgttcgggtccctaccgtacgtttcccggttaacgggaaacctaacgggtcccttacccgtacccccgttaaccgaacccgttaaccggttaccccggggaacccggggggtacccccgaacggggtaccgtaacgggtaacgttacggtaaccgttaaggtaaacgtttacgggttaacgtttaacgttttaacgtttacgtttagggttcggttacggttacgtttacggttaggttccgggtttgggggttacgggtttccgggttttccggttttttacgggtccggggtttacggggtacccggggtaaccgggtaacccggtacggttacccggttacccggtacccggtttacccggtaacccggg

SEQ ID NO: 178127 - DNA, 874 bp, Homo sapiens
  misc_feature: GYAE6OF01BAACR.49.24.C02.1.454.CMB.1.raw
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttccttgctttatggatcaggtgtggaatctcagtacgtgtggtgacccgaggacgcctagtcgttgtcgaggtcgggtccccggggggacngtacacgactcacgttggtcggtcttggactcgttcgtggtcttccgaggttcctacgtaacgttcggttaaccctaccccgtagtccgtacggtaccacgccgaccggaccccgnggacccgacggcctacccgcgaccgaccgtcctactacgttacggtaacctaacgtaaactaaaagtcgtaccgttccttacgtttccggttcggggttaccccttggtaaccgttccgttccgttttcccgttcgttacgggtccccttacgtaccgtttccggtaaacgggaaacctaacgtcccgttcccgaccctacctaacccgcggtaccccgggaccggggtccgaacgtccgaagggtctaagggtacttaaggtaagttacggttaacgttttaagtttaacgttttaacgggttcgttacgggtttacggttacgtttaccgggtttacggtttaaccggggttttggggggttttaccggggttttccgggtttttacccgggtttttttcgggggtttaccgggggttacccgggggtacccgggttaaacgggggtacccggttaccggtaacccggttttacccgggaccccggttttaaccccggttaaccgggg

SEQ ID NO: 178128 - DNA, 686 bp, Homo sapiens
  misc_feature: GYAE6OF01AB294.49.24.C02.1.454.CMB.1.raw
  modified_base (177)..(177): a, c, t, g, unknown or other
  misc_feature (177)..(177): n is a, c, g, or t
  modified_base (234)..(234): a, c, t, g, unknown or other
  misc_feature (234)..(234): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtntggaatctcagactgtggtgacccaggagccatcgttgtcagtgtccccgggggganacgtcacactcacttgtggctttgagctcgtggacctcagtctcaacttggttacctaccccagctggtaccagccacgaccccaggccaggcctccacgtcacggtctacatggtaacgataacgtaaactagtcgcttccgttcgtcggggtccctggtactccgtctttccgtcgtagggtcccttccgtacgttacccgttagggaaaccgtaaacggtccttacgaccccgtacctacccgtaacgtacccggaacccgggggaccccagggtacccgaggtaacgttagacgttaggtaaattcggtagtagtttacgtttacgtggttagtcgtcgttagttacggttcggttggggttcggttggtttccgttttttacggtcgggtttccgggtaacgggtaccgggtaaccacggtacctcgggtacccgtccgttacccgg

SEQ ID NO: 178129 - DNA, 667 bp, Homo sapiens
  misc_feature: GYAE6OF01DWRAD.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttccttgcttatggatcgaggtgtaggaatctcagtactggtggtacgacccgaggacgcctagttcgttgtcgaggtccgggtaccccggggggatacgtcactactctacgttggtcggtcttggagtccttcgtcggccttacgtacgttcctaccgtaaccgttcggttaaccctaccccgagtccgttacggtaaccacggaccaccggaacccccgaggcccgacggtccctacccgaccgccaccgtctacagtacgtaacgaataacaaagtcgtcgtcttcgttcggtcggtcctgactcgtcttctcgtcgtcctctagttccgtaggaacacgtctaccgccctacaccgtacgacccgggacgggcccagcagacgtagagtagtagtcgtagttattacttagtgtagtgtacgtgttagttcggtgggttcggttcgtttcgtttcggtcgggttcgggacggtacggtacgtacgtcgtccggtcccgtcgtaacg

SEQ ID NO: 178130 - DNA, 632 bp, Homo sapiens
  misc_feature: GYAE6OF01A3E3X.49.24.C02.1.454.CMB.1.raw
  modified_base (295)..(295): a, c, t, g, unknown or other
  misc_feature (295)..(295): n is a, c, g, or t
  modified_base (368)..(368): a, c, t, g, unknown or other
  misc_feature (368)..(368): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactggttacctaccccngcctcggtaccagcacgaccccaggcccaggcctccacgccacgctcatgtacgatacaaatgctctcttcgngggtccctgtctcgtcttctctcggtcctccgtacttccgttagggaaacctaacggctcgccctcaccactccggaccggggcccaggcgacgatagataggaattgtagtaactttacttacgttggttcggtacgtcgttggtacttcgggttcggggttagggtttcgggtttaccgttttttcgggtcgggtttaccggggcggggtaacggggtacccctaagggtccgtaccggttaccccggttcccgttaccggg

SEQ ID NO: 178131 - DNA, 859 bp, Homo sapiens
  misc_feature: GYAE6OF01C19CD.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtccaggtcggtccccgggggggacagtcacactcgacttgtggcttggagctctggcctctagtccttcaaacgttggttaaccctaccccagcttcggtacccagaccaccgaccccgaggcccacggccctacccgacgccaccgtctacactacgtaaccgtaataacctaaagttacgtcgtcttccgtttaccggttcggggttcccctaggtacgttccggtcctttaccgtccgttcgggtccccttaccctacgtttacccggtttaacgggggaaaaacctaacggttcccgtacccggtccccccttaacccgtaaacccgtaaccggttaccccgggggaacccggggggtacccccgacggggaccgaacggtacgtacggaagttacggtaaagttggttaacgttaagtttttaacgttaccggtttaggtttacggtacggttaccgtttaggttaccggtttacgggtttgggggggtttaccggttttcggggtttttccggtttttttccgggggttccgggttttacccggggggtaacccggggtaaacggggggtaaaccccgttaaagggttccccggtttaacccgggttacccccgggttccccgtttaaaccccgggg

SEQ ID NO: 178132 - DNA, 825 bp, Homo sapiens
  misc_feature: GYAE6OF01BB69N.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtcaggtcggtccccggggggacagtcacactcacttgtggtcttgagctcgtggctcagttcctactaacgttcggttaaccctaccccagtccgtacgggtaacccagaccgaaccggacccccgacgggaccccacgggtccctacccgaccgtccaaccgcctacacgttacgtaacgtaactaaacaaacgttacgtccgtactttaccgtttcggtaccgggggttccccttaggtacggttcccgtaccttttccgttcgtaccggtcccttacccgtacgtttacccggttaagggaaaccgtaaacgtcccgtacccgaccccgtaacccacccgtaaccggtacccgggaaccccggggggccctaacgggaccgtaacggaggttacgtaacgtaggtaaacgtttaggttacgtttaacgtttaatttaccggttaggttcggttgggtacttagggtttacgtttcggggtttggggtttcggggtttacggttttccgggtttttcggggttcgggttaccgggggtaccggggttaacggggtacccgttaacgggcccggttaccgggttaccccggttacccggttaacccgg

SEQ ID NO: 178133 - DNA, 848 bp, Homo sapiens
  misc_feature: GYAE6OF01CKEKW.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggacttccttgcttatggatcgaggtgtggaatctcagactggtggtacgacccgagggacgcctagttcgttgtcgtacggttccggggtccccgggggggaactacgtaccgactaccttacgtacgtttggtcggtcttgacgtctctcgtctcacgttctacgtaacgttcggttaacctaccccgagtccgtacggtaccacgaccaaccgaaccccgacggacccgacggccctacccgacgaccgaccgtctacgaacgttacggtaaactaactaaaccgtaaaacgttacggtccgtaccgtttccgttaccgggttccgggttcccctaggtaccgttcccggttctttcccgtccggttaccggtacccttacccgttaacgtttacccgggttaaagggaaaaccctaacggtcccttaccccgacccttaccaacccgtaccggtcccggggaacccgggggtacccaaggggacctaaggtacgtaggtaagttacggtaacttaggttaacgtttaatttacgtttacgtaggttggttaccgtacgtttgggttcgttcgggtttggggttccggttttcgggttttacggtttttcggggttaccggggttacccgggaacgggtaaccgggtaaaccctacggtttcccgtacccggtacccgttaccggtacccgg

SEQ ID NO: 178134 - DNA, 599 bp, Homo sapiens
  misc_feature: GYAE6OF01AUIAT.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatccgttgtcaggtcggtccccgggggggacaggtcacgactcacttgtggcttgagctctggctcagtctcaacgttggttacctaccccgagctggtaacccagccacgacccccaggcccaggtcctccgacgcacgctcatgtacatacaaatgtcgctcttctacgggtccctgactcgtcttctctcggctccatccgttaggaacaagtctcgcctcgaccacgtccggaccggggcccagggacagacgtcgaagtgaagtgtacgtatttaacgttactgttagtcgtcgtaggttcgtggttggggttcggttggttcgtttttcggtgtttaccgggcgggtacggtaccgtaagccgtacggtcccgtcccgttaccgg

SEQ ID NO: 178135 - DNA, 760 bp, Homo sapiens
  misc_feature: GYAE6OF01CTLQW.49.24.C02.1.454.CMB.1.raw
  modified_base (245)..(245): a, c, t, g, unknown or other
  misc_feature (245)..(245): n is a, c, g, or t
tcagagtcgagagacacgaccggtgctcgatttagtacagatcgttagggaaaggggaaaggccctgaggaaaacaaacccagctgggaagcctgagaacacgtagccttcatgagtcgtccccaccatggcctggatgatgcttctcctcggactccttgcttatggatcgaggtgtaggaatctcagactgtggtcgacccgaggacgccagtcgttgtcgaggtccgggtccccgggggganacggtcacgtactactacgttgtcggacttgacgtctcgtggctctagtctacgtaacttcggttaacctacccgagtaccgtacggtaaccacgaccgaccgaacccgacggcctaacggcctaccgacgccgacgcttagactacgtaacgactaacaattacgctactcgttcggtacgggtcctaggtacttcgtctttcgtgtcgtcctaccgtacgttaccgttagggaaacctaacgtcccgtaccgtacccctactaaccctacggtacccgggaacccgggggccaacggggtacaaggtactaggaactaaggtaacgttggttaactttacgtttaacgttacgttcggttgtacgttagtttagttaacggtcggtttagggggttcggttacgggtttttcggtttttaccgggtcgggtttcccggggtaaccgggtaacgggtaaacccggttagttaccccgggttaaccgggtccccgtttaacccgggttaacccgg

SEQ ID NO: 178136 - DNA, 676 bp, Homo sapiens
  misc_feature: GYAE6OF01D4PMZ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacagtcacactcacttgtggcttgagctcgtggctcagttctctaacctggttacctacccagctcggtaccagcacgaccccgaggccaggcctaccacggcacgctcatacgtacgactaacaaatcgtcgacttccttcgtcgggtccctgacgtccgtcttcgtcgtcggtccttcctacttccgttaggaacctaagtccttacgccctacaccgtacgtccggaccggggtcccagggctaaggtactacgtactggtaaacttggttaacgtacttttaacgtttcgtacggttgtcgtacgttaggttacgttcgggttcggggtttgggtttccgggtttacggttttttcggtcgggtttacggggccggggtaaaccgggttaccgaacggttccggtaaccgggttaccccggttcccgttaacccggg

SEQ ID NO: 178137 - DNA, 777 bp, Homo sapiens
  misc_feature: GYAE6OF01CND7D.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggaccttccttgcttatggatcgaggtgtggaatctcagactggtggtcgacccgaggacgcctatcgttgtcaggtcgggtccccggggggacacgtcacactacacgttgtggcgtgagtctcgtgctacgacgtctactaaccgttcgttaccctacccagtcgtacggtaccacggaccgaaccggaccccgacggcccgacggtaccctcccaccgcaccgcctcacgtagaaccgtaactaaaccaagttaccgtacgtcccttcggtttaccggtaccggggtccctagttactcccgtctttccgtcgtcgtcccttcctacgttaccggtagggtaaacaacgtcctaccgtcccctacaacctaccggaccggacccggggtaccaaggtcaacgtacgtaggtaattacgtaagttaggtatttaacgtttacgttacgttaggttggtacttaccggttaggtttacgtccggggtttggggggtttcggttttcgggttttacccggggttttacggtttcgggggttccggggttaaccccgggggtaagggtaaaccccggtagggttccccgttaaccgggttccccggtttaacccgtaacccgggg

SEQ ID NO: 178138 - DNA, 779 bp, Homo sapiens
  misc_feature: GYAE6OF01AOJTI.49.24.C02.1.454.CMB.1.raw
  modified_base (248)..(248): a, c, t, g, unknown or other
  misc_feature (248)..(248): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgacccgaggagcctattcggttggtcgtaggtcgggtccccggggggganacggtccacacctcctacgttggtcggtcttggacgtccttcgtgggtcctcgtaagttcctactaacgttcggttaaccctaaccccgagtccgtcgggtaaccagccaaccggaccccgaggcccacgggtcctacccgaccgccaccgctactacgtcgaacgtaactaacgaaagttacgtcgtcttcgttcggtccgggttcctggcgttcgtccttctctcggtcctaccgtcgttaccggtaggaaccaacgtcctccgtccctaccgacctacggtacccgggacccggggtaccaggtacgtacgtaagtacgtaacgttagtaacgtttagggttacgtttaacgttttacgttacggtttagttcggtttaccgtaggtttaacgggttcggtttccggggtttaggggggttttcgggttttcgggttttaccggtttttcggggtcggggttacccgggtaggggtaacccgggtaccgtacggttacccggtacggttcccccgttacggtacccgg

SEQ ID NO: 178139 - DNA, 783 bp, Homo sapiens
  misc_feature: GYAE6OF01B14J4.49.24.C02.1.454.CMB.1.raw
  modified_base (149)..(149): a, c, t, g, unknown or other
  misc_feature (149)..(149): n is a, c, g, or t
  modified_base (285)..(285): a, c, t, g, unknown or other
  misc_feature (285)..(285): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttcncctcggactccttgcttatggatcgaggtgtggaatctcagtactggtggtacgacccgaggacgtccagttcgttgtcgacgggttccgggtccccggggggactacgtccgacacgttcctacgttggtcggtnttgacgtctcgtcggctcgtacgtacctctaaacgttccggttaacccacccgagtccgtaccggtaccacgaccgaccggaccccaggcccacggtccctacccgaccgccaaccgtctacgacgttacgaaccgtaataaccgtaaagtcgtccgtactttccgttacgggttcccgggtaccctgtaacgtttcccgtctttccgtccgtccgtaccttaccgtaccgtttccggtaaacgggaacctaacgtcgtaccccgtcccttaaccgacccgttaaggaccccggggaacccggggtcccggaacggtacgtaacgggtacttaacgggtaataaccggtaattacgggttaatttaccgtttaagtaacggttgtaacgtcggtaattcgggtacgttcgggttggggttaggttcggtttttccgttagggttccgggtcgggtaccggacggtactccgggtatcccggttacgtccggtacccgg

SEQ ID NO: 178140 - DNA, 602 bp, Homo sapiens
  misc_feature: GYAE6OF01CACDP.49.24.C02.1.454.CMB.1.raw
  modified_base (236)..(236): a, c, t, g, unknown or other
  misc_feature (236)..(236): n is a, c, g, or t
  modified_base (355)..(355): a, c, t, g, unknown or other
  misc_feature (355)..(355): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccggggggganagtcacactcacttgtggctgagctctggctcagtctcaactggtacctacccagtctggtaccagccacgaccccaggccaggcctccacgcacgctcatgtacataacaatacgtcncttcttcgtcgggtccctgactcgtcttctctggcctctactccgttaggaacaacgctcgccctcaccacgtccggaccggggcccaggcaggtatgagtgaatgtagtaattagtttacgtcggttgtacgtcgttagttagttcggttggggttgggtttcgggttttcggtttttcgggttcggtttccggggacgggtacgggtaacgtacggtacgtccggtacccggttccgtaacccgg

SEQ ID NO: 178141 - DNA, 663 bp, Homo sapiens
  misc_feature: GYAE6OF01CGU3W.49.24.C02.1.454.CMB.1.raw
  modified_base (237)..(237): a, c, t, g, unknown or other
  misc_feature (237)..(237): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggganagtcacactcacttgtggcttgagctcgtggctcagtctcaaactcggttacctaccccgagctggtaccagccacgaccccaggccaggcctccacgcacgctcatgacatacaaatcgtcgctcttcgtcgggtccctgacttcgctttctcgtaggccttacctacgttccgtttaacgggaacctaaacggtccgtacgtcccctacctaaccccgacgttacccgggaacccgggggccccgaacgggaccaaggtaacgttgaagtacggaagttggtagttaatttaacttacgttgttaggtgtcgttgttacgttcgggttagggttgggttcgggtttacgttttttcggttcgggtttaccggggacgggtacgggtaccgtacggaccgtttacggacccgttcccgtaaccgg

SEQ ID NO: 178142 - DNA, 862 bp, Homo sapiens
  misc_feature: GYAE6OF01EI133.49.24.C02.1.454.CMB.1.raw
tcagagtcgagagacacgaccggtgctcgatttagtacagatcgttagggaaagggaaaggccctgaggaaaacaaaccccagctgggaagcctgagaacacgtagccttcatgagtcgtccccaccatcggcctggatgatgtcttctcctcggactccttgcttatggatcgaggtgtaggatctcgagtactggtcggtcgacccgaggacgtcctagttcgttggtaccgtaggttccggggtaccccgggggggactacggtaccaaccgtaccttccgtacgtttggtcggtcgtttggacgtccgttcgttcggacttcgtacgttcctacgtaaccgtttccggttaaccctaccccgaggtccgtacggtaaccccgacgaccgaccgaccccgaggccctacggccctacccgacgaccgtaccgtccgtaacgtacgtaccggtaactaacctaaacgtaaacgtcgtacccgttcctttccggttacgggttcccggggttacccttggtaccgtttcccggtaccttttccgtccgtccggttaccctaccgttaccggttaaccggtttaaaccggggaaacctaacggtcccgttacccgaaccccgttaccgaaccgttacccggtacccggggacccggggtacccacggtactaagggtacgtacgtagtaagtaagttacgttagttaaccttttagtacggttcgtaggttcgttacgttaggttccggtttagggttcgggtttggttttacggtttcccggtttagggtccggggttaaccggacggggtaacccggtcgtaacggttacccgtccggttaaccccgtcggttaaccccg

SEQ ID NO: 178143 - DNA, 605 bp, Homo sapiens
  misc_feature: GYAE6OF01BHVUV.49.24.C02.1.454.CMB.1.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccgggggganagtcacnctcacttgtggcttgagctctggctcagtctcaactggttaccaccccagctggtaccagccacgaccccaggccaggcctccacgcacgctcatgacgatacaaatgtcnctcgtctggggccctgactcgcttctcgtggtcctcacttccgttaggaacaacgctcgccctcacccagcccgaccggggcccacggcagagtgagtcgaatgtagtaatttattacgttggttgtagttcgttgttagttcggtaggggttcggtttcgggttcggttttttcggttcggggtttccggggacggggtaacgggtaacccgtaacgggttacgtccggtccccggttcccgttacccggg

SEQ ID NO: 178144 - DNA, 853 bp, Homo sapiens
  misc_feature: GYAE6OF01DWB1R.49.24.C02.1.454.CMB.1.raw
  modified_base (264)..(264): a, c, t, g, unknown or other
  misc_feature (264)..(264): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtcccccaccatggcctggatgatgcttctcctcggacttccttgcttatggatcgaggtgtaggaatctcagtacgtggtggtcgacccgagggacgcctagttcggtttgtcgtacgggttcggggtacccccggggggganacggtccaactacttctacgttggtggtctttggactctcgtggcttcacgttcctactaaacgttcggttaaccctaccccgagtccgttacggtacccacggtaccaaccggacccccggacggcccgaacgggccctacccgaccggaccctaccgtaccttacgaagttacgtaaccgtaactaaacctaaaagttccgtaccgttccgttaccggtttccggtacccggggttacccctaggtaccgttcccggttccgtttccgttccgttaccggtccctttacctacggtttacccggttaacgggaaactaaaccggtccctaccgtaccccgtacctaacccgtaaccggtacccgggaacccggggcccgaaggacctaaggtacgtacggaagttaacgtaagttacggttacgttaattttacgttacggtttcgacggtttcgtacggtttacggttaggttcgggtttggggttcgggttttacgggttttcggttttttcgggtcgggttaccggggtacgggtacggtaaaccgtacggttaccggttaccggtcccgttaccggtacccgg

SEQ ID NO: 178145 - DNA, 712 bp, Homo sapiens
  misc_feature: GYAE6OF01B1GU0.49.24.C02.1.454.CMB.1.raw
  modified_base (243)..(243): a, c, t, g, unknown or other
  misc_feature (243)..(243): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccagttcgttgtcgaggtcgggtccccggggggganacgtcacactcacgttgtggcttgagctcgtggctcagtcctcaacgttcggttaacctaccccgagtcctcggtaccagccacgaccccgaggccaggcctccgacgcacgctcagtgtaacgaataacaaagtcgtcgtcttcgttcgtcggggtccctgtactccgtctttcgtcgtcggtccttcctacttccggttagggaaaccaaacgtcctcccgtacccctacaaccgtacgtacccgggaaccgggggccccaacgggaccgtaagtacgtacgtaacgtaggtaacgttaggttagttaattttaacgttaccgttggttcggttagtcgttaggtttacgttccgggttagggggtttcggtttcgggttttccgttttttcggggtcgggtttccggggacggggtaacgggtacccgtaacggtccgtaccgggttacccgttcccgtaacccgg

SEQ ID NO: 178146 - DNA, 688 bp, Homo sapiens
  misc_feature: GYAE6OF01E0SPK.49.24.C02.1.454.CMB.1.raw
  modified_base (246)..(246): a, c, t, g, unknown or other
  misc_feature (246)..(246): n is a, c, g, or t
  modified_base (351)..(351): a, c, t, g, unknown or other
  misc_feature (351)..(351): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgacccaggagcctagtcgttggtcaggtcggtaccccggggggggtanaggtccacacctcacttgtggcttgacgtctctggctcagtctcaacgttggtactacccagctcggtaccagcacgacccgcggccaggcctccacgcacgctnatgacaataacaaatgtacgcttacgtcgtcggggtccctgacttcgtccttcgtccgtcgccttcctacgttccgttacgggaactaaacgcttccgaccctacgacccaacgtccggtaaccgggggaccctaggaccagaatcggaatacgtaagtacgtagtaactttaagttacgttaggtcggttatcggtagttacgttaccgggttagggtttcgggtttcgggtttcggttttttaccgggttcggggttaccggggtaacggggtaaacccggtaaccggtacgggtacccgttaccggtaccccggttacccggttaaaccccggg

SEQ ID NO: 178147 - DNA, 740 bp, Homo sapiens
  misc_feature: GYAE6OF01EBDLC.49.24.C02.1.454.CMB.1.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccgggggganagtcacactcacttgnggcttgagctcgtggctcagtctctaacgttcggttacctacccgagtcgtcggtaccagccacgaccccgaggccaggcctaccacggccacgctcatcgtacgataaccaaagttacgtcgtacttccgttcgtcggggtccctgacttcgtcttctcgtcggtccttacccgtacttcccgttaacgggaaacctaaacggtcccgtaccggtcccctaccgtaaccccgtaaccgttacccgggaaccccggggggtacccccgaacgggacccgtaaggtacgttaggtacggtaacgtaaagtttcgggttaacgttattttaacgttacgttacggtttcgtccggttactttaggttacggttccgggtttgggggtttcgggtttaccgggttttcggtttttcggttacgggttccggggtaccgggtaacgggtaccgtaacggtccggtacccggttacccgtcccggttaacccgg

SEQ ID NO: 178148 - DNA, 555 bp, Homo sapiens
  misc_feature: GYAE6OF01DV2U2.49.24.C02.1.454.CMB.1.raw
  modified_base (485)..(485): a, c, t, g, unknown or other
  misc_feature (485)..(485): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtcaggtcggtccccggggggacagtcacactcacgttgtggcttgagctctggctcagtctcaacttggttacctaccccagctcggtaccagccacgaccccaggcccaggcctccacgcacgctcatgtacataacaaatgcgtctcttcgtcgggtccctgactcgtcttctctggcctccacttccgtaggaacaagctcgccctacaccacgtccggaccggggcccaggcagatgatgtaatgtagtattattacgttgtgtncgtgtatcgtggggtgttgttcgttttcggtcggttcgggcggacggtacacggctcgaccgtcgtaccg

SEQ ID NO: 178149 - DNA, 789 bp, Homo sapiens
  misc_feature: GYAE6OF01ELF0G.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacaggtcacactcacgttgtggcttggagcttcgtggctcgagttcctactaacgttcggttaacctaccccgagtcctacggtaacccacggaccaaccggacccccgagggacccgagggccctacccgaccggccaacggtcctacgattacggtaacgaactaaactaaacgtacgtaccgtcttccgtttaccgggttcggggttaccccttgtacttccggtccttttaccgtcgttcggtacccttaccgttaaccgttcccggtttaacgggaaaacctaaacgtcccgttcccgtaccccgtaccaacccgtaccgtacccgggaccgggggtccccaacgggaccgtaacgagtacgagtacgtaagttaggttacgtaactttagtttaccgtagttcgtcgttacgttacggttagttcgggttagggggttcggtttcggggtttttaccggttttttcgggtcggggttttccgggaccgggggtaaacgggtaccgttaacggtcccggttaaccggtaccccgttaccggtaacccgg

SEQ ID NO: 178150 - DNA, 980 bp, Homo sapiens
  misc_feature: GYAE6OF01BJTDV.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccaggagccatcgttgtcaggtcgggtccccggggggacacgtcacactctacttgtggtcttgacgtctcgtggctcagttcctactaacgttaccggttaccctaaccccgtagtccgttacggtaaccccgacgacccgaaccggaaccccccgacggggaccccgaacggggttcccctaccccggaacccgaccccgaacccggtacccttaccgtaacgttacggttaaaccgaaaccttaaaccgaaaaacgtttaccggtacccgtcccgtttcccgttttaccgggttacccggggggtttccccctaaggtacccgttcccgttccctttccgttcccggttccggtccccttacccgttacgttcccggttaaacggggaaacctaacggtcccgttacccgtacccctacccgtaaaccccgtacggttaccccgggaaccccgggggtccccgaacgggtacccggtaacgtaacggttacggacggttaacggtaaacgttcggttaaacggttttaacgttttaaccgttttaaaccggttgggtttacgggttacgttaccgttttacgggttacggttttcccgggggtttagggggtttccggggtttttccggggtttttcccgttttttttaccggggggtttcggggtttaccccggggggtaaacccggggttaaaccggggttaaacccccgggtaaggttacccccggtttaacccggggttaaccccccggttaccccggtttaacccccgggg

SEQ ID NO: 178151 - DNA, 883 bp, Homo sapiens
  misc_feature: GYAE6OF01CHJHZ.49.24.C02.1.454.CMB.1.raw
tcagagtcgagagacacgaccggtgctcgatttagtacagatcgttagggaaaggggaaaaggccctcgaggaaaaccaaaaccccagctgggaaggcctagacggaacacgtagccttcattgagtcgtccccaccagtcggcctggatgatgcttctccgtcggtacctcccgttggccttaagtcggtatccgaggttaggtcggaaatccctacgacgtacgtccggtcgggtccgaaccccgtagggacggtcccaacgttccggtttcggtccgtacgggttccggggtacccccggggggggtaactacggtaccgaccggaccttccgtaccgtttagggtcgggtccgtttaggacggtccttcgttcggccttcgtaacggttccttaccgtaaaccgtttccgggtttaaccctaaccccgaggtaccgttacgggtaacccacggaccgaacccggaccccgacgggacccgacggccctacccgaccgccaccgtcctacagtacgtaaccgaataacctaaacgtacgtcgtccttcgttcggtccgggtccctgtactccgtcttcgtcgttcgacccttccgtacgttacccggtaagggaaacctaacggtccctacccgaccccttacgaacccgtacggtaccccggggaacccgggggtacccaacgggaccgtaagtacgtacggtaagttaacggtaagttcgttaagttactttacgtttaccgttggttcgttacgtcgtttagggttacgttcggggttaggggtttggtttccgggtttcgtttttacgggtcgggttaccgggacgggtaaccggtaccgtacgtcccggtaccggttaccccgtcggtaacccgg

SEQ ID NO: 178152 - DNA, 625 bp, Homo sapiens
  misc_feature: GYAE6OF01A0OXW.49.24.C02.1.454.CMB.1.raw
  modified_base (241)..(241): a, c, t, g, unknown or other
  misc_feature (241)..(241): n is a, c, g, or t
  modified_base (412)..(412): a, c, t, g, unknown or other
  misc_feature (412)..(412): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagagtcgagagacacgaccggtgctcgatttagtacagatcgttagggaaaggggaaaaggccctgaggaaaacaaaccccagctgggaagcctgagaacacgtagccgttcatgagtgtaccccaccatggcctgggatgatgcttctcctcggactccttgcttatggatcaggtgtggaatctcagactgtggtcgacccaggagccatcgttgtcgagtcggtcccggggggacngtcacactcacgttgtggctgacgctctggctcctagtctcaacgtggttacctacccacgctacggtaccagcacgaccccaggccaggcctccgacgcacgctcatcgtaacataccaagtacgtcgtctctcgtacggggtccctggactcgcttctcgtcggctccntccgttagggaactaacgctcgccctcaccacgtccgggaccggggcccgnggacgacgngtcgagtcgtaatacggtagtaattagttacgtgttgtacgtgttagtgttcgggtcgggtttgggtcggttttggttttccgggttcggggtttccgggtacgggtaacgggtaccgtacgggtcctaccgggttaccgtcccgtacccggg

SEQ ID NO: 178153 - DNA, 576 bp, Homo sapiens
  misc_feature: GYAE6OF01EEI8A.49.24.C02.1.454.CMB.1.raw
  modified_base (236)..(236): a, c, t, g, unknown or other
  misc_feature (236)..(236): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganagtcacactcacttgtggcttgagctctggctcagtctctaactggttacctaccccagctggtaccagccacgaccccagggccaggcctaccacgcacgctcatgtaacgataacaaatagtcgcttcttcgtcgggtccctgactcgtctttctcgttcggccttccgtacttccgttacgggaaacaacgtcctcgccctacaccctacgtccggaccggggcccaggcagatgagtagatgtgtattattatgtgtgtctgtgtgtgggttggttggtttcgttttcggtcggttcgggcgggtacggaccgtagtcgtcgtcccgtcgtaccgg

SEQ ID NO: 178154 - DNA, 962 bp, Homo sapiens
  misc_feature: GYAE6OF01DKDMC.49.24.C02.1.454.CMB.1.raw
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggacttccttgcttatggatcaggtgtaggaatctcagactggtggtgacccaggacncctatcgttgtcgaggtcgggtcccgggggganagtcacgtactcacgttgtggtcttgagtctcgtggctctcgtctactaacgttcggttaccaccccgtagtccgttacggtaacccaggaccgaaccgaacccccgaggaccccaacgggtccctacccgaccgcccaccgtcctaccgtaacgtaccggtaaacgtaaacttaaaccgaaaaacgtttccggtaccggttaccctttccggttttacccggggttccgggggtttacccccttaggttaacccggtttcccgtttacccgtttttaccggttccggtttcggggttacccccttttaacccgttaaccggttttaaccccgggttaaaggggtaaaacccgtaaaccgtcccggttacccgtacccccttaacccgaaacccgttacgggttacccccggggaacccggggggacccctaacggggtaacccgaaaggttaccggtaacggtttaaacgtaaccggggttaaagtttaacggtttaacggtttaacgttttaacggtttaacggttgggttttaacggttccggttacgtttagggtttaccggtttccggggtttagggggtttcgggttttccgggtttttccggttttttacgggggttcgggtttacccgggggtaacgggttaacccggggtaaccgtaaccgggttacccggtaacccgggtttaccccgtaaccgggtttaaccccggg

SEQ ID NO: 178155 - DNA, 700 bp, Homo sapiens
  misc_feature: GYAE6OF01ALUYC.49.24.C02.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggganagtcacnctcacttgtggcttgagtctctggctcagtctactaactggttacctaccccgagtcgtcggtaccacggccaacggacccccaggccaggcctaccaccgccacgctcagtgtaacgaatactaaatgtacgtctcgttcgtcgggtccctgactcgcttcgtctggtcctactacttccgttacgggaactaagtcctcgtcccacaccgacgcccgggaaccggggcccgacggacgagtacgtagagtacgtaagtacggttgtaactttacgttacgttggttcgttacgttcgttacggttacgtttcggggttaggggtttcggggttttcgggttttaccgggttttttcgggtttcggggttaccggggttaccgggggaacccgggtaacccggttaccggtaccggtttccccggttaacccgggttccccgtttaaaccccgggg

SEQ ID NO: 178156 - DNA, 573 bp, Homo sapiens
  misc_feature: GYAE6OF01CPL9A.49.24.C02.1.454.CMB.1.raw
  modified_base (266)..(266): a, c, t, g, unknown or other
  misc_feature (266)..(266): n is a, c, g, or t
  modified_base (387)..(387): a, c, t, g, unknown or other
  misc_feature (387)..(387): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccagggagccatcgttgtcaggtcggtccccgggggggacagtcacactcacttgtggcttgagctntggcctcagtctcaaacttggttactacccagctggtaccagcacgacccaggccaggcctccacgcacgctcatgtacgatacaaatacgtcgctcttcgtggggtcctgatcgtcttcnctggctcgatcttaggaacaagctcgcctcacactcgacggggcccaggcagtatgagtgaatgtgtatttattacgtgtagtcgtcgttgtacttcggtaggggtggtttcgggttccgttttttaggttcggttccgggtagggacgggtaccaaggtccgtacggtcccgttccgttaaccgg

SEQ ID NO: 178157 - DNA, 887 bp, Homo sapiens
  misc_feature: GYAE6OF01BP77S.49.24.C02.1.454.CMB.1.raw
tcagagtcgagagacacgaccggtgctcgatttagtacagatcgttagggaaaggggaaaggccctgaggaaaacaaaccccagctgggaagcctgagaacacgtagccttcatgagtgtcccccaccatggcctggatgatgcttctcctcggactccttgcttatggatcggtgtgagtctcagagtcgtggtggaccgacggaggcctactcgtttcgtcgtacggtcgggtccccggggggaccggtaagtaccgaccgaaccttaccgtaccgtttacggttgggccgtttcggtacggtcgtccgttcgggcctaccgtacgtccgttacctaaccgttacgggtttaccccttaaccccgtaccggtacgttaccggttaacccgaacgaccggaacccgaacccccggaaccggccggaccggacccgtacccgaacccgccgaaccgtacccgtcctaacgtacggttaaccggaaactaacgtaaaaccttaaaggttcccgggtacttcccgttttaccggtaccggggtttcccccgtacgttaccgttacccgtcccttttaccgttccgttaccgggcttacccctacgttacccgtttacggggaaacccgtaaacgtccgttaccgtcccccgttaaccctaccgtaaccgtacccggacccgggggtccccgacggccgtaacgacgttagagttaacgacgttagttcggttaactttacgtttaagttcgttcgggtcgttaccgttggttaccgttcgggttcggggttcgggtttacgtttccgttttttagggtcgggttaccggggtacggtacgggaaccctagggtcccgtacgttccccggttaccggttcgtaaccccgg

SEQ ID NO: 178158 - DNA, 795 bp, Homo sapiens
  misc_feature: GYAE6OF01ARR70.49.24.C02.1.454.CMB.1.raw
  modified_base (248)..(248): a, c, t, g, unknown or other
  misc_feature (248)..(248): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtggtccccaccatggcctggatgatgcttctcctcggactccttgcttatggatcaggtgtggaatctcagactggtggtcgacccgaggacgccattcggttggtcgaggtcgggtccccggggggganacggtcactactcacgttgtcggtcttgacgcttcgtggctcgtagtctacctaagttcggttaacctaccccgagtccgtacggtaccagaccgaccgaccccgacggccacggcctcccgacgccacgcctacatacggtacaactaactaaagtacgttccgacttccgttacgtccgggttcctaggtcgttcgtcctttcgtcgtacggtcccttaccgtacgttcccggtttaaagggaaacccttaacggcccgttacccgtaccccgtaccaaccgtaccgttcccgggaacccgggggtaccccgacggtaccggtacgtaagtaccggtaacgttacggtaacgttaggttacggttaattttaacgttcgtttaaccggttggttaccgtggtttaacgggtcgtttcggggttacggggtttacgggtttcccgggttttcgggttttccggggttcggggtttacccgggaccggggtaaccgggtaccgaccgggttaccggtccgtaaccccgggtttcccgtaaacccggg

SEQ ID NO: 178159 - DNA, 823 bp, Homo sapiens
  misc_feature: GYAE6OF01CEUA6.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtaggaatctcagtactggtggtcgacccgaggacgcctagtcgttgtcgacggtccgggtaccccgggggggacacggtcacactcgtacgttggtcggtcttgagcttcgtggcctctagtcctactaaacgttccggttaacctacccccaggtccgtacggtaaccgacgaccgaaccgacccccgacggaccaccggtcctaccgaccgacctaccggacctcgtaacgtacggtaaccgaacttaaactaaaacgtacgtctaccttcgttcgtaccggggtcctagtactccgtcttcgtcgtcgtcctaccgtacgttacccgttaagggaaacctaacggccttacccggaccccttaccaaaccgtacggtaccccggggaacccgggggtcccgaacgggtacgaacggtaactaggtaacgtaacggttaaagttagttaacgttaacgttttaactttaacgggtgtttaaggttcgtaccggtttaggttacggttccggggtttggggttacgggttttcgggttttaccggttttttcgggtcgggggtttaccggggaacggggtaaacccgggtaaacccgaccggttaaccggtccccggtaaacccgggttcccttaaacccgggg

SEQ ID NO: 178160 - DNA, 830 bp, Homo sapiens
  misc_feature: GYAE6OF01D6BFS.49.24.C02.1.454.CMB.1.raw
  modified_base (169)..(169): a, c, t, g, unknown or other
  misc_feature (169)..(169): n is a, c, g, or t
  modified_base (217)..(217): a, c, t, g, unknown or other
  misc_feature (217)..(217): n is a, c, g, or t
  modified_base (411)..(411): a, c, t, g, unknown or other
  misc_feature (411)..(411): n is a, c, g, or t
  modified_base (494)..(494): a, c, t, g, unknown or other
  misc_feature (494)..(494): n is a, c, g, or t
tcagagtcgagagacacgaccggtgctcgatttagtacagatcgttagggaaaggggaaagccctagaggaaacaaaccccagctgggaagcctgagaacacgtagccttcatggacgtgtccccaccatcggcctggactgatgcttctccgtcggactcctgcttanggatcgaggtgtgaatctacgagactggtcggtcgacccgtagggacnccgtagttcgttcgtcgtacggttcggggtaccccggggggatacggtacctaacctaccgtactacgttgtcggtcgttcggacgccgttcgtggtcctacacggttctacgtaacgttcggttaaccctacccgagtccgtacggtaaccacggaccaacgtacccgacggtacccacggtccctaccgacncctaaccgtcctacgtacgtacgtacccgaacttaacgtaaacgtccgtaccgtaccgtttccgttacggttcccgggtaccngttacgtccgtccgtttactccggtacgtccttaaccgtacgtttacccggtacggtaaacctaccgttcctaccgtaccccttacgaccgtacggtaccccgggaccggggttacccaggtacctaggtaacgtacgtagttaacgtacgttacgttaacgttaacgtttacgttacggttacgttagttaaccggtgtttaccggttaccggttcggtttacggggtttaccgttttccggggtttaccgttttcgggggtaacccggttcggggaaccgggttaccggtaacgtaacccggttcgtaacccggttcccgttacgggtaacccg

SEQ ID NO: 178161 - DNA, 629 bp, Homo sapiens
  misc_feature: GYAE6OF01CAXXE.49.24.C02.1.454.CMB.1.raw
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatccgttgtcaggtcggtccccggggggganaggtcacacctcacttggtggcttgngctctggctcagttctcaactcggttacctaccccagcctacggtaccagccgacgacccccgaggcccgacggcctcccaccgccaccgcctcatgtacgataacaaatagtcgtcttcgttcgtcggggttccctgactcgtctttcgtctcggcctccgtacttccgttacgggaacgaacgtcctcgcccctccacccactaccggacccggggcccgacggacgacgacgtgagtagatgtagtatttattacgttgttgtcgtcgttgttagtcgttggggtggtttcggttggtttttcggtggttcgggtcgggtacgggtaccgtaggtaccgttcggtccgtcccgtacccgg

SEQ ID NO: 178162 - DNA, 669 bp, Homo sapiens
  misc_feature: GYAE6OF01D00AD.49.24.C02.1.454.CMB.1.raw
  modified_base (239)..(239): a, c, t, g, unknown or other
  misc_feature (239)..(239): n is a, c, g, or t
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
tcagagtcgagagacacgaccggtgctcgatttagtacagatcgttagggaaagggggaaaggccctgaggaaaacaaaccccagctgggaagcctgagaacacgtagccttcatgagtgtcccaccatggcctggatgatgcttctcctcggactccttgcttatggatcaggtgtggaatctcagactgtggtcgacccaggacgccagtcgttgtcaggtcggtccccgggggganaggtcacgactcacttgtggcttgagtctctgcttcagtcnctaacgtcggttaccacccagctggtaccagcacgacccngccagctcacgcacgctcatcggtacataacaatcgtcgtctcgttcgtcgggtccctagactcgctttcgcttcgctcctacgtccgttacgggaactaacgtctaccgccccgtacaacccgtataccggaccggggacccgacggccgagtactaggaagttcggtaaagttcggttagtaactttacgttactttggtacgttcgtcggttacgttacggttcggttgggggtttcgggtttcgggttttacggttttttacggttcccggggtttacgggaccgggttaacggggtacccgtaacggttaccgttaccggttaccccggttccggttaacccgg

SEQ ID NO: 178163 - DNA, 864 bp, Homo sapiens
  misc_feature: GYAE6OF01C0HJ9.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccagggacgccatcgttgtcaggtcgggtccccgggggggacaggtccacacctcacgttggtggtcttggagtctcgtggcctacgtacgtcttaccaaccgttacggttaaccctaccccgaagtccgttacgggtaacccaggaccgaaccggaacccccgacggtcccgaacggtccctacccgaaccggccaccggtcctactacgttacggtaaccgaacttaaaccgtaaagttaacggtccgttccgttccgttttaccgggttcgggggtttacccctaggtacccgttccggttcctttccgttccgttcgggtcccttaccgtacgttacccggttaacgggaaacctaaaccggtcctacccggtacccctaccgtaaccctaccggtacccggggaaccccgggggaccccgaagggaccgtaacgtaagtacggtaagttacggtaaagttacggttaagtttaactttacgttaacgtttgttacggttgttaccggttaggtttacgtccggggtttagggggtttcgggtttacggggtttttccgttttttcggggttcggggttcccggggtaacgggggttaacggtaaccccgtaacgggttacccgttaccgggtaacccccggtttcccgtaaacccggg

SEQ ID NO: 178164 - DNA, 864 bp, Homo sapiens
  misc_feature: GYAE6OF01D7VPM.49.24.C02.1.454.CMB.1.raw
  modified_base (255)..(255): a, c, t, g, unknown or other
  misc_feature (255)..(255): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggacgccatcgttgtcagtcggtccccggggggacacgtcacactcacgttgnggtcttgagtctctggcctcgtgtcctacctaacgttcggttaacctaccccgagtccgtacggtaccagccaaccggaccccgaaggcccacgggcctcccgacggccaacgtctactagttacggaacgactaacgtaaacgtacgtcgtacgttccgttcgttaccggggtcccttagtaccgttccgtcgtttccgtcgtccgggtcccttaccgtaccgttacccgtttaccgggaaacgtaaacgtcccgtacgtccccctaaccgtaccgtaaccggtacccgggtaacccggggggccccaacgggaccgtaacggaacgttacggtaacgtaacggtaaagttacggttacgtttaacgtttaacgttttaaccgttaggtttaccgggttacgttccggtttaacggtttaaccggttttccggggttggggggtttttaccggggttttcgggggttttttacccggttttttttcccgggggttacggggttttaccccggggggtaacccggggggtaaacccgggggttaacccggtaaaccgggttccggtttaaacccgggttacccccggtttacccgggttaaaccccggg

SEQ ID NO: 178165 - DNA, 791 bp, Homo sapiens
  misc_feature: GYAE6OF01EQP9J.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtcaggtcggtccccggggggacagtcgacactctacgttgtgcttgacgtctctggctcagtctctaacttcggttacctaccccgagccttacggtaacccacgccaaccggaacccccgaggacccacgggccctacccgaccggccaaccgcctacatcggtaaccgaataacaaaatacgtcgacttccgttcgtccggggtccctgtactcgtcctttcgtcgtcggtccttccgtacgttccgttacgggaaacctaacggtccgtaccgtacccctaccgtaacccgtaccggttacccgggaaccccggggggtacccccgaacgggacccgtaacggtaacgttacggtaagttaacgggtaaacgtttagggttaaggtttaacgttttaaggttttaaccgttacggtttcggttacggttccgtttagggtttacgttccgggtttagggggtttcggggtttcggttttccgggttttttccgggttcggggtttacccggggtacgggtaacgggtaccgtaacgggtccgttaccggttaccccggtaccgttaacccgg

SEQ ID NO: 178166 - DNA, 692 bp, Homo sapiens
  misc_feature: GYAE6OF01B6WG0.49.24.C02.1.454.CMB.1.raw
  modified_base (244)..(244): a, c, t, g, unknown or other
  misc_feature (244)..(244): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactggtggtgacccaggacgccagttcgttgtcgaggtcggtccccggggggganacgtccgacactcacttggtggcttggagtcctcgtggctcagtcctacaacttggttacctaccccagcgtacggtaccagccacgaccccgacggaccgacggcctacccacgaccacgcctacagtcgtaaccgtataacaaagttacgtcgtcttcgtttcgtcggggttccctggtactcgtcctttctctcggtcctcctacttccgttagggaaacaacgtccgtcgtccctacaccgtacgtaccgggaccggggcccaacggctagacgtagatacgtaagttgtaagttatttaacgttcgttagttggttgtacgttggttacgttcgggttagggtttcggggtttcggttttcggttttttcgggttcgggtttcgggacccgggtacgggtacccgtaagtccggttaccggtacccccgttcggttaacccgg

SEQ ID NO: 178167 - DNA, 643 bp, Homo sapiens
  misc_feature: GYAE6OF01EGWAO.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcggtccccgggggggacacgtcacactcacttgtgcttgagctctggctcgagtctactaacgttggtttacctaccccgagtctacggtaccagccacggacccccaggcccgacggcctaccgaccgccacgcctacattcgtaacgaactaacaaatacgtcgtcttcgttcgtcggggtccctgtacttccgtctttctcgtcggtccttcctacgttccgttacgggaaactaacgtcctcgaccctcaaccgtacgtaccgggaccggggcccaggcagatagagtagaagtgtagttatttacttcgttgtgtcgtcgttgttagttcgggttgggttggttcggttttgtttttcggtcgggtttcgggacggggtaaggtaccgtaaggtccgtacggtcccgtccgtaccg

SEQ ID NO: 178168 - DNA, 930 bp, Homo sapiens
  misc_feature: GYAE6OF01A3EG8.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggatctcagactggtggtcgacccgaggacgccagttcggtttgtccgtacgggttccgggtacccccggggggggactacggtccaaccaaccttcctaccgtttggtcgggtctttcggacgtcgttccgtcggcctaccgtacgttcctaccgtaaaccgtttacgggtttaaccctaaccccccgtaaggtcccggttacgggtaaccccgaacggaccccgaacccggaacccccgaccggggaccccgaacggggtcccctaccccggaaccggacccgaaccgtcccttaaccgtacgttacgtaaaccggtaacttaaaccgtaaaaacgttccgtaccggtcccttaccggtttccggtccggggttacccttggtaccgttcccgtcctttccgtccgtacggtcccttacccgtacgttcccggttaacgggaaacctaacgtccgtacccgtcccctaaccgtaacccgaccggacccggggtacccggggtaacccgacggtaacccgaggttaccgtagtaacgttaggtaaacgtttagttaacgttaacgttttaactttacggttggttacgttcggttacgtttaagggttcgttcggggtttcggggtttcgggtttacgggtttttccccggtttttagggttccggggtttaccggggtccggggtaaaaccggttacccgggtaacgggtcccgttaacccgggttacccccggttcggttaaccccgg

SEQ ID NO: 178169 - DNA, 721 bp, Homo sapiens
  misc_feature: GYAE6OF01A37U8.49.24.C02.1.454.CMB.1.raw
  modified_base (240)..(240): a, c, t, g, unknown or other
  misc_feature (240)..(240): n is a, c, g, or t
  modified_base (281)..(281): a, c, t, g, unknown or other
  misc_feature (281)..(281): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggagccatcgttgtcaggtcggtccccggggggganagtcacactcacttggtggcttgagctcgtggctcagtccnaacttggtacctcccagctggtaccagcacgacccaggccaggcctccgacgccacgctacatcgtaacgataacaaacgttagtccgtctttaccgttccggttacgggggtttcccctaggtaaccgttccgtcttttccgtcgttcgggtcccttacccctacgtccccgtttagggggaaacctaaaggtccctcggtccccttacaaccctaccgtacccgggacccggggggaccccacgggaccacgaacgtagagttacgaagttacggtagtaagtttagtttaaccgttgttggtacggtcgtttaggttacgtttccgggttgggtttacggggtttcggtttcccggtttttttcgggtttcggggttcccggggttacgggtacggggtaaccgacggttacgtcggtacccgttccgttaacccgg

SEQ ID NO: 178170 - DNA, 1128 bp, Homo sapiens
  misc_feature: GYAE6OF01AETDI.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccagttcgttgtcgacggttcggggtccccgggggggacacggtccacctacctcgtaccgtttggtcggtctttggacgtccgttcgtcgggtccttccgtaacggttccttactaaaccgttcgggtttaaccctacccccgagtccgttacgggtaaccccacggccgaaccggacccccgagggaccccgacgggtccctacccgaccggacctaacccggtcctaccgtaacttacgggtaaccgtaaacttaaaccgtaaaaagttaccggttacccgttaccccgtttccgtttttacccggggttccgggggggtttaccccccttagggtaacccgttccccgggtttcccgtttttaccccggtttccccgggtttccggggtttaccccctttaccccgttaacccggttttaccccgggtttaaaccgggggtaaaaccccgtaaaaccgggtccccggtttaacccccggtccccccgtttaaccccgtaaacccccgttaacccgggttacccccggggtaaaccccggggggggtacccccccgaaaccgggggtacccgtaaccggggttaacgttaacgggtaaacgttaacgggttaaacggtttacgggttaacggtttaacgttttttaaacgttttaaccggtttcggggttttacgggttaccggtttaaccggttttacgggtttaccgggtttaccgggggttttaggggggtttcgggggttttttcccgggtttttacccggggtttttttttacccgggggttttccgggggttttacccggggggttaacccggggggtaacccggggttaaaccccgggttaaacccgggtttacccgggtttaaccccgggttaacccccgggtttaccccgggtttaaacccccgggg

SEQ ID NO: 178171 - DNA, 708 bp, Homo sapiens
  misc_feature: GYAE6OF01C37BV.49.24.C02.1.454.CMB.1.raw
  modified_base (242)..(242): a, c, t, g, unknown or other
  misc_feature (242)..(242): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccgaggacgccagttcgttgtcaggtcggtccccgggggganacgtcaacgactctacttgtggtcttgagtcctcgtggctcgtacgtccttacaaaccgtttcggttaaccctaccccgagtcctacggtaccagaccaaccgaccccgaggaccacggccctccgaacgccaacgtctacgagttacggactaataacgaaactacgtccgtacttcgtttccggtcgggtaccctgtacctcggtcttccgtcgtcggccttactacgttacgttacggaaactaacgtccgtacccgtccctaacgaccgtaccggtcccgggaaccccgggggacccaagggacctaaaggtacgtaagtagtaaccggtaatgggtttaactaagtttacgttacgttgtacgttgacgtttagttacgtcgggttgggttcggtttcggtttgtttcggtgggtccgggaaggtaccgtacgtacgcgttacggtacccttcgtaaaccg

SEQ ID NO: 178172 - DNA, 650 bp, Homo sapiens
  misc_feature: GYAE6OF01BCGYB.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatagatcaggtgtggaatctcagactgtggtgacccaggacgccatcgttgtcaggtcggtccccgggggggacagtcacactcacgttgtggcttgagtctctggctcagtcctcaacgtcggttaccacccagctggtaccagccacgaccccaggccaggcctccacgcacgctcatgacgatacaaatgtcgctcgttcgtcgggtccctgtactcgtcttctcgtcggctccacgtccgttacggaacaagtcctcgccctacacctacgtccggaccggggtcccagggaccaggtactagacgtagtaagtgtagtaacgtttagttacgttgttcgtcgtacgttaggtagttccgggttgggggttacggttttcgggtttccggttttttacgggtcgggttttacccgggggacgggttaacggggtaacccgtaagggtacccgttacggtaccccggttccgttaacccggg

SEQ ID NO: 178173 - DNA, 862 bp, Homo sapiens
  misc_feature: GYAE6OF01BV67N.49.24.C02.1.454.CMB.1.raw
  modified_base (299)..(299): a, c, t, g, unknown or other
  misc_feature (299)..(299): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgcccccaccatggcctggatgatgcttctcctcggactccttgcttatggatcaggtgtggaatctcagactgtggtgacccaggagccatcgttgtcaggtcggtcccggggggacagtcacactcacttgtggcttgacgctcgtggctcgagtcctcaacgttcggttacctacccngctcggtaccagcacgcccaggccagccaccacgcacgcctacatcgtaacataacaaagttacgtcgtctcgtttcgcggggttccctgactcgtcttctctcggctcctactcgtaggaacaanctcgtcccncacctcgccggaccggggcccagacagtagtagacgtagtacgttaggtacgttaagtttaactttacgtttggttacggttacggttacggtttacgggtttaaaccgttttccggggggttttacgggggggttttacgggggtttttcccggggtttttttcccgggggtttttttttccccggggggtttttaacccgggggggtttttaccccccgggggggggggtttaaaaccccgggggggggtttaaaaaaccccccggggggggggttttaaaaacccccccgggttttaaaaccccggggggggttttaaacccccccgggggtttttttaaaccccccggggggttttaaaaccccccccccgggggggtttttaaacccccccccggggttttttaaaaaccccccccggggggg

SEQ ID NO: 178174 - DNA, 641 bp, Homo sapiens
  misc_feature: GYAE6OF01CZ7ZF.49.24.C02.1.454.CMB.1.raw
  modified_base (259)..(259): a, c, t, g, unknown or other
  misc_feature (259)..(259): n is a, c, g, or t
  modified_base (543)..(543): a, c, t, g, unknown or other
  misc_feature (543)..(543): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtctaggtcggtccccgggggggactagtcgacacctcactttgnggtcttgagctcgtggctcagtctacgaacttcggtacctaccccgagtcctcggtaccacgcgacgtaccccaggccagggcctacccgacgtccgaccgtctcgactacggtaaccgataaccgaaagttcgtcgtacttcgttcggtcgggtccctgtactccgtcttccgtacgtcggcttccagttccgtaggaacagtcctcgtccctactacctacgtccgaccggggccaggcaggtactagtagtgaagttgtacgttattacgttagtgttcgntgttgttacgttcggtgggttacggttcggtttcggttttcgggtggttccgggacggtacggtaccgtagtcccgtacggtcccgttccgtaaccgg

SEQ ID NO: 178175 - DNA, 727 bp, Homo sapiens
  misc_feature: GYAE6OF01E3I3A.49.24.C02.1.454.CMB.1.raw
  modified_base (243)..(243): a, c, t, g, unknown or other
  misc_feature (243)..(243): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggacttccttgcttatggatcgaggtgtggaatctcagactgtggtgacccgaggacgccagttcgttgtcaggtcgggtccccgggggganagtcacactcacttgtggcttgacgctcgtggctcgagttctactaacgttggttaaccctaccccagtccgtcggtacccaggccaaccggacccccgaggcccacggtccctaccgacggccaccgtctacattacggtaaccgtaaataaccgaaaattcggtccgtacgttccgttacggtccggggttccctggacttccgtccttctcgtcgtcccttactacgtccggttaagggaaacctaacggtcctacccgtaccctaccgtaccctaacggtacccgggacccgggggcccaacgggaccgtaagtagttacggaagttaggtaactggttaatagtttaacttacggtgttacggttcgtacttgggttacgttcgggttggggttcggtttcggttttcggttttcgggttcgggttacgggacggggtaaccggtacaacggtccgttacggtccccgttcggtaacgg

SEQ ID NO: 178176 - DNA, 775 bp, Homo sapiens
  misc_feature: GYAE6OF01DXMXQ.49.24.C02.1.454.CMB.1.raw
  modified_base (258)..(258): a, c, t, g, unknown or other
  misc_feature (258)..(258): n is a, c, g, or t
  modified_base (751)..(751): a, c, t, g, unknown or other
  misc_feature (751)..(751): n is a, c, g, or t
tcagagtcgagagacacgaccggtgctcgatttagtacagatcgttagggaaagggaaaaggccctgaggaaaacaaacccagctgggaagcctgagaacacgtagccttcatgaatcgtccccaccatggcctggatgatgcttctcctcggactccttgtcttagtggatcgaggtgtaggtatctcgagactgtggtacgacccgaggacgctagttcggttgtacgtagggtccggggtaccccgggggggaanacggtaccacgtaccgtcgtacgttggtcggtcgttaggagtccgttcgtcggtccttccgtacgttcctaaccgtaaccggtttccggttaaccctacccggtacgtccgttaccggtacgaacgacccgacccggaaccccgacgggacccgaacggtccctaccgaccggccctaccgaccttacgtagttaacggtaacaaacgtaaactaaagttcgtaccgtcgtttccgttcgggtttccgggtcccttgtaccgttccgtccgtttaccgtcgttaccgccttaccgtacgttacccggtaaggaaccgtaacgttcccgtacctaccctaccgtaccgtaacggtcccgggaaccgggaccgtacgacgtacgaacgtatagtagtaagttcgtaatttactagtttacgtgtgtactgttactggttcggtggtcgttttggtttgtttcgggtggttccgggagggtaccgtacgggttacnccgggtaccgtcgtccggtaccgg

SEQ ID NO: 178177 - DNA, 980 bp, Homo sapiens
  misc_feature: GYAE6OF01AZCHC.49.24.C02.1.454.CMB.1.raw
  modified_base (168)..(168): a, c, t, g, unknown or other
  misc_feature (168)..(168): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtcgtcccccaccatcggcctggatgatgcttctcccgtcgtccttccgttntcttagtgtactcgtaggtgtagtactctacgacgtacgttggtcggtaccgaaccggaggaccgtaccttacgtttccggttacgtaccggtacggggtccccggggggttaccccgggggaataccgtacctaaccgttacctaccgtttacggttcgggtacgttcgttacggtaccgttccgttccggtccgtccgtaccgttacgttccctaacgttaaccggtttacccggttaacccctaccgtacgtccggttaccgtaacccacgacccgaccccggacccgtacggacccgtacggtccctacccgaccgccgacgtcctacgtacgtaacgtaacaactaacgtaacgttcggtccttccgttacggtttccgggtcccggttacctgtaccgtttccgtccgtttaccgtcgttcccgtaccctttacggtacccgtttaaccgggtaaaacgaacctaccgttcccgtaccccgtaccctaaccggacccgaaccgggtccccggggacccgggacctacggtacgtaacggttacgtagtaacgttacgtaacgggtttagttaaacccgtttttaagtttaccggtttgggttacgggttcttaccgggttacgttttaaggtttccggggtttagggggtttccggttttcggggttttaccgtttttacccggggtttttcgggggtacccgggggaaccccggggttaaacggggttaaaccccgaacccggttttacgggtacccccggttttaaaccccggggttaacccggtttccccgtaaaccccgggg

SEQ ID NO: 178178 - DNA, 838 bp, Homo sapiens
  misc_feature: GYAE6OF01AUHWC.49.24.C02.1.454.CMB.1.raw
  modified_base (247)..(247): a, c, t, g, unknown or other
  misc_feature (247)..(247): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttccttgcttatggatcgaggtgtggaatctcagactgtggtcgacccgaggacgccagttcgttgtctacggtcgggtccccgggggganacggtccactactctaccttggtcgtcttgacgcttcgtggtcctcgtacgtcctacaaccgtttacggttacctaccccgagtccgtcggtaaccacgaccgaaccggtaccccacgggacccgacggtcctcccgaaccggaccaccgcctaccgagtacgttaacgaacttaactaaagttacgccgtccttacgtttccggttaccgggtccctagtaccgttccggtcctttccgtcgtcggtacccttcccgtacgtttcccggtaagggaacctaaacggtccttaccgaccccgttacccaacccgtaccgttaccccgggaaccggggtacccccaacgggtaccgacggtacgttagggacttaacggtaacgttagttacgtttaacgtttacgtttacgttggtttaggttcggttaccgtttacggttacggtttcgggtttagggggtttcgggtttccgggtttttcgtttttttaccggggttcggggtttacccggggtaccggggttaaacgggtaacccggttaacgggttacccggttacccggttaccccggttacccgttaaccccggg

SEQ ID NO: 178179 - DNA, 840 bp, Homo sapiens
  misc_feature: GYAE6OF01C3CTJ.49.24.C02.1.454.CMB.1.raw
tcagagtcgagagacacgaccggtgctcgatttagtacagatcgttagggaaagggaaaaggccctgaggaaaacaaacccagctgggaagcctgagaacacgtagccttcatgagtcgtccccaccatggcctggatgatgcttctcctcggctccttgcttatggatcgaggtgtggaatctcagtactggtggtcgaccgaggacgcctattcggttcgtctagggtccggggtccccggggggacacggtccactactcctacgttggtggtcttggtagtctcgtcggtctacgtacgtacctaccgtaacgttaccggtttaacccaccccgtagtccgtacggtaaccacgaccaaccgaccccggacggcccgacggtccaccgaccgactaccgcttacgaacgttcgtaacgaactaaacgtaaaacgttcgtccgtccgttccgttccgggttccgggttacccttggtaacccgtttccggttccctttcgtccgtccgggttaccccttaccgttaacggttacccggttaacgggtaaaacctaaccggttcccgtcccggtaaccccctaccggtaaccccgtacgggtaccccggggaacccgggggccctaacgggactacggtacgtaaggtacggttaagtacgtttaggttacgttaacgttttaccgtagttggttacgggttatccggtttaggttaccgttggggtttacgggttgggttttccggttttcgggttttgggtaccgggttacgggggtaccgggaacggtaaccggttacggtacccggttaccgtacccggggtccttaaccgggg

SEQ ID NO: 178180 - DNA, 802 bp, Homo sapiens
  misc_feature: GYAE6OF01CLVJJ.49.24.C02.1.454.CMB.1.raw
  modified_base (214)..(214): a, c, t, g, unknown or other
  misc_feature (214)..(214): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccccacatggcctggatgatgcttctcctcggacttccttgcttatggatcgaggtgtggaatcctgagactggtggtcgacccgagggacncctagttcgttgtcgaggtcggggtacccggggggactagtacacaccttcacgttggtcgcgttggagtccgttcgtcggtccttcgacgttctacctaacgtttacggttaacccaccccgtagtccgtacggtaaccacgacccgaaccgaccccgaggcccgacggccctccgaaccgccaccgtcttacacgttacggaaccaattaacctaaagtcggttccgtacttccgtttccggtcggggtccctagtcgttcgtaccctttcgtccagggtcccttaaccgtccgtttaccggttaacggaaacgtaaaccgtcccttaccgtaccccgtactaacccgtacggtacccggggaacccgggggacccaacggacggtaacggtacttaaggtacgtaagttaacgtagttaggtttaacttagtttacggttgttcggtacggttgttggttacgtcgggtttggggttcgggtttcgggtttcggtttttccggggttcgggttacccggggtacggggttaaccgggtaacctacgggttacccggtaccgggtacccggttaccgttacccggg

SEQ ID NO: 178181 - DNA, 778 bp, Homo sapiens
  misc_feature: GYAE6OF01B301E.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtgacccaggagccatcgttgtcagtcggtcccggggggacagtcacactcacgttggtggtccttggacgtcgttcgtggcctcgtagttcctactaacgttcggtttaaccctacccccaggtaccgttacggtaacccgaggtaccaaccggaacccccgagggccccgaacggtcctacccgaaccggtccaaccggtcctactaacgtacggtaaccggtaactaaaccgtaaagttaccggtacgtccgttaccgtttccgggtcggggttccctaggtacgtccgtcctttcgtcgtcggtaccttccgtacgttaccgtttaacgggaacctaacggttccgtaccgtccccgtaccaaccgtacggttacccgggacccgggggaccctacgggtacgaggtaacggtcggtaacttaggtaacgttaggttaagttaagtttaacgttacgttggtaggtcgttccgtggtttacgtccgggttaggggttcggtttcggtttcgttttacggttcgggttcgggaacgggtacggtacccgtacgtaccggtcgttacccggtcgtacccgg

SEQ ID NO: 178182 - DNA, 736 bp, Homo sapiens
  misc_feature: GYAE6OF01DOCOS.49.24.C02.1.454.CMB.1.raw
  modified_base (188)..(188): a, c, t, g, unknown or other
  misc_feature (188)..(188): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtcgtccccaccatggcctggatgatgcttctccgtcggactccttgcttatggatcgaggtgtggaatctnagctggtggtcgacccgaggcgaccattcgttgcgtacggtcggggtccccggggggaatacggtcaacctctcgtacgttgtgtctgacgtctcgtcggctacgacgtctactaacgttcgttaacctacccgtacgtccgtacggtaaccacgtaccgaccgtaccccgacggaccgacggccctcccgaacgcctaccgcctacctagtaacggtaactaacgtaacaaacgttcgtacctccgttccggtttaccggtaccgggttccctacggtacgtccgttcgttcgttcgtcggtacctccgtacgttacccgtaaggaaaccgtaacgtcctacccgtccaaccgtcccgtaaccggtacccgggaccggggtacccgaacggacgtaacgacgtaagtagtaacgtcgtttagtacgttaatttaccggttagttcgttacgtcgtattagttgttcggttggttacggtttcggtttcgttttggtccggttcggacggtaacgtacggacgtacgtccgtacccgtcgtaacccgg

SEQ ID NO: 178183 - DNA, 767 bp, Homo sapiens
  misc_feature: GYAE6OF01C9F9E.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctccctcggacttccttgtcttagtggatcgagggtgtaggaatctacagtacgtggtggtacgacccgaggacgacctagttccgttgtcgtacgggttcccggggtacccccgggggggactacggtaccaacctacctacctacgtttggtcggtcttaggacgtccgttcgtcggtctacgtacgttctaaccgtaacgtttaccggttaaccctaccccgagtccgtacggtaaccgacgaccgaacccggaaccccgacggccgacggccctaccgaacgccaacgtcctacgtagtacggtaactaactaaactaatacggtcctcttcgttccggtacgggtccctggtacctcgttaccttcgtcgtccgccttaccgtacgttccgtaacggaaactaacgccttaccgaccctacctaaccgcggacccgggtaccggggacccaggacgtagactagagtacgtaagttgttagttaacgtttagtacgttggttattcgttacggttagttacggttcgggttggggttcggttttacggtttcgtttttcgggtacgggttccgggaaggtacgtacgtacgtcggtaaccgtcccgtacgtacgg

SEQ ID NO: 178184 - DNA, 552 bp, Homo sapiens
  misc_feature: GYAE6OF01BCPJX.49.24.C02.1.454.CMB.1.raw
  modified_base (235)..(235): a, c, t, g, unknown or other
  misc_feature (235)..(235): n is a, c, g, or t
  modified_base (383)..(383): a, c, t, g, unknown or other
  misc_feature (383)..(383): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganagtcacactcacttgtggcttgagctctggctcagtctcaactggttacctaccccagcctggtaccagcacgaccccaggccaggctccacgcacgctcatgtacgataacaaatgtcgctcttcgtcgggtccctgactcgcttcnctgctccattcctagggaactaagctagccctcaccgatccggaccggggcccaggccaggatcgagtagaatggtagtatttagttactggtcgtgtgtgtagttcgtgggttgttcggttcttttggtgttcgggcggaacggacctagctcgtcccgtccgtaccg

SEQ ID NO: 178185 - DNA, 733 bp, Homo sapiens
  misc_feature: GYAE6OF01BULZK.49.24.C02.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggacttccttgcttatggatcgaggtgtggaatctcagactgtggtgacccagganaccatcgttgtcgaggtcggtccccgggggganagtcacgactcacttggtgtcttgagctcgtggcctnagtcctacaacgttggttaacctacccgagtcctacggtaccagaccgaaccgaccccgaggtcccaacgggcctacccgacgccgaaccgctacgaagttcgtaaacgataacctaaaagtcggtaccgtaccttacgtttcggtccggggtccccttaggacttccgtcctttcgtccgtcggttcctaccgtacgttaccgttaacgggaaacaaacggtctaccgtccctacctaaccacggtaccggacccggggtacccgacggacgtacgagtgtaacgtagtaacgttgttagttaagtttacgttacgttcggtaggttacgtccggttagttaagttcgggttaggggtttcggggttcggtttcggtttttcgggtcggggttaccggggtacgggtacgggtaccgtaacggtccggtaccggttacccgtccggttaacccgg

SEQ ID NO: 178186 - DNA, 867 bp, Homo sapiens
  misc_feature: GYAE6OF01DN3GY.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtaggaatctcagactggtggtcgacccgaggacgcctagttcgttgtcgtagggttcgggtccccggggggggactacggtccaaccaccttctacgtttggtggtcgttggacgtctcgtcgggtctcgacgttcctacctaaaccgtttcgggttaaccctaccccgagtccgttacggtaacccgaggaccgaacccggaacccccgacgggtacccgacgggtccctacccgaccggacccaccgtcctacgtactacggtaaccgtaaactaaaccgtaaaacgttacggtccgttcctttacgtttccgggtttaccggggttcccctaggtactcccggttctttccgtacgtccggtccttaccgtacgttaccggttacgggaaacgtaacgtcctaccgtcccctacctaacccgtacggtaccgggacccggggacccgacgggaccgaaggtacgtagtaagtacggtaaagttaggttaacgtttaacgttttaacgtttaccgtttggtttcggttacggttaccggtttaggtttaccggttcggggtttgggggtttcggggttttacggggttttccggttttttacggggttcggggtttacggggtacggggttaaccgggtaaccggtaacggtaccggttaccggttaacccggttccgttaacccggg

SEQ ID NO: 178187 - DNA, 1052 bp, Homo sapiens
  misc_feature: GYAE6OF01D5QGI.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccattcgttgtcgaggtcgggtccccgggggggacacggtcacacctctacttggtggtcgttgacgtcttcgtggtcctcgacgttccttactaaccgttcgggtttaacctacccccgaggtccgttacggtaacccacggccgtaaccggaaccccccgagggtaccccgaacgggcccctacccgaccggacccgtaaccggtcccttacctaacgttacggttaaaccgtaacttaaaccgtaaaaacgttccggtaccggttaccctttacccggttttcccgggttccggggggtttacccccttaggtaccgttttccccggttcccgtttttacccgttccggtttccggggttaccccttttacccgttaaccggttttaccccgggtttaaccgggggtaaaacccgtaaaaccgggttcccgtttaccccggtaccccccgttaaccccgtaaccccggtaacccggttaccccggggtaaccccgggggggtacccccgaaaccgggtaccggtaaacggtaacggttacggtaacgttacgggtaaaacgttttacgggttacggtttaaacgtttttaacgtttttaaccgggttagggtttccgggtttacggttaccggtttacggtttaacggtttccggggtttacggggggttttcgggggttttccggggttttttcccgggttttttttaccgggggttttcccgggggtttacccgggggttaacccggggggttaaaccggggttaaacccggttaaccggggttacccggtttaacccggggttaacccccgggtttacccccgggtttaaaccccgggg

SEQ ID NO: 178188 - DNA, 827 bp, Homo sapiens
  misc_feature: GYAE6OF01DJO3W.49.24.C02.1.454.CMB.1.raw
  modified_base (139)..(139): a, c, t, g, unknown or other
  misc_feature (139)..(139): n is a, c, g, or t
  modified_base (167)..(167): a, c, t, g, unknown or other
  misc_feature (167)..(167): n is a, c, g, or t
tcagagtcgagagacacgaccggtgctcgatttagtacagatcgttagggaaagggaaagccctgaggaaaacaaaccccagctgggaagcctgagaacacgtagccttcatgagtcgtccccaccatggcctggatgntgcttctccgtcgacttcttgtcttagnggatcgaggtgtaggaactctacgagtacgtggtggtcgacccgaggcgtcctagttccgttgtacgtacgggttcccgggggtaccccgggggatacggtaccaacctaccttaccgtagtttggtcggtccgttaggtacgttccctggttcggtcccttcggtaccgttaccttaaaccgtaaccggttttacccgttaaccccgtaccccggtaacggtccgttaacccgggtacccgaacggacccccgaaccccggaacccccgggacggacccccggacggtccccctacccgaccgacccgaccgtaccttaacgtactaaccggtaacctaaaactaaccgtaaagtcggttacctttccttacggtttacccgggttcggtacccttagtcccgtacgttccttacgttcgtcccgcccgtttaacctacgttcccgtaaaggaacctaacgtcccgtaccgtacccctacaccgtaccggtaccgggacccgggtaccgacgacgtagtacgagtacgttagtacgtagtagttttatacgtttagtgttacgttgtccgttagttggtcggttagggtttggtttccgttggtttcggttcgggttacgggacggtacggtactacgtcccgtacgttccgaccgtcg

SEQ ID NO: 178189 - DNA, 741 bp, Homo sapiens
  misc_feature: GYAE6OF01AFMOA.49.24.C02.1.454.CMB.1.raw
  modified_base (220)..(220): a, c, t, g, unknown or other
  misc_feature (220)..(220): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (636)..(636): a, c, t, g, unknown or other
  misc_feature (636)..(636): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccccaccatggcctggatgatgcttctcctcggacttccttgtcttatggatcgtaggtgtaggtaatctacagtacgtggtggtcgacccgaggacncctagttcgttgtcgtagggtccggggtccccgggggggacacggtaccaccacctccgtaccgttgggtcggtcttggagtcccccccttggtcggtcctcgtacgttcctactaacgttcggtaaccctaccccgngtaccgttacggtaccncgaccgaaccggaccccgacggtccgacggtccctacccgacgcaccgtcctacagttacgtaaacgtaaactaacgtaaacgttcgtacctccgttccggttacgttccggggtcctacggtctccgtcttccgtcgtccgtcccttactaccgttaccgtaaagggaacctaacgtcccgtccctaccgtacccaaccgtcggacccggtccgggacccagacagtgacgtatcggtaatgtagttacttagtcggttntcgtgtacgttgtacgttgggttggtttcggttcggtttcggtttcggtcgggtaccggtaacgggacgtaccggtacggtacccgtccgtaaccgtcggtaccg

SEQ ID NO: 178190 - DNA, 907 bp, Homo sapiens
  misc_feature: GYAE6OF01BFL5C.49.24.C02.1.454.CMB.1.raw
  modified_base (242)..(242): a, c, t, g, unknown or other
  misc_feature (242)..(242): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccagtcgttgtcgaggtcgggtccccggggggganacgtcacactcacgttgtggcttgagctcgtggctcagtcctactaacttcggttacctaccccgagtccgttcgggtaacccaggaccgaaccggacccccgagggaccccaacgggccccttaccccgaccggaccctaacccggcccttacgaacgttacggtaaacgtaactaaaccgtaaaattaccggtccgtctttccgtttaccggttcggggggttaccccttaggaccttccggtccttttccgtacgttccgggtcccttaccgtaccgtttacccggtttaacggggaaaacccgtaaaacggtcccgttacccgtacccccgtaccctaacccgtacccggttacccgggaaccccgggggggtaccccgaaccggggaccgtaacggtaacggttacggttaaacggttaaggttaaacggtttagggtttaacggttaactttttaacgttttacgtttacgggtttcggttcggttaccgtttagggttttacggtttccggggttgggggtttttcggggtttacgggttttttccggttttttcggggtttcggggtttacccgggggtacggggtaacccgggggtaaccggttaaccggtacccgggtttaccgggttaacccccggttccggttaaaccccggg

SEQ ID NO: 178191 - DNA, 833 bp, Homo sapiens
  misc_feature: GYAE6OF01C2HCE.49.24.C02.1.454.CMB.1.raw
tcagagtcgagagacacgaccggtgctcgatttagtacagatcgttagggaaagggaaaggccctgaggaaaacaaaccccagctgggaagcctgagaacacgtagccttcatgagtgtcccccacagtcgtcgtgatgatgtccttcctccgtacgtaccttccgttgtacttagtaggtactacggtagggttggtaaggtaacttccgtacgaagtacgttgggttcggtacccgaaccggaggacctactagtttcggttcgacggttacggggttaccccgggggtacccgggggaataccggtaccaaccgttaccttaacgttcggttggtcggttacgttagacgttccgtacggttcgtccttacgtacgtacctaaccgttaacggtttaccgtaaccccaccgtgttacggaccgtaaccgaccgaccgaacccgacccgtaccggaccaccggtcccaccggaccgtacacgtcctacgtagtaacggtacaaataaacgtaagtcgtccgttacttcggttaccggtccggtccagtcttccgttacttcgtacggccgtaccttaacctcggttacgtaacgaaccgtacgtccacccgtacccgtaactaccgaaccgggtacccggggacccggtacccgaggtaacgtaacgtagtaacgtaggtaacgttagggttattaacgtttacttttagtacgtttaggtacgttgttacgttagttacggttcgggttaggtcggttttacggttttcgttcggtcgggtaccggtagggaaccgtacggtactaggccccggttaccgtcgtaaccgg

SEQ ID NO: 178192 - DNA, 661 bp, Homo sapiens
  misc_feature: GYAE6OF01AVU33.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttggtggcttgagctctggctcagtctacaacttggttacctaccccagcctggtaccagccacgaccccacggccacggcctccacgccaccgctacacgtacgtaccgaataaccaaaatacgtacgtccttcgttccgtcggggtcccctaggcttcgtccttcctctcggtcctccacttcccgttagggaacaacgtctacgccctcaccactccggaccggggcccaggcacgactagactagaatgtacgtatttacttacgttgtacggtcgtacgttggttacgttcggtgggggttacgttttcgggtttcgttttttcgggttacggtttccgggggtaacgggtacgggggttaacccaacggttcccggtaaccggttccccggttcgttaaacccgg

SEQ ID NO: 178193 - DNA, 614 bp, Homo sapiens
  misc_feature: GYAE6OF01AZZTU.49.24.C02.1.454.CMB.1.raw
  modified_base (204)..(204): a, c, t, g, unknown or other
  misc_feature (204)..(204): n is a, c, g, or t
  modified_base (340)..(340): a, c, t, g, unknown or other
  misc_feature (340)..(340): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtgtcccaccatggcctggatgatgcttctcctcggactccttgcttatggatcaggtgtggaatctcagactgtggtgacccagganccatcgttgtcagtggtccccgggggggacagtcacactcacttgtggcttgagcttctggctcaggtctcaactggttacaccccagctggtaccagcagaccccaggccaggctccacgcacgctcatgtacgntacaaatgacctctacttctgggtccctggactcgctttcctctggacttccgatcctttagggaacaaggtcctacggccctacacccagtccgaaccgggggccctaggccagtaacgtggaacgtgtaacgttggtacgtacgtttagtttaacgtgttcgttagtccgttgtacgttccgttagggttgtcgggtttctttttacggttcggttaccggtcgggtacgggtacccgtaaggtcgtcggtaacccgttcccgttaaaccgg

SEQ ID NO: 178194 - DNA, 993 bp, Homo sapiens
  misc_feature: GYAE6OF01BFO80.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgacccgaggacgcctattccggttgtccgtagggttccggggtacccccgggggggggactacggttccaacctaccgttcgtaccgtttgggtcggttccgtttaggtacggttccgtttttcgggccttaccgtaacggttccttaccgtaaaccggttttccgggtttaacccctaacccccgtaggtcccgttaccgggttaaccccaacggacccgaaacccggaacccccccggtacggggtaccccggaccgggtaccccttaccccggaccggtacccaacccggtccttaacgtaacgtttacggttaaacccggtaacttaaaaccgtaaaacgttacggttcccgtccgttttaccgtttccgggttcccgggggttccccttggttaccgttcccgttccttttccgttcgtccggttcccttaccgttaaccgttacccggttaacgggtaaacccgtaaacgtccgttacccgtaccccctaccgtaacccgtaccgggtaccccgggaccccgggggtacccgaacgggtaccgtaacggtacgttaggtaacttagggtaacgtttaggttaagttaacgttttagtttaaccggtttggttacggttcgttacgttcggttacggtttccggggtttgggggtttccgggttttacgggtttttccggttttttacggggtttaccggggttccggggtaaccggggtaccggggtaacccgtaaccgggttccggttaaccccggttaccccggttacccgtaccggttaacccggg

SEQ ID NO: 178195 - DNA, 816 bp, Homo sapiens
  misc_feature: GYAE6OF01AVJ8F.49.24.C02.1.454.CMB.1.raw
  modified_base (289)..(289): a, c, t, g, unknown or other
  misc_feature (289)..(289): n is a, c, g, or t
  modified_base (657)..(657): a, c, t, g, unknown or other
  misc_feature (657)..(657): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggcgcctatcggttgtcgaggtccgggtcccggggggacacggtcactacctctacgttgtcggcttgacgtcgtcgtcggcctntacgtcctactaacgttcggttaaccctaccccgtagtccgttaccggtaacccacggaccgtaaccgaccccccggacgggccccgaacgggtccctacccgaccgaccaccgtcctacgacgttacggtaacgtaacttaacgaaaacgttcgtaccgttccttaccgttcggtccgggttcctagtacgttccgtcctttctcgtcggtccttaccgacgttccgttaacgggtaaacctaacggtcccgtacctaccccgtaccgaaccgtacccggtacccgggacccgggggtacccgaggaccgtaggacgttaggtaaagtcgttaacgttggttaacgtttaactttaaccgttttagngttgtacggtcgtttcggttacggttgggttccggggtttaggtttccggttttccggttttcggggtttcccgggggttacggggtaacccggggttaaaccgggtacctaaccggggtacccgttacccgggttacccgttccggttaacccccggg

SEQ ID NO: 178196 - DNA, 930 bp, Homo sapiens
  misc_feature: GYAE6OF01BAOC0.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactggtggtcgacccgaggacgccagttcgttgtcgaggtccgggtccccgggggggacacggtcactacctctacgttggtggtcttggacgtccgtcgtggtcctcgtacggttcctacctaaccggttcggtttaaccctaccccgtaaggtccgttacgggtaaccctacggacccgaacccggacccccgaccggggaccccgaacggccccgttacccgaccggcccacccggtcctacgtaacgtaccggtaaccgtaaataaaccgaaaacttaccggtccgtaccgtttccggtttcccggttaccgggggtttccccctaggtaaccgttccccgggttcctttttcccggttaccggttcccggttcccgttacccgttaacccggttttacccgggtttaaccgggggtaaaaccgtaaaccggttccctaccccggtaccccccttaaccgaaccccgtaacccgggttaccccggggaaccccgggggggtacccccgacggggtacggacgtaacgggttaccgaaacggttaggtaagttcgggttaagtttaaggttttacctttacggtttaggttgttcggttagttacggttagttccgggttagggggttcgggtttcgggttttaccggttttcgggttcggggttaccgggggttccgggtaaccgggtaccgtacggttaccgggttacccggttaccccggttaccggtaacccgg

SEQ ID NO: 178197 - DNA, 774 bp, Homo sapiens
  misc_feature: GYAE6OF01D500C.49.24.C02.1.454.CMB.1.raw
  modified_base (249)..(249): a, c, t, g, unknown or other
  misc_feature (249)..(249): n is a, c, g, or t
  modified_base (528)..(528): a, c, t, g, unknown or other
  misc_feature (528)..(528): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccagggacgcctagtcgttgtcgtacggtcgggtaccccggggggganacggtccaactactccgtacttggtggtcttgagtctcgtggctcacggttctaccgtaacgttacggttaacctaccccgagtccgtacggtacccgacgacctacccgaccccgtacgggaccacgggtccctacccgacgccacggccttacgagttacgtaacgaactaacgtaaagtacgtccgtcttccgttcggtcgggtccctagtactccgtctttcgtcgtcggccttacgtacgttaccggttaggaaacctaacgtcccgttacccnccccgtaacctaccgtaccgggtacccgggacccggggtacccacggacgtacgaagtttcggaacgttggtaaagtttggttaacgtttaacgtttacgtttagttcgggtttaggtaccgttaggtttcggttacggtttggggttacggggttttgggtttccggtttttaccgggtttcgggttcgggttaccgggacgggtacgtaaccgtcggtcgttacccgtccgttcggtaaccccg

SEQ ID NO: 178198 - DNA, 876 bp, Homo sapiens
  misc_feature: GYAE6OF01CPI9F.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtgatctcagactgtggtcgacccaggagccagtcgttgtcaggtcggtccccggggggacagtcacactcacttgtcggcttgagtctcgtggcctcagtcctacaacgttcggttacctaccccagtctggtacccagccacgaccccacggccacggcctccgacgccaccgtctcgaatcgtaacgtaataaccgaaagttcgtaccgtcttccgtttacgtcggggttccctgtacgtcgttccgtttcctccgttacggtccttaccctacgtttacccggtttacgggaaaaccgtaaaacggtccccgttaccgtacccccgttacccgaaacccgtaccggttaccccgggaaaccccggggggttccccgaacgggtaccgtaacggtaacgttaggtaaacgtttaacgggtaaacgtttagggttaacgtttaacggtttttaacgttttaaccggtttagggtttacggtttaccgggtacgttttacgggtttaacggtttccgggggtttcggggggttttcggggtttttaaccggggtttttccgggttttttttcgggttcccgggggtttttaacccggggggtaccgggggttaaacccgggggtaaaccccggttaaacgggttcccggtttaaacccggggttaccccccgggtttaacccgggtttaaacccccggg

SEQ ID NO: 178199 - DNA, 659 bp, Homo sapiens
  misc_feature: GYAE6OF01ALN1K.49.24.C02.1.454.CMB.1.raw
  modified_base (395)..(395): a, c, t, g, unknown or other
  misc_feature (395)..(395): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgctttatggatcaggtgtggtaatctcagactgtaggtcgacccgaggagccatcgttgtcaggtcggtccccggggggacaggtcacactcacgttggtggtcttggagtctcgtggctcgagttcctacaacgttcggttaccctaccccgagtccgtacggtaccacgcaaccgaccccgaggcccaggcctaccacgcacgtctactactcgacactaacaaagtcgtcncttcgttcgtcgggtcctggtactcgtcttcctcgtcggccttcgtacttccgttaagggaaactaacgtccttaccgtcctacccgaaccgttaccgtcccggggaacccggggacccgacggtccaagtacgtagtaacgttagtaacgtggtacttagttacgttacgtgttgtcgtgtagttcgtggttgggttgttggtttcgtttggttcggttcgggacgggtaccgacggtacgcctacggtcccgttcgtaccgg

SEQ ID NO: 178200 - DNA, 869 bp, Homo sapiens
  misc_feature: GYAE6OF01EV8NS.49.24.C02.1.454.CMB.1.raw
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatgatcaggtgtggaatctcagactgtggtgacccgagggacgccagttcgttcgtcgacggtccggggtaccccggggggggactacggttaccaccgtactcctaaccgtttggtgggcttttggacgtccgttccgtggtccttcgaacggttcctaccgtaacgttcggtttaaccctaccccgagtcccgtaggtacccgacgaccaaccgaccccgacggtcccgaggccctcccgaaccgccaaccggtctctaagttacggtaacgaactaaccgtaaaagtcgttaccgtacttcgttcggtcgggttaccctgtacttccgtctttcnccgttgcccttaccgtacgttcccgttaagggaaacctaaggtccttacggtacccctaacgtaacccgaccgttacccggggaacccgggggacccaacgggtacccgtaaggtacggtagtaacgttaacggtaagtttaacggttacgtttaaacgtttttaacgtttaacggttagggtttacggttacggttcgtttaacggtttaccggtttcccgggttaggggggttttccgggttttcgggtttttacccgttttttccggggtcgggggtttaccggggaccggggttaaaccggggtaacccgttaacggttacccggtaccccgggttaacccgttaccccggttaacccgggg

SEQ ID NO: 178201 - DNA, 980 bp, Homo sapiens
  misc_feature: GYAE6OF01CZRQB.49.24.C02.1.454.CMB.1.raw
tcagagtcgagagacacgaccggtgctcgatttagtacagatcgttagggaaagggaaaaggccctgaaggaaaacaaaccccagctgggaagcctgagaacacgtagccttcatgagtcgtccccaccatggcctggatgatgcttctcctcggactcctgtcttatggatcaggtgtagtatctcagtacgtgtcggtacgaacccgagggacgccgtaacgttcggtttcggtacgtacggttcggggtacccccggggggggtaactaccggttccaaaccgtacccgttaccgttaccgtttgggttacggttccgttaggtcgtccgttccggtacggtccttacgtacggttaccttaaccgtaacccggtttaccggtttaacccctaacccgtacgtaccgtttaaccggtaacccgaacgaccccgaaacccggacccccggaccggaccgtacccggaccgtaccccgaaccggcccttaaccacccgttagaacgttacggttaaaccggaaaactttaaacccaaaagtttccgtaaccggttccgttcccgtttccgggtacccgggttcccctaggttaaccgtttcccgtttccgtttccggtagttcccgggtcccttacccgttacccgttaccggttaaaccggtaaacgtaaccgttacccgttaaccccggacccttaacccgtaaccccggtaaccggttccccgggaacccggggacccggtaccggaacccggtaaggtaacgttaacgtaagttaacgtaaacgtttaggttaaacgttaagggttttacttacggtttagttaccgttgttacgttacgttcgggttacggtttggggttcggttttcgggttttccggttttcgggtttcgggtttccggggtaaccggggtacggtacccggttaacgggtacggtttaccccccccccgtaggtttcccgttaaccccggg

SEQ ID NO: 178202 - DNA, 696 bp, Homo sapiens
  misc_feature: GYAE6OF01ELVZ9.49.24.C02.1.454.CMB.1.raw
  modified_base (241)..(241): a, c, t, g, unknown or other
  misc_feature (241)..(241): n is a, c, g, or t
  modified_base (490)..(490): a, c, t, g, unknown or other
  misc_feature (490)..(490): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtgacccaggacgccatcgttgtcgaggtcgggtccccgggggganagtcacactctacttgtggcttgacgctcgtggcctcgagttcctacctaacgttcggttacctaccccgagtcctacggtacccacgccaaccggaccccgacggcccacgggccctacccgacgccaccgcctacacgttacgtaacaacttaacaaaagttacgtccgtcttccgttcgtcggggttccctagtactccgtctttctcgtcgtcctacctacttccgttaggaactaacgccgtcnccctacaccacgtccggaccgggaccaggctagatagagtagtaagtgtagtaatttagttacgttgttgtacgttcgttaggttagttccgggttaggggtttcggtttccggttttacggttttttcgggttcggggttaccggggtacgggtaaccgggtaccgtacggttacccgtaccggttacccgttaccgttacccgg

SEQ ID NO: 178203 - DNA, 892 bp, Homo sapiens
  misc_feature: GYAE6OF01AV2WH.49.24.C02.1.454.CMB.1.raw
  modified_base (249)..(249): a, c, t, g, unknown or other
  misc_feature (249)..(249): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgtcttctcctcggacttccttgcttatggtatcgaggtgtggaatctcagactgtggtcgacccgaggacgcctagttcggttgtcgtagtcggtccccgggggganacggtcacactcacttggtggcttggacgtctcgtggtctcgagtcctacaaacttcggttaacctacccgagtccgtcggtaacccacgaccgaaccggaacccccgtagggacccctaacgggccctacccgaccgaccgaaccggtccgttaccgtagttaccggttaaacaaacgttaaaaccgtaaaacgttaacggtccggtaccctttaccgtttacccggtttaaccgggggtttacccctaaggttaacccgtttcccggtacccttttacccggttcccgttacggggtaccccttaacccggttaaccgtttacccggtttaacgggtaaaaccgtaaaaccggtcccgttacccgtacccccgtaacgtaaccccgtaaacggtacccgggtaacccgggggacccctaacgggtaccgtaccggttaatacggtaacgttaacggtaaagttacgttacgttaatttaacgttacgttaacggttgtacgaccgttaggtacgttaccgggttgggtttacgggttcggttttacggtttttccgggttagggttacccggggtacggtaaccgggggtaaccttaacggggtaccccgttaacggtaccccggttaccgtaaacccggg

SEQ ID NO: 178204 - DNA, 744 bp, Homo sapiens
  misc_feature: GYAE6OF01B1IHJ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggactcctgcttatggatcgaggtgtggaatctcagtctggtggtcgacccgaggacgcctattcggttgtaccgtacggtccggggtaccccggggggacacggttcaacctaccgtcgtacgttggtcggtacgttaggacgtctccgtggtcctacgacgttcccgtacgtaacgttccggttaaccctaccccgaaggtccgttaccggtaaccgacgacccaaccggacccccgagggtccccacggtccctacccgaccgccaacggtcctacgtactacggtaaccgaataaacctaaagtagtcccgtacctttcgttaccggtccgggttaccctgtccgttccgttacgttccgtcgtcggtcctaccgtacgtccgtacggaactaaccgtctaccgccctactacgtaccgtaccgggaccgggccaggacacggtactggaatacggtatcggttataagttacgttagtgtcgttagtcgttaagttcggtacgggttggttcggttcggtttcggtttaggtccgggtacgggtaggggaactaccggtatccgtaccgtccgtacccgtaccggg

SEQ ID NO: 178205 - DNA, 600 bp, Homo sapiens
  misc_feature: GYAE6OF01AZZIZ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacgttgtggcttgagtctctggctcagtctcaactcggttacctaccccagctggtaccagccacgaccccaggccaggcctccacgcacgctcatcgtacgatacaaatgtcgtctcgttcgtcggggtccctggactcgtcttctcgtggcctaccgacttccgttagggaacaaacgtctcgccctacacctacgtccggaccggggacccaggccaggatgacgtagtactagtagtattattacgttgtagtcgtctgttacgttcgttggggtggttcggttcgtttttacgggtcggttccgggcggtacgggtaccacggtcgtcgtcccggttccgtacccgg

SEQ ID NO: 178206 - DNA, 907 bp, Homo sapiens
  misc_feature: GYAE6OF01CT7QK.49.24.C02.1.454.CMB.1.raw
  modified_base (250)..(250): a, c, t, g, unknown or other
  misc_feature (250)..(250): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtcgtccccacatggcctggatgatgcttctcctcggactccttgcttatggatcgaggtgtaggaatctcagtacgtggtggtcgaccgaggacgcctagtcgttgtcgagggtccgggtacccggggggganaggtcacgtactacgtacgttggtcggtcgttggacgtcgttcgtcgggtccttacgtacggtccttaacgtaaaccggttccgggtttaaaccctacccccgtaaggtccgttacgggtaaccccaccggaaccgaaccggacccccgacgggtaccacgggtccctaccggaccgaccgaaccgtcctacgtagtaacggtaaccgtaaacttaacgtaaaacgttacggttccgtcctttccggtttaccgggtaccggggttccccttagaccgtttccgttcctttccgtcgttcggtacccttacctacgttaccggtaacggaaacctaacgtcccgtacccgtaccctaccgtaacccggtacgtacccggggaccccggggacccgtacgggtaacgacggtaacgttacggaacgttaacggtaaggtttacggttaagtttaaacgttttagttaaccgtttcgggttacggttacgttaccggttaagggtttccggttcgggggttttcgggggtttacggggttttcgggttttaccgggttttttaccggggtcggggtttacccggggggaacggttaacccggggtaaccggtacccgggttaccgggtacccggtaacccggttcccggtaaacccggg

SEQ ID NO: 178207 - DNA, 833 bp, Homo sapiens
  misc_feature: GYAE6OF01DCTJC.49.24.C02.1.454.CMB.1.raw
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
tcagagtcgagagacacgaccggtgctcgatttagtacagatcgttagggaaaggggaaaaggccctgaaggaaaacaaaccccagctgggaagcctgagaacacgtagccttcatgagtcgtccccaccatggcctggatgatgcttctccgtcggaccttccttgctttagtggatcgaggtgtaggtaactctacgaagtcgtggtaggtaccgacccgaggacgctagttcgttgtcggtacgggtccggggtaccccggggggatacggtacacactccgtactggtacgtctgacgtcttcgngtcnctntctacgtaacgttcgtaaccctccgagtccgtacgtaccgacgaccgaccgtacccgcgaccgacgcccgtaccgacgcctaacggcctcgtaggtaaccgtaacaactaacgtaaacttcggaccttccgtcgttaccggttacgtccgtgtaccgttcgtccttccgtcgtacggtcccttactaccggtttaccggtaaaggtaacctaaccgtcccgtaccgttaccccaccgtaacccgtacgggtacccgggaccccggggacgaacggtacccgtaaaggtacggtagtaaaccgttaggttacgttaagggttaactttaagtttaaccggtgttttacggttccgttaggttaccggttttggttaccgggtttcggggtttacgggttcggggttttccgtttttcccgggttacggggtttaccgggtacggggttaaccggggttaaccttaaacgggcccgttacccgggttacccggtaacccgtttcccgttaaacccgggg

SEQ ID NO: 178208 - DNA, 936 bp, Homo sapiens
  misc_feature: GYAE6OF01BBWM6.49.24.C02.1.454.CMB.1.raw
tcagagtcgagagacacgaccggtgctcgatttagtacagatcgttagggaaaggggaaaaggcctgaggaaacaaacccagctgggaagcctgagaacacgtagccttcatgagtgtccccaccatggcctggatgatgcttctcctcggactccttgtcttagtggatctaggtgtggaatctcgagacgtgtggtacgacccgagggacgcctagttcggttcgtcgtagggtcgggtccccgggggggatacggtcactactctacgttggtcggtcttggacgtcgttcgtgggtccttccgtagttcctacgtaaaccgtttaccgggttaaccctaccccgaggtccgttaacggggtaacccaaccggaccgaacccggaaccccggacgggacccggtaaccggtcctaccccggaccgaccgacccgtctaaccgtaacgttaacggttaaccgaaacttaaaccgtaaaaagttcggttacccggtaaccttttcccgttttaccggggtaccggggttaccccgttaggtacccgttaccgttcccggtttacgttccggttacgggtccctaccgtaacggttacccgttaacgggaaacctaaaccggtcgttaccccgtaccccgtaaccgtaacccgtaaccggtacccgggtaacccgggggaccctacgggaccgtaaggtacgttaggaacgtacgtaagttacgggtttagttaaacgttacggtttacgttggttaccggttacggtacgtttacgggttaacgtttcgggttgggggtttaccggttttcggggtttttacgggtttttccggggttacggggtttacccgggggttaccgggggttaaccggttaaacccggtacggggttaccgttaacccgggttaaccccgggttcccgtaaacccgggg

SEQ ID NO: 178209 - DNA, 861 bp, Homo sapiens
  misc_feature: GYAE6OF01BJY1L.49.24.C02.1.454.CMB.1.raw
  modified_base (700)..(700): a, c, t, g, unknown or other
  misc_feature (700)..(700): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatcgcttctccgtcggacttccttgcttatggatcgaggtgtgtaatctacgagtacgtggtggtacgacccgaggacgccgtattcggttgtacgtagggttccggggtaccccggggggactacgtacgaccgtactactacgtttcgggtcggtacgtttggagtccgttcgtcggtcttaccgtacgttacctaccgtacgttaccggttaaccctaccccgagtccggttaacggtacccgacgaccccgtaaccgaccccggacgggtaccccagggtcccctaccgaccggtacccgaccgtacctacgtaaacttaccggttaaacgtaaacgtaaaccgtaaagttccggtccgttccgtttaccggttacgggtccgggtcccctggtacccgtttccggttactttccccgtcggttaacggtccttaacccgttacgttacccgggtaacggtaaactaacggtccgtacccctaccgtacccaaccggttcggacccgggtacccgggacccgacggtacgtacgtacgttacgtagtacggttanacggtttgttaatttacgttgggttcttagtacgtcttggttacgttcgggtttacgggtttcgttcgggtttttacgtttcgggggttaccggcgggtaacccgggttaccggtaacgaaccgggttacccgacccggtttccggtaacccgtaacccgg

SEQ ID NO: 178210 - DNA, 738 bp, Homo sapiens
  misc_feature: GYAE6OF01EKEJ8.49.24.C02.1.454.CMB.1.raw
  modified_base (243)..(243): a, c, t, g, unknown or other
  misc_feature (243)..(243): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgagggacgccagtcgttgtcaggttcgggtccccgggggganagtcacactctacttgtggcttgagctcgtggctcagtcctactaacgttcggttacctacccagtcctcggtaaccacgaccaccggacccccgacggcccgacggcctacccgacgccgacgctacagtacgtaacgaactaacgtaaagtcgtcggtcctttacgttcggtcgggtccctagacgttccgtcctttcgtcgttcgcccttcctacgttaccgttacggaaacctaacgtccgttccgaccccgtacctaccgtaccggtacccgggacccgggggtacccgacgggaccgtaacgtagtacgtagttacgtaagttaggttaagttagtttaacttcggttacggttagtcgtcgtttgtacggtttcgggttaggggtttgggttcgggtttttcgtttttcggggttccgggttcggggtaccggggtaacccgggtacgtaaccgggttccgtacccgggtaccgttcccggtaaccgg

SEQ ID NO: 178211 - DNA, 674 bp, Homo sapiens
  misc_feature: GYAE6OF01BYX2A.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggacgccattcgttgtcgaggtcggtcccgggggganacgtcacgactcacttgtgtcttgagctcgtggctcgagttcctactaacgttcggttaacctaccccgagtccgttcggtaaccaagccgaaccggacccccgaggcccgacggtcctacccgacgtcaccgtctacgacttcgtaacgaataacaaaattgtcctacttcgttcgtacgggtccctagtacttcgtctttcgtcgtcggtcctacgacgttacgtacgggaacgaacgtccgtacgtccctacgaccgtaccgtaccgggaccggggacccgacggacgaagtagtacgtagtagtaagtagttacgtattttacgttacgttacgtggttcgtacgttgtaacgttcggttaggttggtttcggtttcgttttcggttcggtcgggtacggacggtaccgacgtacgtcgtaccgtcgtacg

SEQ ID NO: 178212 - DNA, 799 bp, Homo sapiens
  misc_feature: GYAE6OF01EDBCO.49.24.C02.1.454.CMB.1.raw
  modified_base (274)..(274): a, c, t, g, unknown or other
  misc_feature (274)..(274): n is a, c, g, or t
  modified_base (600)..(600): a, c, t, g, unknown or other
  misc_feature (600)..(600): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggactccttgcttatggatcgaggtgtaggaatctacagtactggtggtcgacccgaggacgcctattcggttgtcgaggtccgggtccccggggggactacgtcactactcgtacgttgnggtcgttgacgcgtcgtggctacgtacgtcctacgtaaccgttcggttaaccctacccgacgtccgttacggtacccgagaccgaaccggaccccgacgggccgacgggccctaccgaccggacctaccgtcctactacgtacgtaacgtaataactaaaacgtcgtcgtccttaccgttcggttaccgggtacccttgacttccggtctttacgtcgtccggtacttacctacgttaccggttaacggaaaccgtaacgtccggtcccacccgtaccgtaaaccgtaccggtacccgggaacccgggggccaacggtacaaggtntacggtaacgtagtaacgtttagttaacgttagtttaacgttacgttgggttactcgttagtcgtttacggttcggggttacgggtttcgggtttacgggttttcggttttacgggccggggtttaaccgggggacggtaaccggggtacccgttaacgggtcccgttaccgggttaaacccgttccgggttaacccgg

SEQ ID NO: 178213 - DNA, 956 bp, Homo sapiens
  misc_feature: GYAE6OF01C7QK0.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccacatggcctggatgatgcttctcctcggacttccttgcttatggatcgaggtgtaggaattcctacgagacttggtgggtacgaacccgagggacgcctaagttcggttcgtcgagggttccggggtaccccgggggggactacggtccaatacctcgtacgtttggtcggtctttggacgtccgttcgtcgggtccttacgtaccggttccttacgtaaaaccggtttcccgggtttaaccccttaacccccggaacgttaccggttaccgtaaccccgaaggacccccgaaaccggaacccccccggacgggtaccccgaacccgggggttacccctaccccggaaaccccggcccgtaacccggtacccctttaacgtaccggttaaacgggtaacccgttaaaactaaaacgtaaaaaaccggttttccggtaccgtttcccgtttacccggttttcccggtcccgggggtttacccctacggttcgttcccgttcgtttcctaccggtccggtcccttaccgttaccgtttaccggttaaacgggaaaccgtaacgtccgtaccccgtaccccgtacctacccggaacgtacccggggacccgggtaaccggtaccggaccggtaaggtactaggtacgttagtaacggttgttacgtttaagtttagtttacggttgttcgtacggtcttaacggttcggtttccgggttggggtttccgggttttggtttccgggttttttcgggtcggggtttccggggaaccgggttaccgggtacgtaacggttccgggttaaccgttcccgggtcccgttaaacccggg

SEQ ID NO: 178214 - DNA, 733 bp, Homo sapiens
  misc_feature: GYAE6OF01DTGI8.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcgaggtcggtccccgggggggacagtcacactcacttgtggcttgagtctcgtgcctcagtcctcaacgttcggttacctaccccagtcgtcggtaccacgacaccgaccccgacggccacggcctccacgccacgctcatagtacgatacaaatgtcgtctcttcgtcgggtcctgctcgtcttcgtcgtcgcctcctacgttcccgttacgggaactaacgtccgtaccgtcccctacgacccacgtacccgggacccgggggtccccaagggtccaacggtactacggtaacgttacgtaagttggttacgttaacgttttaagttaccgttagttcggttacgttacggtttcgttaacggttccgggtttagggggtttcggggttttccgggttttacccggttttttcggggttcggggtttacccgggggtaccggggtaaaccgggttaacccggtaaacgggttcccggttacccgggtacccccggtttcccggttaaaccccggg

SEQ ID NO: 178215 - DNA, 890 bp, Homo sapiens
  misc_feature: GYAE6OF01DWCEZ.49.24.C02.1.454.CMB.1.raw
  modified_base (253)..(253): a, c, t, g, unknown or other
  misc_feature (253)..(253): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggactccttgcttatggatcgaggtgtggaatctacagactgtggtcgacccgaggacgccagttcgttgtcgaggttccggggtacccccggggggganaggtccaacaccgttcctacgtttggtcgggtcttggacgtccgtcgtcggtccttcgtaagttccctaccgttaaaccgttaccgggtttaaccctaacccccgtaggtccgttacgggtaaccccgtaacggacccgtaacccgggacccccgtaacgggacccctaccggggtcccttacccgaacccgggcccaacccgggtccctaacccgttacgttaccggtaaaccgtaaaattaaaaccccgtaaagttaacccggtcccgttacgtttaccgttttcccgggtaccggggttcccccgttagtaaccgttcccggttacctttccggtcgttaccggtccttacccgtacgtttccggttaaacgggaaaccgttaaacggtcccgttaccggaccccttccgaaccgtaccggtacccgggaccgggggccccaacgggaccgtagacgaggtaacgtacggtaagtttacggttaagttagtttaacgtttacgttcggttgttcgtacgttgtttacgttacggttgggggtttccgtttcgggttttccgttttccgggttagggttccgggacggttaccgggaacggtacgtcggtacccggtaccgttccggtaacccgg

SEQ ID NO: 178216 - DNA, 852 bp, Homo sapiens
  misc_feature: GYAE6OF01BYSIL.49.24.C02.1.454.CMB.1.raw
tcagagtcgagagacacgaccggtgctcgatttagtacagatcgttagggaaaggggaaaggccctgaggaaaacaaaccccagctgggaagcctgagaacacgtagccttcatggagtcgtccccaccatggcctggatgatgcttctcctcggacttccttgcttatggactcgaggtgtagaatctacagtactggtcggtcgaccgaggacgcagttcgttggtacgtacgggtccggggtacccgggggggatacggtccacgtacctctacgttgtcggtcttaggcgtcctgtcggtactcgtgtaccttacgtaacgtttccggttaacccacccgtaggtccgttaccggtaaccacggaccaacccggaccccgtacggggaccccgtacccggtacccaccccggtaacgcccgtaccgtcccgttaacgtaacgttaccgggttaaaacaacgttaaaactaaacgttccggttaccgtcctttccggtttaccggggtccggtttacctcgtacgttcccgttctttcgtccgtccgggttcctacccgtaacgttacccgggtaagtaaacctacggttcctacccgtaccctaccgaaacccgttacggacccgggggtaaccgggtcccaagggtacgacggtagttagtaacggttagtacgtttagtaagttctttaagtacggttgtagtcgttaagttggtacggttacggttgggtttccgggtttggttttacgggtttccggttacggggttaccccgggggaaaggttacccgggtaacgttaaccggggttcccgtaaccggtttaccccgggtcccgtaacccggg

SEQ ID NO: 178217 - DNA, 660 bp, Homo sapiens
  misc_feature: GYAE6OF01DE83O.49.24.C02.1.454.CMB.1.raw
  modified_base (205)..(205): a, c, t, g, unknown or other
  misc_feature (205)..(205): n is a, c, g, or t
  modified_base (413)..(413): a, c, t, g, unknown or other
  misc_feature (413)..(413): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggngccatcgttgtcaggtcggtccccgggggggacaggtcacactcacttgtggtctgagctctggctctagtctacaacgttacggttacctacccacgtcgtacggtaccagaccgaccgaccccgaggccacggctacccgacgccacgctacacgtacgtacgaataacaaagtcggtcctcgtccgtttcggtacggggttcccngtactcgtcttcgtcgtcggccttcgacttccgtacggaaacaacgtccgtacgtcccactaccgacgtacccgggaccggggacccacgggacgaagtcgtagtagtacgaagttgtacgttaagtttacttacgtgttcgttacgtcgtcgttagtcgggtttgggtcgggtttcggtttacgtttttcgggtcggttcgggacgggtacggtaccgtaacgtccggtacgtcccgtcgtaccgg

SEQ ID NO: 178218 - DNA, 803 bp, Homo sapiens
  misc_feature: GYAE6OF01CDQUY.49.24.C02.1.454.CMB.1.raw
  modified_base (241)..(241): a, c, t, g, unknown or other
  misc_feature (241)..(241): n is a, c, g, or t
  modified_base (302)..(302): a, c, t, g, unknown or other
  misc_feature (302)..(302): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggactccttgcttatggatcaggtgtggaatctcagactggtggtgacccgaggacgccatcgttgtcaggtcggtccccgggggganagtcacactcacttgtgcttgagctcgtggctcagtcctacaacgttcggttacctacccngtctacggtaccagccaaccggaccccgagggccaacgggtcctacccgaacgccgtaaccgccgtacgacgtacggttaaccgaataaaccgtaaattacggttccgtacctttccgtttcggttccggggtccctggtactccgtcctttcgtccgtcggtacctaccgtacgttccggttaacgggaaaccgtaaacgtccgttacccggtccctaccgtaaccgacgtacccgggacccggggtacccgacgggacgtaacggtacgttaggaacgtttaggaacgtttacgttacgttaaacgttttacgtttaacgtttggttgggttaccgtcggtttacgtttacgggttcgggtttgggggtttcgggttttcgggtttttcccggttttttacggggttccggggtttaccgggggacccggggttaacggggtaaacccggttacgggtaacccggtttacccgggtaccccgttcccggttaaccccgg

SEQ ID NO: 178219 - DNA, 981 bp, Homo sapiens
  misc_feature: GYAE6OF01CNSJ2.49.24.C02.1.454.CMB.1.raw
  modified_base (436)..(436): a, c, t, g, unknown or other
  misc_feature (436)..(436): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggactccttgcttatggatcgaggtgtaggaatctacgagactggtggtacgacccgagggacgcctaagttccgttcgtacgacgggttccggggtacccccggggggggaacacggttacccaaccgtaccttaccgtaacggttttggttacgggtaccgtttagggtacgtccgttcgtcggggtaccttcgtaacgttccttaaccgtaacgtttaccggttaaccctaccccgtaggtccgtacgggtaacccaggtacccgaaccggaacccccgnggacccgacggccctaccggacgacccgacgactaccgtaacgtacggtaaccgaaacttaaaccgtaaacgttacggtccgttacgttaccgtttccgggttaccggggtaccctagtaacgttccgttacgtttccgtacgttccggtaccttcccgtaacgtttacccgggttaaacgggtaaacctaacggttcctaccccggtacccgttacccaaacccgggttaccggtccccggggtaaaccccgggggcccctaacggggaccgtaacggtacgtacggtaaaccggttttaggtaaacccgttaaggtttaccgtttaaagttttaccgttacggtttaacgggtttcggtacgtttaacgggtttcgttaacgggtttcccggggttgggggtttaccgggttttcgggtttttaccgggtttttaccgggtcggggttttaaccccgggggggaccgggttaacggggttaacccggacccgggttacccgggttaaacccggttcccgggttaaccccgttaaaccccgggg

SEQ ID NO: 178220 - DNA, 1028 bp, Homo sapiens
  misc_feature: GYAE6OF01CZ2NE.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcgacctccgttgtctttatggatcgagggtacgtaggaacttcctacgacgtactggtcggtaccgacccgaggaccgcacgttccggttgtcgacgggttccggggaccccggggggactacggtacaacctacgtacctaacgtttaggtcggtccgtagtaccgtccgttcgtcgggtacctacctacgttaccgtaaccgtaaccgttttaccggttaaacccgtaccccgtacggttaccgtcccggtaaccgtgtacccgaacccgtacccggacgacccgacggtacccctaccggacccgaccgtaccccgtacgtaccgttaagtaccggtaacggtaacttaaaccgtaaagtacccgttacgttacccgtttccggtttaccgggtttaacccggggtttccccggtacggttaacccctttcgtttacccgttacggtttacccggttaccggtaccctttaccccgttaaccggtttaaccccgggtttaaacgggaaaaccccgttaacggtacccgttacccccgttacccgaacccgttaacccgacgggttaccccgggaacccgggggtcccccaaaccgggtacgaacgttaaccggaaggtaaccggtaaggttaacgtttaacggtttaaccgttttaagtttaaaccggttttgttacccgggtttaaggttcgtttaacggttccggttttaacgggttcggggttttaaggggtttcggggttttacccggttttttacgggttttaccgggttaccccgggggtttagggtaacccgggggttaaccgttaacccggtaaccgggtttaccgtaaacccggggtttccccgttccccgggttaaaccccgg

SEQ ID NO: 178221 - DNA, 699 bp, Homo sapiens
  misc_feature: GYAE6OF01EUB0F.49.24.C02.1.454.CMB.1.raw
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (355)..(355): a, c, t, g, unknown or other
  misc_feature (355)..(355): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccaggacgccagttcgttgtcgaggtcgggtaccccgggggganagtcacgactcacttgngcttgacgctcgtggcctcgagtcctacaacgttcggtacctaccccagtaccgtcggtaaccagccgaccgaccccgaaggcccacggtccncccgacgtccacgcctacagtacgacgtaactaactaaaacgtcgtacgtcctttacgttcgtcggggtccctagtacgttccgtcctttctccgtcggtaccctaccgtacgttacccggttaagggaaacctaacgttccgtacccgtcccctaccaaccgtacgtacccggggacccggggtaccacggaccgaggacgttacgagtacgtaagttgtacgttatttacgtacgttgtagtcgtcgtagtcgttacggtgggttggttcggttttcgtttcgggtcgggtaccgggagggtaacggtaccaaggtccgtaccgtacccgttcgtaacccgg

SEQ ID NO: 178222 - DNA, 659 bp, Homo sapiens
  misc_feature: GYAE6OF01EWDFK.49.24.C02.1.454.CMB.1.raw
tcagagtcgagagacacgaccggtgctcgattttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccggggggacagtcacactcacgttgtggcttgagctctggctcagtctacaacttcggttacctaccccgagtcgtaggtaccagccaacggaccccgaggcccaggcctccacgcacgctcatacgtacgaataacaaagtcgtacgcttaccgttcgtacggggtccctgactccggtctttctcgtcggctacctacgttccgttacgggaacaacgtccgtcgcccctacacccgtacgtacccgggaccggggacccgacggacgagatgagtagagttagtagtatttacgttacgttgttcgtagtcttagttacgttcggttcggggtttggttcggtttcggttttttcggtcgggtttccggggtacgggtaacgggtaccgtaacggtaccgtaccggttacccggtcccgttaacccgg

SEQ ID NO: 178223 - DNA, 633 bp, Homo sapiens
  misc_feature: GYAE6OF01E0UPZ.49.24.C02.1.454.CMB.1.raw
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcgtcccgggggggacagtcacactcacttgtgcttgnctctgctcngtctcactcggttaccncccaggctggtacccnacgaccanggaccccaggccacgaccgtccaccgcaccgactcgtacgtacgtaacgaataacgtaactacgtccgtccttcggttccgtcggggtccctcggtacttcgtcttcgtctcgctccgtacgtacctaaggacctaacgccgtcgaccctaccaccgacggctacgggacccgggaccgacgtacgaacgtacgacgtagtacgtaattacgttacgtagttacgttacgtcgttgtcgtcgttggttcggttggttcgggtttcggttcggtttcggtttcgggttcgggttacggtaacgggtacggtacggtaccggtccg

SEQ ID NO: 178224 - DNA, 582 bp, Homo sapiens
  misc_feature: GYAE6OF01B8ETG.49.24.C02.1.454.CMB.1.raw
  modified_base (236)..(236): a, c, t, g, unknown or other
  misc_feature (236)..(236): n is a, c, g, or t
  modified_base (413)..(413): a, c, t, g, unknown or other
  misc_feature (413)..(413): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganacgtcacactccacttgtggcttgagctcgttggctcgagtctactaacgttggttaacctacccccagccttcggtaccacgccgacgacccccgaggcccaggcctcccgacgcaccgctcatgacgataaccaaatcgtcgcttcttcgtcggggtccctggactcgtctttcncgtcggtctccattccgttacggaactaagcctcgccctcaccactcggaccgggcccgaggcagncgatcgaatgtanatttntatgtgtgctgtcgtggttgggtgttcggttgttttcggtcggttcgggacggacggacctacggtatccggtaccgtccgtacg

SEQ ID NO: 178225 - DNA, 760 bp, Homo sapiens
  misc_feature: GYAE6OF01BZCN4.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtgaatctcagactggtggtgacccaggagcctatcgttgtcacggtcggtccccgggggganacgtcgacactctacttggtggcttgagtctcgtggtctcgtatcgtactaaaccgttcggttaacctaacccccgagtccgttacggtaaccgacgaccgaaccgaacccccgaggtaccccgacgggcctacccgaccggaccaccgccttacagtacgttaaccgaataaccaaagtacgtcggtacctcgtttcggtcgggttccctggtactccgtacttcgtcgtcggtcctaccgtatacccggttagggaaactaaacgtccttacgccctacgaacctacggtacccgaaccgggggtcccaaggtaccgaagtaactcggtaagtaacgtaagttacggttataatttaacgtacggttaggttacgcgttcgtaaggtttaccgttcgggttaggggttcggttttacggtttccggttttttcgggagggtttcccgggggtaaacggaaccggggttaacctaaacccggtggtttaacccggtaccccgtttaacccggtaaccggg

SEQ ID NO: 178226 - DNA, 697 bp, Homo sapiens
  misc_feature: GYAE6OF01A4I36.49.24.C02.1.454.CMB.1.raw
  modified_base (674)..(674): a, c, t, g, unknown or other
  misc_feature (674)..(674): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtggtccccaccatggcctggatggactgcttctcctcggactccttgcttatggatcaggtgtggaatctacagtactggtggtgacccgaggacgcccagtcgttgtacgaggtcggtaccccgggggggacaggtcaccactctacgttggtggtcttggagtctcgtcggctcagtcctccgtaacgttcggttacctaccccgagtccgtcggtacccacggccaaccggaccccgacgggtcccaacgggtccctacccaaccggccaacgcctcgaactcggtaacaactaactaaaacgtcggtctacgttccgttccggttcggggtccctggtactccggtctttcgtcgttacggccctctacgttcgttacgggaaacaacggtcctacgaccctacacccgaacgtcccgggacccggggtaccacgtactagcggtacgacgttaggaacgttgtactagtttacttacgttgtctacgtgttaggtcgttcggtggggttcgttcggtttcgtttacggtcgggttcgggaggtaccggacncggtacctccgccgtccgtaccg

SEQ ID NO: 178227 - DNA, 814 bp, Homo sapiens
  misc_feature: GYAE6OF01B0C8N.49.24.C02.1.454.CMB.1.raw
tcagagtcgagagacacgaccggtgctcgatttagtacagatcgttagggaaagggaaaggccctgaggaaaacaaaccccagctgggaagcctgagaacacgtagccttcatgagtgtccccaccatggcctggatgatgcttctcctcggactccttgcttatggatcaggtgtggaatctcagactggtggtgacccaggagccatcgttgcaggtcggtcccggggggacaggtcacactcacgttgtggcttgagtctctggctcgagtcctactaacgttcggttaaccttaaccccgagtcgttacgggtaacccacgaccgaccgaacccccgaggtacccacgggtacctacccgaacggccaaccggtcctactaagtacggttaaaccgaattaaaccgaaaattacgtacgtcttacgttccggtcggggtccctagtaactccggtactttccttcgtcgggtaccttcccgtaacttacccgtttaacggggaaaacctaaacggtcccgtacggtaccccctaaccgtaacccgtaccgttacccgggaccccggggggtaccccaacgggacccgtaagtaacgttacggtaacgttaagtaaagttggtttacggttaattttaacgttaacgttagtttggtacggtcgttacggttaacgttccgggtttagggggttacggggtttcgggttttacgttttttccggggtttgggttacccggggacgggtaaaccggggtaccggtaacggtaccggttaccggttaaaccccggttccccgttaaacccggg

SEQ ID NO: 178228 - DNA, 960 bp, Homo sapiens
  misc_feature: GYAE6OF01A1OUS.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggacttccttgcttatggatcgaggtgtggaactctcagactggtggtcgacccgaggacgtcctattcggttgtccggtaggttccggggtacccccggggggggactacggtacctaacctaccgtcgtaccgtttggttcggtcgtttaggtacggtcgttccgtcgggtccttaccgtacggtccttaacccgtaacggtttacgggtttaacccctaaccccgtaggacccggttacggtaaccccgtaccggccctaaacccgggaacccccgacgggtaccccgaccgggtccccttaccgaccggacctaccgtcccgttaccttaaggtaccgtaaccgtaaacgtttaaacccgtaaaaggtaccggtttacccgttacccttacccggtttaccgggttacccggggggtttacccccttaggtaaccgtttccccggttaccgttttccccggttaccggttccggggttacccctttaccggaccggttttaacccggttaaccgggggtaaactaaccgtccgttacccggtaccccgtcccgtaaaccccgtaccggttacccggggaaccccggggtaccccggtacgggtacctaaccgggaacttaacggtacgttaaggtaacgttacgttagtttaacgtttaccgttagtttcgttacggttcgtaacgttggttacgttccgggttgggttacgggtttcggttttaggttttccgggtttcggtaccggggtacggtaacgggaccgttacggttcggttaacccgtccgttacggtaacccgg

SEQ ID NO: 178229 - DNA, 829 bp, Homo sapiens
  misc_feature: GYAE6OF01BXI4I.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggagccatcgttgtcaggtcggtccccggggggacagtcacactcacttgtggcttgagctcgtggctcgagtcctactaacgttcggttaacctaccccgagtccgttacggtacccaggaccaaccggaccccccgacgggcccaacgggccctacccgaccgccaccgtccctactacgtacggtaaccgaataactaaaacgttcggttccgtcctttccggtttccggtttccgggggttccccttaggtaccgttccggtcctttccgttccgtcggtcccttacccgttacgttacccggtttaacgggaaacctaaacggtccttacccggaccccctacccgtaaccccgtaaccggttaccccggggaaccccggggggaccccctaacgggaccgtaacggaacttacgggtaagttaacggtaagttacgggttacgttaaacgttttacgtttacgtttcgggttggtaccgttcggttggtttaccggttcgggtttggggtttcgggtttcggtttttccggttttttcggggtcgggtttccggggaccgggtaacgggttaacccgtacgggttaccgtacccggttaccccggttaccgttacccggg

SEQ ID NO: 178230 - DNA, 884 bp, Homo sapiens
  misc_feature: GYAE6OF01AJ9KI.49.24.C02.1.454.CMB.1.raw
  modified_base (168)..(168): a, c, t, g, unknown or other
  misc_feature (168)..(168): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttccttgcttanggatcaggtgtggaatctcagactgtggtcgacccgaggacgcctagtcgttgtcaggtcgggtccccgggggggactaggtccacgtactccacgtttgtggtcttgacgtctcgtggtctcgacgttctaccgtaacgttcggttaaccctaccccgagtcgtacggtaacccacggaccaaccggaccccgacggcccgacggccgtacccgaaccgcctaaccgcctcgaacgtacgtaaccgtaactaaccgaaaacgttcggtaccgttaccttaccggtttacccggttaccggggttcccttacgggtacctttccgggtcccgtttttaccgttccggttaccggttacccttaccgtacgtttacccgggttacgggtaaaacccgtaacgtaccgttcccgtacccctaccgtaaccctaaccggtacccgggaaccccggggggtaccccacgggtaccaacggtactaaggtaacgttaaggtaacttacggtaggtttaaacgtttaacgttttaaccgtcggtttaccgttcggtacgtttaccggttacgttcggggtttaggggttttcgggtttccggtttttaccgggtttttcggggttccgggtttacccgggggtaaggggtaacccgggttaacccggtaacggtttacccgtaacccggggttaaccccgttccccgggtttaaaccccggg

SEQ ID NO: 178231 - DNA, 741 bp, Homo sapiens
  misc_feature: GYAE6OF01A8BP1.49.24.C02.1.454.CMB.1.raw
  modified_base (253)..(253): a, c, t, g, unknown or other
  misc_feature (253)..(253): n is a, c, g, or t
tcagagtcgagagacacgaccggtgctcgatttagtacagatcgttagggaaaggggaaaaggccctgaggaaaacaaacccagctgggaagcctgaagaacacgtagccttcatgagtgtccccaccatggcctggatgatgcttctcctcggactccttgcttatggatcaggtgtggaatctcagactggtggtgacccgaggacgcctagttcgttgtcgaggtcgggtccccgggggggacagtcacnctctacttgtggtcttgagtctcgtggctcagttcctacgtaacgttcggttaacctacccgagccgttacggtacccacgccgacggaccccgacggccgacggcctaccgacgcgaccgctacactgtaacgtactacaaagtacgtctcttcttcggtcggtcctggactcgtcttcgtctgcctcacgttccgtaaggaacacgtctccgaccctacacctcgtacccgggaccggggtcccagggtacccaaggtactaggtacttaaggtaaacgttaggttaacgtttaacgttttactttaacggtttcggttacggttacggttacccgttagggtttaccggtttgggggtttacgggggttttcgggtttcggggttttttacggttttccggggtacgggtttccggggtaacggggtaacccgggtaaccgtaccggttggtaaccccggtttaacccgggttccccgtaccggg

SEQ ID NO: 178232 - DNA, 940 bp, Homo sapiens
  misc_feature: GYAE6OF01DKLL8.49.24.C02.1.454.CMB.1.raw
  modified_base (263)..(263): a, c, t, g, unknown or other
  misc_feature (263)..(263): n is a, c, g, or t
tcagagtcgagagacacgaccggtgctcgatttagtacagatcgttagggaaaaggggaaaaggccctgaggaaaacaaaccccagctgggaagcctgagaacacgtagccttcatgagtcgtccccaccatggcctggatgatgcttctcctcggactccttgctttatggatcgaggtgtaggaatctacgagactggtcgggtcgaacccgagggacgccagttccgttggtccacgggtcgggtaccccgggggggganacggtaccactactcctacgttgtcgggcttcggacgtctcgtagggcctcgtaacgtccttaccgtaaaccgtttcgggttaacccttaccccgaagtccgttacggtaaccccacgaccgaaccggaacccccgacggggacccgaacggtccctacccgaaccggccgtaaccgccgttaacgacttacggaaaccgtaataaaccgtaaaagtttccggtaccgtccgtttaccgtttccgggtttcggggttccctaggtacttcccggtttcctttccgttaccggtggtacccttaccgtacgtttacgggttaaccgggaaacctaacgtcccgtcccgtacccctacccgtaaccgttacccggaccgggtacccgggggtaaccccgagggacccgtaaaggtcggttaacgtaaaggttacgggtaaacggtttagttaacggttaacgtttttaacgttaacggtttcggttacgggtttcgttacgtttaccgggtttacggttccggggttttgggggttacgggtttttccggggttttacggggttttttcccgggtttacggggggttacccgggggaacggggttaaaccgggttaacccggtaaccgggttaccccgtttaacccggggttaaaccccgtttcccggtaaaccccggg

SEQ ID NO: 178233 - DNA, 859 bp, Homo sapiens
  misc_feature: GYAE6OF01DCDMK.49.24.C02.1.454.CMB.1.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
tcagagtcgagagacacgaccggtgctcgatttagtacagatcgttaagggaaaggggaaaaggccctgaaggaaaacaaacccagctgggaagcctgagaacacgtagccttcatgagtcgtccccacatggcctggatgatgccttctccgtcggactccttgcttagtggatcgaggtgtaggaaactctacgagtacgtggtggtaccgaacccgaagggtacctcctaagttcggttgtaccgagggtccggggtaccccggggggaanacgtaccaactacctacgtcgttggngtcttggacgtcctgtcggctacagttacctacaaccgttggtaacccctaccggngtaccgtacgaaccgacgaccgtaacccggaacccgtacgggaccccacggtcccctaaccgaaccggaccctaacctccggtacttaaacgttaacgggaaacctaaaacttaaaacgtaaaaagttccggttcccgttactttacccgggtttccggggtaccgggtaccccttaggacgtttccctcctttacgtcgtcggtaccttccgtacgtaccgtaaggtaaaccaaggtccttaccgacctacctaaccgaacggtcccggggaacccgggaccgaaggacgaacggtagtacggtaataagtaacgttaggttaagttaacgtttaaccgtttaggttacggttaggtacgttcgttaacggttacgggttcgggttaggggggtcgttttacgggtttttcggttttacgggttcggggttaaccgggaaccgggtaacggtaaccggtacgtaaccgggttacccgttaacccggtaccgttaaacccggg

SEQ ID NO: 178234 - DNA, 984 bp, Homo sapiens
  misc_feature: GYAE6OF01ASKNL.49.24.C02.1.454.CMB.1.raw
  modified_base (264)..(264): a, c, t, g, unknown or other
  misc_feature (264)..(264): n is a, c, g, or t
tcagagtcgagagacacgaccggtgctcgatttagtacagatcgttagggaaaggggaaagcctgaggaaaacaaacccagctgggaagcctgagaacacgtagccttcatgagtcgtccccaccatggcctggatgatgtcttctcctcggacttccttgtcttatggtatcgaggtgtcggtaatctcagtacgtggtggtcgaacccgaggacgcctagttcggttggtacgtacggttccggggtaccccgggggggtanacggtaccgaactacctccgtacgtttggtcggtccgttttggaccgtccttcgtacgggtacctttacggaccgttacccgttacctaaaccggtttaccgggtttaacccctaacccccggtaggttcccggtttaacccggggaacccaaaccggggtcccaaaaccccgggttacccccccggtaaacggggaccccggtacccgggtaccccgttacccggaaacccggccgaaaccccgggttcttaaccggttaacgttaacggttaaaacccgtaaaccttaaacggtttaaaacgtttccggtacccgtttaccgttcccgggttttaccgggtcccggggttaaccctttggttaacccgttccgtccggtttttccccgcgttaccggtaccccgttaaccgtacgtttaacccgggtaaggggtaaaccccgtaacgttcccgtaaccccgtacccgtaacccgtaccgtaaccggtaccccggggaacccggtaccggtaccggtaagtacggtagtacgtaagttaagtaacgttagtaacgttagttttaaccgtacgtttgggtagttaccgtgttacggtaggtttcgggtttgggggtttacggtttccggttttaggttttcccggggtgggttaaccgggtacccgggtaacgggttaaccgtcgggtaccgttcccggttaccggttacgtaccccggg

SEQ ID NO: 178235 - DNA, 702 bp, Homo sapiens
  misc_feature: GYAE6OF01E3GOL.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggactccttgcttatggatcaggtgtggaatctcagactgtggtcgaccgaggacgccattcgttgtcgacggtcgggtccccgggggggacacgtcacactctacgttggtcgcgttgacgctcgtgtctcgacgttctacctaacgttcggttacctaccccagcgtacggtaccacgccaaccgaccccgacggcccacggccctacccgacgccaccgtctactactacgtaacgaactaactaaagtcgtcgtccttcgttcggttacgggtccctgtactccgtctttccgtcgtcggtcctaccgtacgttacccgttaagggaacctaacggtcctacccgtccctaccgacccgtacggtaccccgggaccggggtaccccgaggtaccgaagtagtacgtagtaagtagttacgtacgttaatttacgtttacgtgtacgttcgtacttggtacgttcgggttggggtttcggttcggtttcgtttacgggtggttccgggacgggtacgaccgtacgtccggtccgtccgtccgtacg

SEQ ID NO: 178236 - DNA, 801 bp, Homo sapiens
  misc_feature: GYAE6OF01BNI54.49.24.C02.1.454.CMB.1.raw
  modified_base (242)..(242): a, c, t, g, unknown or other
  misc_feature (242)..(242): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatcggatcaggtgtggaatctcagactgtggtcgacccgaggacgcatcgttgtcgaggtcgggtccccggggggacngtcactactctacgttgtggtcttgagtctcgtggctcagttcctctaacttcggttaccctacccaggtctcggaccagcaccgacccggacgccacggcctaccgacgccgacgcctcgatacggaacctaatactaaacgtcgtaccgttcttcccgttcggtacggggttccctgtacccgttacgtccgtttaccgtccgtacgggttccccttaccgtaccgttacccggttaccggggtaaaaccgtaaccggtcccggttacccgccccttaccgaacctaacccggtaccccggggaacccgggggtaccccggaccggtcccgaaaggttacgtacggtacgtaacgggttaacgttaggtacgtttaaccttttaaggtttaccgttcgggtttacgtacggttacgttccgggtttagtttccgggggttaggggtttccggggtttcgggtttttccggtttttacggtcggggtttacggggacccgggtaacgggggtaacctacgggtacccgtacggttaccccgggttacccgttaccggg

SEQ ID NO: 178237 - DNA, 734 bp, Homo sapiens
  misc_feature: GYAE6OF01D3T2E.49.24.C02.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtcgtggaatctacagactgtggtcgacccaggacnctattcgttgtcaggtcggtcccgggggganagtcacnctcctacgttgtgcttgacgtctcgtggctctagttcctactaacgttggttaaccctacccagtcttacggaccagacctaccgaccccgacggccacggcctacccgaccgtcacgtcctacgtactacgtaactaataaccgaaagttcgtctacttccgttacggttcgggtcccttgtacgtcctcgttcgtcgtcggtaccttcctacgttaccgtacgggtaaacaacgtcgtaccctcctaccaaccgtaccggtacccggggacccgggtacccacggacgtaacgtacgttacgtaagtaacgttaaggttagttacgttaactttagtttaacgttcggttggtacgttacgttaggttcggttcggttaggggtttcggtttcggtttttcggttttcgggtcgggtttacgggacggggtaacggtcccgtaaagggttcccgttaacccgggttcccgttcccggtaaccgg

SEQ ID NO: 178238 - DNA, 671 bp, Homo sapiens
  misc_feature: GYAE6OF01DZIIN.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaattctacagtactgtggtcgacccgaggagccattcgttgcgtaggtcggtccccggggggacagtcacacctcacgttgtggcttgagtctctggctcgagtcctctaaaccttcggttaacctaccccgagtcctacggtacccagaccaccgaccccgaggccgacggcctccgacgcacgctacagtcgtacgaataacaaagtcgtctcttcttcggtcgggtccctgtctcgtctttctctcgtccttacctacgttaccgtaggaacaacgtcctccgccctacaccgtacgtccggacccggggccacggacagtacgtagagtagtaacttagtagttaacttttacgttaacgttgtacgttgtacgttcggttagttccgggtttgggtgggttttcggtttcgtttttcgggttcggttcggggtacgggtacggtaacccggacggtacgttaccggacccgtttccgtaacccggg

SEQ ID NO: 178239 - DNA, 745 bp, Homo sapiens
  misc_feature: GYAE6OF01BZJ31.49.24.C02.1.454.CMB.1.raw
  modified_base (217)..(217): a, c, t, g, unknown or other
  misc_feature (217)..(217): n is a, c, g, or t
  modified_base (570)..(570): a, c, t, g, unknown or other
  misc_feature (570)..(570): n is a, c, g, or t
  modified_base (596)..(596): a, c, t, g, unknown or other
  misc_feature (596)..(596): n is a, c, g, or t
  modified_base (605)..(605): a, c, t, g, unknown or other
  misc_feature (605)..(605): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtcgtccccaccatggctggatgatgtcttctctcggtactccttgcttatggatcgaggttgtggaattctacagtacgtggtcggtcgacccgaggacncctagttcgttagtcgtacgggtccggggtacccggggggactacgtaccgaactacctacctacgtttggtcgggtcttaggacgtcctcgtcggctacgtacgttacctaccgtaacgtttccggttaaccctacccgcgtaccgtacggttaccgaacgccgacccggaacccgtacgggcccgtacggtaccctcccggacgtcccggactcctaccgtagtaaccgtaacgtaacaaacgttaaactcggttccgtacgtttccggttcggtccgggttccctgtacgttcctcttacggtcgtccgtacctcgtacttaccggttagaacgtaccgctccctacccncaacggtccgaccgggtccgggaccngactagtanaggtatagtagtgttagtactttacgtgtttcgtgtacgtgttacgttagttcgggtggtttcgtttcgggtttgtttacgggttggggccgggtaaccgggacgtacggttacgcccgttacggtaccgtccgtaccgg

SEQ ID NO: 178240 - DNA, 711 bp, Homo sapiens
  misc_feature: GYAE6OF01EYP1X.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgacagtcggtccccggggggacngtcacactcacgttgtgcttgagctcgtgctcagtctctaactggttaccacccagcctggtaccagtcacgacccgaggccacggccaccacgcacgctacacgtgtaacactaacaaagtacgtcgacttcttacgtcgggtccctgactcgtctttctcgtcggtccttacctacttaccgttacgggaaacctaaacggcttaccgtaccctacctaacctaacgtacccggtaccgggggtaccccaagggtaccaacggtaattacggactaaggtaataggtattaagtttaatttacggttagttacggttacgttacgttacgtttaggttccggttgggggtttcggtttcgggttttacggttttttcgggttcggggtttaaccgggtaccgggttaaacgggggtaacccgtaaacgggtaccggttacccgggtaaaccccgtttcccggttaacccgg

SEQ ID NO: 178241 - DNA, 778 bp, Homo sapiens
  misc_feature: GYAE6OF01AOHHD.49.24.C02.1.454.CMB.1.raw
  modified_base (332)..(332): a, c, t, g, unknown or other
  misc_feature (332)..(332): n is a, c, g, or t
  modified_base (652)..(652): a, c, t, g, unknown or other
  misc_feature (652)..(652): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccgaggacgccatcgttgtcaggtcggtcccgggggggacagtacactactcaccgttgtcggcttgacgtctcgtcggctactagtctactaacgttcggttacctaccccgtagccttcgggtaacccncggccgtaaccggacccccgacggccgaacggcctacccgaacggcccacgctacagtaccgtacgactaaacgaaacgttgtcctacttccgtttccggtccgggtaccctacggtctccgggtccctttcgtaccgtccggttaccttcccgtaccgtttccccggttaagggtaaaccctaacggttccctcccgtacccctacccgaacccgtaccggttacccggggaccccgggaccgtacgggacccgaagtcgttacggataacggtagttacggttagtaagtttacgttacgtttagggtccttcggttnttacggttcgtttgggttaggggttcggttttcgggtttacgttttttggggtcccgggtttacggggacgggtaccgggtaccgtaccggtaccgtttacccgggccgtttaccccggtacccgg

SEQ ID NO: 178242 - DNA, 808 bp, Homo sapiens
  misc_feature: GYAE6OF01CSWLA.49.24.C02.1.454.CMB.1.raw
  modified_base (110)..(110): a, c, t, g, unknown or other
  misc_feature (110)..(110): n is a, c, g, or t
tcagagtcgagagacacgaccggtgctcgatttagtacagatcgttagggaaagggaaaagccctgaggaaaacaaacccagctgggaagcctgagaacacgtagccttnatgagtcgtccccacagtggcctggatgatgtcttctccgtcggacttccttgtcttagtgatcgaggtgtaggtactcgtcagtacgttgtggtacgaaccgaggactcctagttcgttgtacgaggttccggggtcccgggggactaggtaccaactctacctacgttcggtaggtccgttagcgtcgtcgtacgtcgtacgtacgttctacgtaacgttccgtaccaccgtaggtctacggacgcgaccgaccgtacccgacggtaccgacggtccctaccgacgacccgtacgtacctacgtaacgtaacgtaacgtaaactaacgttaaacgtcgtccttacgttcgtttcgggtcggttaccctgtacgttccgttcttctcgtccgtcttacgtcgttacggtaacggtaactacgtcctaccgtacccaccgtaccgtaccggtacccgggtccgggaacccgacgggtactaacgtcgtaagttacgtaacgttaagtagttaacggttttattacgtttacggttggtttaaccgtggttactttacgggttacgggttcggttttaagggggtttcccgtttaaggtttttcgggtttaccggggtttcggggttaaccgggaccggggttaaacgtaccgggtaacggttcccgggtaaaccccgttccggttccccgttaacggg

SEQ ID NO: 178243 - DNA, 819 bp, Homo sapiens
  misc_feature: GYAE6OF01DH8R6.49.24.C02.1.454.CMB.1.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (303)..(303): a, c, t, g, unknown or other
  misc_feature (303)..(303): n is a, c, g, or t
tcagagtcgagagacacgaccggtgctcgatttagtacagatcgttagggaaaggggaaaaggccctagaaggaaaacaaaccccagctgggaagcctgagaacacgtagccttcatgagtcgtccccaccatggcctggatgatgcttctccgtcggactccttgcttatggatcgaggtgtggatctcagctgtggtgacccgaggngcctagtccgttgcgnggtcggtcccggggggacagtcacactcacttgngcttgngctcgtgctcagtctacgtaactcggttaacctacccngtccgtaggtaccaggccaaccggacccaggcctacggacctccgacggcacggtctactacgtaggtaactataaactacgtacgttacgtccttacgttcggtaccgggttcctggtactccggtctttcctcggtccgtaccttaccgtaacgttaccccggttaacgggaaaacctaacggtacccttacccggtaccctaacccgtaaacgttaacccggtacccggggaacccggggtaaccccgtacggggaacccgttaaggaaccgttaaggtaacgtttacgtaaaggtttcggttaacggttaactttttaacgttaccgtttggtttacgtaggtttacgtacggtttaacgggttccgggtttaggggtttacgggttttccggggttttacggtttttttcggggtccggggttttaccggggaacgggggttaaacccgggtaccggttaaacggttcccgtttaacccgggttaaccccggttcccgggttaaacccggg

SEQ ID NO: 178244 - DNA, 910 bp, Homo sapiens
  misc_feature: GYAE6OF01EZ1NX.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggctccttgcttatggatcgaggtgtggatctcagctgtgtcgaccgaggacgccattcgttcgtcgaggtccgggtcccggggggacacggtcacctacgtctacgttgtcggtcttagacgtcgttcgtcggctacgtagttcctaccgtaacgttcggttaaccctacccgtacggtacgttacggtaaccccgtacggtacccgaaccgggacccccgacgggacccccggtacggaccccgttaccccgaacccggtccggaaccctccggttacgtaacggtttaacggttaaacgtaaaacttaaaccgtaaaagttaccgggtttccgtaccgtttacccggtttcccggggtttaccggggggttaccccctggttaacctttcccgggttcgttttcccgttaccggttccgggttacccttacccgtttaaccggttacccggtttaacggggaaaccctaacggttcccgtacccggttacccctaccgtaccgaccggtacccgggaccccgggggacccgacgggtacgtaggacgttagaacgtaggttaacggttacggttacgttaagtttacgtttcggttagtcggttcgtacgttacggttcggtttaccgggttggggtttccgggtttcgggtttttccggttttacgggttcggggtttacccggggtaaccgggaacgggttaaaccccggagggtttaacccgtccgggtttaacccctcccggttaacccgg

SEQ ID NO: 178245 - DNA, 825 bp, Homo sapiens
  misc_feature: GYAE6OF01A7WXT.49.24.C02.1.454.CMB.1.raw
  modified_base (217)..(217): a, c, t, g, unknown or other
  misc_feature (217)..(217): n is a, c, g, or t
  modified_base (433)..(433): a, c, t, g, unknown or other
  misc_feature (433)..(433): n is a, c, g, or t
  modified_base (692)..(692): a, c, t, g, unknown or other
  misc_feature (692)..(692): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccacatggctggatgatgcttctcctcggacttccttgcttagtggactcgtagggtgtaggtaacttctcagtcgtggtgggtacgacccgnggacgctagtcggttagtccgacgggttcggggtaccccggggggaacacgtacacgtaccgttctacgttggtaggtccttaggcgtccttcgtacggtcctcgtaaccggtttcctaacgtaaaccgtttccggttaaccctacccgaggtccggttaaccggaccgtacgaccgaacccggacccgacggccgaacggcctaccggaccgacnccgtactacgaacgttacggaacacttaactaaacgtcgtaccgtctttccgtacggtcgggtacctggtacttccgtactttcgttgccgtccttactacggttaccggttacggaaccgtaacgtcccgttacctaccccgtacaacccgttacgggccccggggtaaaccccgggacccggtaagaccggttaggaacgtacgtagtttaacgggtattacggttaacgttatttaacgggttcgttaggttacgngttacgtggtttacggttccggttggggtttacggttcgggtttttaccggtttcggttaccgggggttacgggtacccgggaagttacccggagtttccccgggacgtttccccggttaacggtaccccggg

SEQ ID NO: 178246 - DNA, 795 bp, Homo sapiens
  misc_feature: GYAE6OF01CBV3J.49.24.C02.1.454.CMB.1.raw
  modified_base (477)..(477): a, c, t, g, unknown or other
  misc_feature (477)..(477): n is a, c, g, or t
  modified_base (654)..(654): a, c, t, g, unknown or other
  misc_feature (654)..(654): n is a, c, g, or t
  modified_base (689)..(689): a, c, t, g, unknown or other
  misc_feature (689)..(689): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtcccccaccatcggcctggatagatgtccttctcccgtcggtacctccttgtacttataggatcgtaggtgtaggaatcctcagactggtcggtacgacccgaggaccgacctacgttcggttaggtccgtagggtccgggggtccccgggggggaactacggtcctaacctaacttaccgtagttcggtacggtacttaggacgtcctcggtcgtcctttacggacgttactaacccgttaaccgtttaccggttaacccctacccgtacgtcttacccgggaaccaccgaaccgaaccggaccccgtaccgggacccgaccggtaccctacccgaccgacccgactacccgtanaacgttacggtaaactaacgtaaaactaaacgtcgttacccgtcctttacggttcgggttacccgggttccctaacggtcttaccgtccttacgtcgtcccgtatacccgtagttaccggtaagaaccaacgtcctcaaccctacaaccgaccgccggaccgggaccagcgtaacgntagatactagttagacttaattattcgtgtacgtnacgttacgtcgttggttacggtggtttccgtttggtttcggtcgggttacgggacggtaaccgggtaccgttacgacccggttacccgtaaaccgtggtaacccgg

SEQ ID NO: 178247 - DNA, 827 bp, Homo sapiens
  misc_feature: GYAE6OF01CKL54.49.24.C02.1.454.CMB.1.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctccgtcggacttccttgcttagtggatcgaggtgtgaatctcagtactggtggtcgacccgaggacnccattcggtgtcgtacggtccgggtaccccggggganacgtaccactacctctacgttggtacggtccttggacgtccttcgtacggccttaccgacgttaccgtaccgtaaaccgtttacccggtttaaccctacccccggaaggttccggttaccggaacccacggacccgaacccggaaccccccggaggccccgacggtccctacccggaccgtccgacccgcttacgaacgttcggtaaaacctaacgtaaacctaaacggtttcgtccgtccgtttccgtttccgggtaccgggtccctagtcgttccgtactttccgttacgtcgtaccctacgtaccgtcgtaacggaacctacgtccctacgccctacgaccgtacgacccgggaccgggccaacggtcgagtacgtagtacgtagtagtagtttagttaacgtttacgttacgttggttcgtacgttacgttcggtttacggttgggtttcgggtttaccgggtttccgttttccgggtttacggggtttcccggggtccggggtaaaccgggtaaccggtaccggttaacccggttccggtaacccggttcccggttaacccgttaacccggg

SEQ ID NO: 178248 - DNA, 853 bp, Homo sapiens
  misc_feature: GYAE6OF01CNLJE.49.24.C02.1.454.CMB.1.raw
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
tcagagtcgagagacacgaccggtgctcgatttagtacagatcgttagggaaaggggaaaaggccctgaggaaaacaaaccccagctgggaagcctgagaacacgtagccttcgatgagtcgtccccacatggcctggatggatgtccttctccgtcggaccttccttgtctttaagtggactacgtagggtggtaggtaattcctcaggaccgtggtacggtccggaacccgagggacncctaagttcggttgttccgacggggttcccgggggtccccgggggggaanacgggttacccaacctacgttaccagtttcggttggtacggtttcggcgtccgttcggtcggtacctacgtacgttcctaacggtaaccggttttaccgggtaaccctacccgaaggttcccgtaggtaaccgcgaaccgaacccgaccccgcggccggaccggtcacccggcaccgtcgctcagtagtacaataactaagttcgcctcgttcgttcggtaccggtctaggtccttcgacgtttcgcgtaacgccctacgttcgtacggtaaggaaccgaacgtcccgtaccgtaccctaccgtacccgtacgggtaccgggaaccccgggaccgaacccgggatacggtactaggtaacgtagtttaaggtacggttatttaccgtttaacgttcgtaggtttcgttacggttacgttggttccggttttaggggtttagggggttcggttttcggggttttaccgggttttttccggggttacggggggttacccgggtaaaccgggttaaccgggtacggttaccggtacgggttacccgtacgggttccgttacccggg

SEQ ID NO: 178249 - DNA, 811 bp, Homo sapiens
  misc_feature: GYAE6OF01B5D6M.49.24.C02.1.454.CMB.1.raw
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtcgtcccacatggcctggatgatgcttctccgtcggacttccttgcttagtggactcgaggtgtaggaatctcgagtacgtggtcggtacgaccgaggacgtcctagttcgttcggtcgtacgggttccggggtaccccggggggactacggtacctaactaccgtcgtaccgtttggtcggtcgtttaggaccgtcgttcgtaggtcctcgtacgtcctacgtaacgtcgttacccgtaccgacgtccgttacgaccnggtaccgaccggaccccgnggaccgaccggtccaccgaccgaccgtacgctactacgttacgaacgtaacgtaacgtaaagttcgtccgttacttccggttacgttccgggtaacctcggtaacgtccgttacgttcgttaccgtacgttcctacgttaccgtaccggttaacgaaaccgtacgtcccttaacccgtacctaccgtaaaccgtccggacccggggaccccgggtacaggttaccgaagtaacggtgaacgttagaaggtttactaacggttatttaacggtcgttaggttcgttaagttccggttaaggtttcgtacggggttttgggttaccggtttcggtttttacggtcgggttaccggggttaacgggacgggttaacccgaacggttcggttaccgtccggtaacccgttcggtacccgg

SEQ ID NO: 178250 - DNA, 822 bp, Homo sapiens
  misc_feature: GYAE6OF01CXSYL.49.24.C02.1.454.CMB.1.raw
  modified_base (265)..(265): a, c, t, g, unknown or other
  misc_feature (265)..(265): n is a, c, g, or t
tcagagtcgagagacacgaccggtgctcgatttagtacagatcgttagggaaaggggaaaaggccctgaaggaaaacaaacccagctgggaagcctgagaacacgtagccttcatgagtcgtccccaacagtggcctggatgatgcttctccgtcggtacttccttgtacttatggatcgtagggtgtaggaactctacagtacgtggtggtcgaacccgagggacgccagttcggtgtcgacgggtccggggtacccggggganacgcacctactcgtacgttgggtcggtcttggactccgttggtcggtctacctgtaccgttacgtaaccgttcgttaacccacccgagtcgttacggaccgacaccgaaccgaccccgagaccgtacgcccaccacggactaccgctacgacgtacgtaacgaaacttaaacgaaacgttacgccgttacgtttccggtttcgggtcccggtaccgttagcggttctccgtttctcggtcggaccctaccttaccggtaccggttaacgggaaacgtaaccggtacctacccgtacccgtaaccgtacccggtaaccggtacccggggacccggggtaacccggaccgggtaacggtaacggtaagtacgtaagtaggttaagttaggtttagttaacgttttacgttaacgttggttacgttgtacggtttacggtacggtttgggttaggggttcgggtttcggttttcgggtttcgggtttccgggtacggggtacggggtaaccggtaacgtaccgggtcggttaacccggtacccggtccggttaaacccgg

SEQ ID NO: 178251 - DNA, 956 bp, Homo sapiens
  misc_feature: GYAE6OF01AD5F4.49.24.C02.1.454.CMB.1.raw
tcagagtcgagagacacgaccggtgctcgatttagtacagatcgttagggaaaggggaaaaggccctgaggaaaacaaaccccagctggaagcctgagaacacgtagccttcgatgagtcgtccccaccagtgcctggatgatgcttcctccgtcggcttccgttgtctttagtcggatcgaggttgtaggtaacttccgtacgtagtacgtgggttcggtccgaacccgacggacggtccctacgtttcggttacgtacggtacgggtccgggggtacccccgggggggtaactacggttccgaaccgacgttaccgttacggttacggttcggtccgttagtaccggtccgttacggtacggttcctaccggtacgtttccgtaaccgtaaccggtttaccgtttaacccccgacccggtaagtcccggttaccggtaaccggacgaccccgttaacccggaccccgtacggacccgtaccggtcctaccccgaaccgtacgaccgcccgtttacgtagtaccggtaaacctaaacgtaacctaaaacgtttcccggttacgtcccgtttaccggttaccggttacccggggttaccttaagttcccggtaccgttcctttaccggttccggcgtttaacccctcgttacccgttaaccgggtaacggttaaccggacgttacccgtcccggtaaccctaccgtaaaccggacccgtaccccggggccgggtaacccggacggtaccgtaacgggttacgaacggttaaggttattaccggtttaacgttacggtttaagtttaccggtttcgttacggttacgtttacgttccggttaagttccggtttaaagggttcgggtttacggtttcgttttacgggttacggttcggggtacgggtaccggtacgggtaacccggtgtacccgtccggttaacgtcccgttaccggg

SEQ ID NO: 178252 - DNA, 773 bp, Homo sapiens
  misc_feature: GYAE6OF01ECC2S.49.24.C02.1.454.CMB.1.raw
  modified_base (272)..(272): a, c, t, g, unknown or other
  misc_feature (272)..(272): n is a, c, g, or t
tcagagtcgagagacacgaccggtgctcgatttagtacagatcgttagggaaaggggaaaggccctgaggaaaacaaacccagctgggaagcctgagaacacgtagccttcatgagtcgtccccaccatggcctggatgatgcttctcctcggactccttgcttatggatcaggtgtaggaactctcagactggtcggtcgacccgaggacgcctagtcggttgtcgacggttcgggtccccgggggggatcgtccactactctacgttggnggtcttgacgtcctcgtgacgtcgtagtctactacgttcggtaccctacccagctcgtaaccacgaccaccgaccccgagggcccgacgggtcctacccgaccgccgtaccgccttacgtaacgtcggtaaactaacgtaacgtaaacgttcggtccttaccgtttaccgtttcgggtaccgggggttcccctggtaccgttcccgtctttccgtccgttacggtcccttaactacgttaccggttaaggaaaccgtacgtccctaccgtaccctaccgaccgtacccggtaccgggaccccgggggaccaacgggcaacggtacgtagagttacgtagttacgttagttactttagttacgttcggtcggttacgtacgttcggttaggttcgggttggggtttacggtttccgggttttcgttttcggggtacgggttaccggggaacgggttaccgggaaccgttacgtaccggtccggttaccgtcccggtaaccgg

SEQ ID NO: 178253 - DNA, 624 bp, Homo sapiens
  misc_feature: GYAE6OF01A2UZH.49.24.C02.1.454.CMB.1.raw
  modified_base (237)..(237): a, c, t, g, unknown or other
  misc_feature (237)..(237): n is a, c, g, or t
  modified_base (369)..(369): a, c, t, g, unknown or other
  misc_feature (369)..(369): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggganagtcacactcacttgtggcttgagctcgtggctcagttcctacaacttggttacctaccccagccgtggtacccagccacgaccccgaggccaggcctccgacgccacgctcatgtaacataacaaatgtcncttcgttcgtcggggtccctgacttccgtctttctcgtcggtcccttacctacgttcccgttagggaaaccaaacgtccctcgacccctccaaccctacgtcccgggacccgggggtcccgacggacaggatgacgtagaattgtagtatttacgttattgttcgtgtcttgtacgttcggtgggttggttcggtttcgttttcggtggttacgggcgggtacggaccgtaggtcgtcggtcccgtccgtaccgg

SEQ ID NO: 178254 - DNA, 1021 bp, Homo sapiens
  misc_feature: GYAE6OF01DQS0X.49.24.C02.1.454.CMB.1.raw
tcagagtcgagagacacgaccggtgctcgatttagtacagatcgttagggaaagggaaaaggccctgaggaaaacaaaccccagctgggaagcctagagaacacgtacgccttacgatgagtccgtcccccacctagtcggccgttaggatggattgtaccttcctcccgtcggtaccttccgttggtacttagtggtatacgtagggtgttaggtaacttaccgtacgtagtacgttggtcggtaccggacccgaaggaccgtaccgttacgtttccggttcggtaccggtaaccgggggttcccggggtaacccccgggggggaataccggttaccctaccgttaccgtaccgttacggttcggtacggttcgttacggtacgttcccgtgtcgggtacccttacgtacggtttacctaacggttaaccggtttacccgtttaacccgtacccgtacgttccggtaacccggtaacgacccgtaacccggaaccccgaacccggacgtccgtaaccggtcccctacgacgacccgtacgttcgtacgtaaacgtcgttaaaacctagtaaaaccgttacgttccggttaaccgtctttcccgggttaccggttaaccccggttcgaactttacccggttctttcccgttacggtcctaccggttaccttaccgtaccgttaccggtaaacggtaaccgtaccggtacccgtaccccgttacccgtaccgtacccggtaccggtaacccgggacccggtaacggtaaccgtaacgtagtaaccggttaaggaccgttagggttaacgtttaacggtttagttaacggtttcgttacgtttagggttaccggttcggttaacgttcgggttttaaccggttcgggggttttaacggttttccggggtttttacgggttttccggttttacgggggttcgggtacccgggggttaaaacgggtacccggtaaccggttcggttaaccccggttacccgttcccggtaaacccggttacccgg

SEQ ID NO: 178255 - DNA, 691 bp, Homo sapiens
  misc_feature: GYAE6OF01B986X.49.24.C02.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctccctcggactccttgcttatggatcaggtgtggaatctcagactgtggtgacccagganccatcgttgtcaggtcggtcccgggggganagtcacnctcattgngctgngctctgctngtctacacttcggttaccacccagtcgtcggtaccagaccgaacgacccccgaggccgacggccctaccgaccgactaccgctacagtagtacgaataactaagtaccgtactcgttccttcggtaccgggtccctacgtatccgtcctttcgttccgcgtccctacgtacgttacgtaacgggtaaacaaacgtcctacccgtcccctaccgtaaccgaccgtccgggaacccggggacccgaaacgggacaaggtacgtaacgtactagggtaattccggttattaagtttacgttacgtttggtcggttctacgttagttaccgttgggtcgggtttggtttcgggttttcgttttacgggtcggttacgggtaccgggtaacggtacggtaccgtcgtacccggtaccgttccgtacccgg

SEQ ID NO: 178256 - DNA, 887 bp, Homo sapiens
  misc_feature: GYAE6OF01CE6OI.49.24.C02.1.454.CMB.1.raw
tcagagtcgagagacacgaccggtgctcgatttagtacagatcgttagggaaaggggaaaagccctgaggaaaacaaaccccagctgggaagcctgagaacacgtagccttcatgagtcgtaccccacatggcctggatgatgcttccgtcctcggacctccttgcttagtggatcgtaggtgtgatctcagtactggtcgtacgaccgaggcgcctagtcggttgtcgtaacgggtccgggggttaccccggggggaactacgtccctaccgtaccttaccgtacgtttcgggtcggttaccttaggaccgttcgttccggtaggtcccgtcgtaaccgttcccgttaccgtaaaccggtttaccggtttaaccccgtaaccccggtaggacccgttaccggtaacccacggaccggaccccggaaccccggaccggtccacccgggtaccccacccggaacccgtacccgccgtacctaccgtaacggttacggtaacgtaacttaaacgtaaacgttccgggttacctccgtttcccggtttacgggtcccgggttaccccgtgttaccgtccgtttccgttccgttcggtacccggttaccctacccgttaccgttaccgggttaaacggaaaccgtaaccgttcccgtaccccgtacccctaccgacgtacccgggtaccccgggggaccgggaccccggtagaccgtaggttaacgtcgttagtaaccggtaggtttaacggtgtttaaacgtttcggtttaacggttcggttagttccggttcgtattaccggggttggttgggttacgggttttcgttcggttttacggtgggtaccgtacgggacgtacctcgtacggtacccgtccgtaccggtcgg

SEQ ID NO: 178257 - DNA, 669 bp, Homo sapiens
  misc_feature: GYAE6OF01A7VME.49.24.C02.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagatcggtggtgacccgaggancccattccgttgtcgaggtcgggtccccgggggganacgtcacacgtcacgttgnggnttgganctcnggcctnagtctcacgttgttaccnccngcgtcggtaccagccgacgacccgnggccnggcctccgacgcacgctcatcgaacactacaaatcgtcgtacttctcgttcgggtcctggtactcgtcttcgtcctgcctctactccgttaggaacaacgtcctacccgtcctaccgacctcgtacccgggacccggggtacccacggactaccggatacggtactaaggtagttaggttagttaagttaacgttacgttggttcgttagtccgtttagtccgtaggtttggggttacgggtttccgggttttacgttttccgggttcgggttacggggaccggggttaaaccgggaccgtaacggttccgacgggttcccgtacccgtaacccgg

SEQ ID NO: 178258 - DNA, 879 bp, Homo sapiens
  misc_feature: GYAE6OF01EBSO6.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggagccattcgttgtcgtaggtcgggtccccgggggggacacgtcgactacctctacgtttggtcggtccgttggacgtccgtcgtcggtcctccgtacgttcctaccgtaaccgttacggtttaacctaacccccgtaggtccgttacggtaacccacggacctaccggaacccccgacgggcccgacgggtccccgtacccgacccgccgtaaccgtccttacgtaacgttacggtaaccgaaactaactaaaaacgttcgtccgttccgttccggtttccggtccggggttacccttacggacttcccggtcctttcggtccgttccggtacccttaccgtaccgttacccggttaacgggaaacctaacgttccccgttaccgtaccccctaccgtaaccccgtacccggttacccggggaaccccgggggacccctaacgggaccgtaacggtacgttagtaaggttaacggtaagtttacggttaagttaacttttaacggtttagttacggttaggttacgttaccggtttgttacgggtttcgggttaggggtttcgggttttccgggttttaccggtttttcggggttcggggttacccggggtacggggtaaccgggtaaccgttacggtacccggttccgtaaccccggttcccgtaacccggg

SEQ ID NO: 178259 - DNA, 766 bp, Homo sapiens
  misc_feature: GYAE6OF01DT2KZ.49.24.C02.1.454.CMB.1.raw
  modified_base (472)..(472): a, c, t, g, unknown or other
  misc_feature (472)..(472): n is a, c, g, or t
  modified_base (589)..(589): a, c, t, g, unknown or other
  misc_feature (589)..(589): n is a, c, g, or t
tcagagtcgagagacacgaccggtgctcgatttagtacagatcgttagggaaaagggaaaaggccctgaggaaaacaaaccccagctgggaagcctgagaacacgtagccttcatgagtcgtccccaccatggcctggatgatgcttctcctcgactccttgtcttatgatcgaggtgtggaattctcagactggtggtacgacccgaggacgcctattcgttcgtcgacggttccggggtccccggggggactacggtccaacctacttcctaacgtttggtcggttcgttggacgtccttcgtcggtccttcgtagttcctaccttaaccgttacggttaaccctaccccgacgtcgttacggtaccacggtacccaccgacccggacggcccgacgtccacccgcgccacgtctacagtcgtaactaagtaaccaagtcgttcgtcttccgtttcggtccgggttaccnggtacctcgtcttccgtgtcgtccttccgtacgttacccggtaacggaaaccgtaacgtccgtacccgcccctaacctaaccgtccgtcccggggacccggaccggacgcgtaacgntacgtacgtagtaacgttgtttaacgttactttaacgttcggttgttcggttacgtcgttaacggttggtcgggttttggggttcggtttacgggtttttcggttttcgggttcggttacggggtacgggaacgggtaccttacgggtacctacccggttacccgttcgtaacccgg

SEQ ID NO: 178260 - DNA, 712 bp, Homo sapiens
  misc_feature: GYAE6OF01E0WRF.49.24.C02.1.454.CMB.1.raw
  modified_base (213)..(213): a, c, t, g, unknown or other
  misc_feature (213)..(213): n is a, c, g, or t
  modified_base (325)..(325): a, c, t, g, unknown or other
  misc_feature (325)..(325): n is a, c, g, or t
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccacatgcctggatgatgcttctcctcggactccttgcttaatggatcgaggtgtaggaatctcgagtactgtggtcgacccgagggacnccagttcgttggtcaggtccgggtcccggggggacacggtcactaccgtctacgttggtggtcttgacgtcgtctggcttcgagtcctacgtaacgttcggtacctacccgngtcgacggtaccagaccgaccggacccgacggccgacgcccgtaaccgcgtacccagtccgtaagtacgtaacgtaactaaactaacgtaacgtccgtacgtcttaccggtcgggttaccgtccgttagccgttcctcgttacgtccgtctaccttacggttacgtaaccgggtaaanaacgtaccgttcgtaccccacccgtaactccgaacgggtcccgggacgaccgatagacgtgtactagactggtagtacgttattacgtgttgtcgcgttagttggtacgttgggtcggggttttcgttcgtttttacgggttcggtccgggttacgggaacccggtaacggttacgacgttaccggtcccggtaccgttaacgtaccgg

SEQ ID NO: 178261 - DNA, 869 bp, Homo sapiens
  misc_feature: GYAE6OF01DHK9I.49.24.C02.1.454.CMB.1.raw
  modified_base (141)..(141): a, c, t, g, unknown or other
  misc_feature (141)..(141): n is a, c, g, or t
  modified_base (194)..(194): a, c, t, g, unknown or other
  misc_feature (194)..(194): n is a, c, g, or t
tcagagtcgagagacacgaccggtgctcgatttagtacagatcgttagggaaagggaaaaggccctgaaggaaaacaaaccccagctgggaagcctgagaacacgtagccttcatgagtcgtccccacagtgcctggatgntgtcttccgtcctcgacttccgttgtcttagtgtatcgtaggtgtgaactctnagtcgttggtggcgacccgaggacgtacctagttccgttcgtacggtacgggtcccggggtacccggggggactacgtaccgacctaactcgtacggtttggtcgtacgttcgacgtcgtcgtagctaacgtctacctcgtaaccgttaccgtacctaacccgcgtcgtaccggtaccacgtaccgacccggtaacccgaccgtccgtacggaccctacccgaccggtaccgtaccgtctaaacgtactacggtaaaaccgtaaaatttaaccgaaacggttccgttaaccgttcccggttttaacggtcccgggttccgggttaccctacggtacgtttccccgttattcccgtaccggtttcgtccccgttaacccgttaccgtttaccggtaaacggtaacccgtaacggttcccctaaccccgtcccgtacccgtaccgtaccgggtaccccggggaaccccggggaccgaacccgggtactaacgggttagaaccgtcggtaagttaaacgttagttaaacgtttagtttaacgttaccgttggttccttgttaccgttttggtcggtttacggttggggtttcggtttccggttttggtttcgggttcggttacgggtaccggaacggttaccgaacgggttacccttcggtacccgttcccggtacgg

SEQ ID NO: 178262 - DNA, 943 bp, Homo sapiens
  misc_feature: GYAE6OF01DS9X4.49.24.C02.1.454.CMB.1.raw
tcagagtcgagagacacgaccggtgctcgatttagtacagatcgttagggaaagggaaaggccctgaggaaaacaaacccagctgggaagcctgagaacacgtagccttcatgagtgtccccacatgcctggatgatgcttctccgtcggacttccttgcttagtggatcgaggtagtggaattctcgacgtactggtggtacgacccgaggacgccagttcggttgtcgagggttccggggtaccccggggggatacgtccacactcgtacgttgtggtcttggacgtccgttacgtcggtccgttaccgtacgttcccttaccgttaaccggtttaccggtttaaccccgtaacccgtcggttaccggttaccggtaaccccgaacggtacccgaaacccccgggtaaccccgccggggaacccgacgggtcccctaacccgacggtacccgaccctaccgtacctaagttaacggtaacctaaagtaaaaccgttaaagttcccggttccgtttccgtttacccgggttttcggggtacccgggttacccgtaagtttccccgtccgggtttcccttaccggtttccgtacccggttccttaaccgttaccggttaacccggttaaacgggaaaccgttaccgtcccctaacccggtacccctaaccgtacccgtacccgggggtacccgggtacccgggggtcccgaaacggtcggaactttacggtacggtaaggttaggtacgtttaacgttcggttttaacttaaccggtttagttcggggtaattacgggtttagttccggggttttatcggggggttttgggttaccgggttttccggttttgggtttttaccggggccggggtttaacggggtaaccggtacccggtaacggtccggttaaccgggtttccccgtacggttccctaaccgggg

SEQ ID NO: 178263 - DNA, 757 bp, Homo sapiens
  misc_feature: GYAE6OF01AWYAO.49.24.C02.1.454.CMB.1.raw
  modified_base (223)..(223): a, c, t, g, unknown or other
  misc_feature (223)..(223): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatgcctggatgatgtcttctccctcggtactccttgtcttatggtactcgtaggtgtaggaacttctacagtctggttggtacgacccgaggcncctagtcgttggtctagggtccgggtccccggggggactagtcaccacgtcgtacgtttcggtcggtcgttaggacgtcgttcgtcggtctctacgtcctcgtaacgttcggttaccctacccgacgtcgttacggtaaccgtacgaccgtaccggaccccgacccggtaccgaccggtccctacccgacccggtcccgaccgtccgtaccagttacggtaaccgtaattaaccgaaagttacgtccgtccttccgttacgggttcccgggttacctacggtactccttcccgtttagttccgtcggtccctacgtccgttaccggttaacgggaacctaacgccgtccctccccgtacctacccgaacggtcccgggaccgggtacccgcggtaacgagtacgtcgtaacgtatacgttaggattaacttagtcgttgtgtctgtagtgtcggttgggtcggtttgtttcggtttacggtcgggtaccgggtaggaccgtaaggtccgtacggtcgttcccgtcccgtaaccg

SEQ ID NO: 178264 - DNA, 979 bp, Homo sapiens
  misc_feature: GYAE6OF01CKDV4.49.24.C02.1.454.CMB.1.raw
  modified_base (269)..(269): a, c, t, g, unknown or other
  misc_feature (269)..(269): n is a, c, g, or t
tcagagtcgagagacacgaccggtgctcgatttagtacagatcgttaagggaaaggggaaaaggccctaggggaaaacaaaccccagctgggaagcctgagaacacgtagccttcatgagtcgtccccaccatggccgtggatggatcgtcttcctcctcggtaccttccttgcttatggatcgaggtggtgtaatctacagtacgtggtggtcgacccgaggacgtcctagttcgttgtcgacgggttccgggggtaccccggggganaccggtactaaccgtacttaccgtacgtttcggtggtacgttggccgttcgttcggtaggtccttacgtacgttcctaccgttaaaccgtttccggtttaaccccgtaacccgtacggtaccggttaccggaaccgaccgtaccccgaacccggaccccggtaccggtacccgaccggccctaccccgaccggtacctacccggtaacctaccgtaacgttaccgtaaaacgtaacttaaaacgtaaccgttaaccggttaccgttcctttccccggttccgggttcccgggggttttacctaccggttacgtttcccgttccgtttccggttccgttacccggtaccctacccgttaacgtcccgggtaaccggtaaaccgtaaccccgtcccgtaccccgttaccccgtaacccgtaacccgtacccggtacccgggaccccggggacccgtacgggtacgaaccggtagttacggtaacgttaggtaaaggtttcggttaactttaagtttaccggtttacgtcgggtttcggttaccggttgttaagggtttacggttcgggtttcggggtttacggggtttttccgggtttttccggggttttcggggttaaccggggttccgggttaacccggggtaacgggttaccctaccgggttcgtaacccccggttaacggttcccccggttaaccggtaacccccggg

SEQ ID NO: 178265 - DNA, 721 bp, Homo sapiens
  misc_feature: GYAE6OF01AR6LM.49.24.C02.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
  modified_base (715)..(715): a, c, t, g, unknown or other
  misc_feature (715)..(715): n is a, c, g, or t
tcagagtcgagagacacgaccggtgctcgatttagtacagatcgttagggaaagggaaaaggccctgaggaaaacaaacccagctgggaagcctgagaacacgtagccttcatgagtgtccccacatggcctggatgatgcttctccgtcggactccttgcttaatggatcgaggtgtgaatctcagactgtggtcgaccaggacgcagtcgttagcagtcggtccgggggangtcacactcacgttgcgtcgttagcgcgtcgtggtctcgtacgtctactaacgttcggttaaccaccccgagtccgtcggtaacncgacgtaccgacccgacggtccgaacggcctaccgacgaccgtaaccgccgttacgaacgttcgtaaacgtaactaacgaaaagttcggtctaccgttcggttacggtaccgggttccaggttactccgttactttccgttcgtcggtacctaccgtacgttaccggttaacggaaaccttaacgcgttacccgaacccttcgacccgtaacggtccgggaaccggggaccctaaggcgtaagtacgtagaacgtaggttaaacgtacttaaggtaaccgttttagttacgtcgggttaactcgtaacgttgtacgttagggttcgggtttgttaccggtttcgttttacgggcgggttacggaacggtcggaaccgtaggtaccctcgtacccgtntaccgg

SEQ ID NO: 178266 - DNA, 1041 bp, Homo sapiens
  misc_feature: GYAE6OF01B2PWI.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagcctttcatgagtcgtccccacatggcctggatgatgcttctccgtcggtaccttccttgtacttagtggtatcgtaggtgtaggtaactcgtcgagtacgttggtacggtacgaccgaggtacgtccgagtttcggttggtaccgtacgggtcccggggtacccgggggggactacggtccaaccgtaccttacgtaccgtttgggttccgtacgtttacggacgttccgttcggtcggtcctaccggttagttacccgttaacctaaaccgttttccggttaacccctaacccgttacggacgtttaccgggtaacccgaccggaacccggaacccggtaccccggaccgggaaccccggttcgggtacccctaccggtacccgtaccggaccccgttacttacgtaaccggttaacgtaaacccgtaaacgttaaaaccgtaaagttcccggtaccgtttaccctttccggggttaccggtttaacccgggtcccgttaggttaccgtttcccgtttaccgtttccggttccgttcccgttaccgttaacccggttcgtttaaccgggtaaaccggttaaccaaccggtcccgttacccgtacccctaacggaaaccccggtttccggaaccgggggtacccccgggagtaaccggtacgtacgggttacccttaaaggtaccggttaaagtttaaccggtttaggttaaccgtttaacgtttacggtttacgttaacggttcgttaacgggtttcgttaaggtttcggggtttcgggtttaccggggggtttttcgtttacccgggtttttttggggtttaccgggttcccggggtaacgggggtaaacggggttaaacccggtaccggggttaaccggttacccccggtttaaccccggggttaccccggtttaccggaacccccgggg

SEQ ID NO: 178267 - DNA, 777 bp, Homo sapiens
  misc_feature: GYAE6OF01EBZ4Z.49.24.C02.1.454.CMB.1.raw
  modified_base (443)..(443): a, c, t, g, unknown or other
  misc_feature (443)..(443): n is a, c, g, or t
  modified_base (600)..(600): a, c, t, g, unknown or other
  misc_feature (600)..(600): n is a, c, g, or t
tcagagtcgagagacacgaccggtgctcgatttagtacagatcgttagggaaaggggaaaggccctgaggaaaacaaccccagctgggaagcctgagaacacgtagccttcatgagtcgtccccaccatggcctggatgatgcttctcctcggactccttgtcttagtggatcgaggttgtaggtaacttctcgagacgttggtggtacgacccgaggacgcctagttccggttgtacgtacgggttccggggtacccccgggggggtactacggtccaacctactccgtacgtttggtacggtcttacggaggtccgtcgtcggtcctactacggttcctaccgtacgtttaccggttaaccctacccgagtcccgttacggaccacgaccgaccgtaccccggacgtaccgacggccctacgaaccgccgtaccgcttacngttacgtaacaataacaaagttcgtacgttccgttgtcggtccggtacctgaccgttctcctttacgtcgtcgttacctaccgttacgtttaccggttaagaaaccgacgtccgttcccgcctaaccgacgtacccgccgggacccggtcgacgganacgtactgtaacgttgtaacgttagtagtttacgtttacgttaccgtgttagtcttacggttcggtgggtttcgggttagggtttcggtttacggttttcgggttttcggttcgggtaccggggacgggtaaccggtcgttaccggtaccgtaccccggttacccgtccgtaaccgg

SEQ ID NO: 178268 - DNA, 769 bp, Homo sapiens
  misc_feature: GYAE6OF01D2OQ6.49.24.C02.1.454.CMB.1.raw
  modified_base (202)..(202): a, c, t, g, unknown or other
  misc_feature (202)..(202): n is a, c, g, or t
tcagagtcgagagacacgaccggtgctcgatttagtacagatcgttagggaaaggggaaaggccctgaggaaacaaacccagctgggaagcctgagaacacgtagccttcatgagtgtccccaccatcggcctggatgatcgcttctcctcggactccttgcttatggatcaggtgtggaatctcagactgtggtcgacccnggacgccattcgttgtccaggtcggtccccggggggacaggtcacgactctacgttgtggtcttgagctcgtggtctaccgtagttcctacctaacttccggtttacctaacccctagtacgttacggtacccaacggaccaaccggacccccgagggcccacgggtccaccccgcggtacccacgtacctacgtaacgtacggtaacaactaaacctaaagttacgtccgtacttccgttcggtccgggttcccttggacttcggtctttaccgttcgtcggtaccctccgtaacgtttccggtaaccgggaaacacggtccctaccgtccccgaactacccgtaccggtcgggaacccggggtccctaagggcctaacgtagtactaaggtctaaagttccggtaatttaacggtttagttaccggttgttacgttacgtcgttaccgttagtcgggtttagggtttgggtttaccggtttccggtttttacggtccggggtttacggacggggttaacccggtaggtaaccctcggggtacccttaccggttcccctaaccggg

SEQ ID NO: 178269 - DNA, 715 bp, Homo sapiens
  misc_feature: GYAE6OF01EWCPX.49.24.C02.1.454.CMB.1.raw
  modified_base (352)..(352): a, c, t, g, unknown or other
  misc_feature (352)..(352): n is a, c, g, or t
tcagagtcgagagacacgaccggtgctcgatttagtacagatcgttagggaaaggggaaaaggccctgaggaaaacaaaccccagctgggaagcctgagaacacgtacgaccttcatgagtcggtccccaccatggcctggatgatgcttctcctcggactccttgcttatggatcaggtggtggaatctcagtactgtggtcgacccagggacgccatcgttgtcgaggtcgggtccccgggggggacagtcaacactctacttgtgcttgagctctggctcatctcaacgttcgttacctacccagtcctggtaccagcaaccgacccacggccaggcctcccacgcacnctcatcgtacaataacaactagtcacttctacgtcgggtccctaggacttcgtccctttcgttcctcggtccttaccgtacgttacccggtttaacgggaaactaacgtccgttcccgtaccctaccacccgtaccgacccgggtacccggggacccgaggtacgagtacgtagacgtagtaagttacggtagttaactttacgttaccgttagggttcgtacgttaccgtagttacgttacgggttgggtttacggggtttcgggttttaccgtttttacgggggttcggttacgggggtaccgggtaacgggtaacccgtacggtaccgttaaccggtccccggttacccgttaaccccgg

SEQ ID NO: 178270 - DNA, 882 bp, Homo sapiens
  misc_feature: GYAE6OF01E413L.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgccttctcctcggactccttgtcttatggatcgaggtgtaggaactctcgagacgtggtcggtcgaacccgagggacgaccctagttccggtttcggtaccgacggggttccggggtaccccccggggggggaactaacggttcccaaccgtaccttccgtacgtttggtcgggtccgtttaggacggtccttccgtgggtcctacgtacgttcctaccgtaaccgtttccggttaaccctaccccgtaggccgttacggtaccacggaccgaccggaccccgagggtacccacggtcctaccgaccgccacgtcctacgtacgtacgttaaacaacgttaaaccgtaaagttccggtaccgttccgtttacccggtttccgggttccccgggggttcccttaggtacccgttcccgtttacccgtttccgttccggtcccggtaccccttaccggttaacccgttaacccgggttaaacgggaaaccctaaaccgtcccgttaccccgttaacccgtacccgaacccgtacccgggtacccgggaccgggtacccgaggaacgtacgtagtacgtaagtacgtaagttgttaacgtttacgttacttacggtgttacggttcgtagtttcggtacgtttggggtagggttttcggtttggtttaccgtttcgggttcggggtccgggaacgggtacggacccgtacggtcccgtaaccggttcccgttcgtaacccggg

SEQ ID NO: 178271 - DNA, 837 bp, Homo sapiens
  misc_feature: GYAE6OF01ERUYO.49.24.C02.1.454.CMB.1.raw
  modified_base (657)..(657): a, c, t, g, unknown or other
  misc_feature (657)..(657): n is a, c, g, or t
tcagagtcgagagacacgaccggtgctcgatttagtacagatcgttagggaaaggggaaaagccctgaggaaaacaaacccagctgggagcctgagaacacgtagccttcgatgagtcgtccccaccatcgcctggatgatgcttctcctcggacctccttgtcttagtggatcgaggtgtgaatctacagtcttggtggtacgaccgaggacgtccctaagttcgttacgtcgtaacgggttccggggtaccccggggggactacgtaccaaccgtacctcgtacgttggtacgacttagtcgtacggtccttcgtacgtcttacgacgttacctacgttaaccggttcgttaaccctaccgacgtacgtaccgtaaccacgaccgtaacccgacccgacggacccgtaccgtcccgtacccgaaccgtccgaaccgtcgtaccttaaggttacgtaaccttaagtaaaccttaaagtaccgttcccgtacgttttccgggtaccgtttccgggttacctacgtaacgttcccgttacttccgtcgttcgtcccctacgttaccgttacgggtaaccgtaactaccgttcctaccgacccgttaacgtaccgtaccggtacccgggaccggggtaccacgggacgtacgaagttanaacggtagtaagttcgtaacgtttacgtttacgttacgttagttcgttaggtccgtttagttccgggttcgggtttacgggtttaccgggttttccgttttcgggtttcggttccgggttaccggaaacggggttacccgttaaacgtaccccggcccgttaacggttccccgtaaccgg

SEQ ID NO: 178272 - DNA, 809 bp, Homo sapiens
  misc_feature: GYAE6OF01BMPX6.49.24.C02.1.454.CMB.1.raw
  modified_base (282)..(282): a, c, t, g, unknown or other
  misc_feature (282)..(282): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgactgcttctcctcggtactcttgcttatggatcaggtgtggaatctacagtacgtgtggtcgacccgaggacgcctagttcggtttgtccagggttccgggtccccggggggggaactacggtcacacctactaccgttggngtcgtttggagttccacgttgggtcctcgttaacggtcctacgaacgtttcggttaaacctaccccacggtctacgggtacccaggaccacggtacccccgagggcccctaaggccctacccggaccggtaccaccggtccctacgtaacgttcggttaaaccaacgttaaccgaaaaagttccggtccggtacccttccggttttccggttacgggggtaccccctgggtcccgttacgttctttccggtcgtccgggttcctcccgtaacgttcccgtttaacggaaccgtaaccgtccgtaccgtacccgtctaacccgtaaccggtcccgggaaccggggccgaacggcgaacgtgcggtaacgtcgaaattcggtacgttaatttaacgtcgtttacggtaggttactcggttaccgtagtttggtcggggtttgggttaacgttttcggttttacgggtccggttacggggacgggtccggtaaaccgtcgttacggtacccggtcggttcccctaaccgg

SEQ ID NO: 178273 - DNA, 1050 bp, Homo sapiens
  misc_feature: GYAE6OF01EXX3J.49.24.C02.1.454.CMB.1.raw
  modified_base (199)..(199): a, c, t, g, unknown or other
  misc_feature (199)..(199): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatcgtcttctcctacggccttccttgctttagtaggatacgtaggtgtagtaattccncgtagacgttggtaggtacgacccgagggacacccgtagttcggtttcgtacgtacgggttcccgggggaccccggggggtaactcggtacctaccgtaccttaccgttacgtttgggttccggtcgttacggaccgttccgttccggttcggtcctaccggttaccttacccgtaacccgttaacggtttacccggtttaacccccgtaacccgtaccggtaccggttaaccggtaaccgtaaccgacccggaaaccccggaccccgggaccgggtacccggccgggttaccccaaccccgaccggaccctaccggtaccccttataaaccggttaacggttaaacctaaacgtttaaaaccgtaaaacggtttcccggttaccgtacccggttttaaccggtttcccggggtttaccggggttaccccttaaggttccggtttaccccttccgtttttacccgtcccggtccggttacccgtttaccgttaaccggtttaccgggtttaaacgggaaacccttaaccgggttcccgttaccccgtaacccccggttaaccgtaaaccccggggttacccggtaaaccccggggggtcccccgggggtaaccctaacggggaacccggtaggtttaaccgttacggtaaacggtcggtttaaaggttcggtttaaatttaaccggggttttaacttcgggtttaagttccggggttattcggtttacggtacgggtttcggggtttaccggggtttgggttttaccgggttttggtttaccgggtggggtaccggggtaaggtacccggtacggtcggttacccgttaccgttcccgttacccggtaacg

SEQ ID NO: 178274 - DNA, 749 bp, Homo sapiens
  misc_feature: GYAE6OF01CQ3E3.49.24.C02.1.454.CMB.1.raw
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctggactccttgcttatggatcaggtgtggaatctcagactgtggtgacccaggacgccatcgttgtcgaggtcggtcccgggggangtcacactcacgttggtgtcttagagtctntcggctacgacgtctacgtaacgttacggttaacctaccccagtaccgttcgggtaaccacggacctaaccggaaccccgacggggacccacgggtaccctcccgaaaccgccgaaccgtcctactacggtacgtaaccgaataaacaaagttcgtaccgtcgttacgttcgttacgggtaccctgtaccgtcgtctttctacgtcgtaccttccgtaacgttaccgttaacggaactaacgtcccgtacgtcccttacgaaccctcgttacccgggaccggggtacccacgggactaacgtacgtaggtaagttcgtaaacgtgttacgtttaaagtttcgtttacgttaggttgtcgtacgtttggtacggttcgggtttagggttagggtttccgggttagttttttaccgggtcggttaccgggggtaacggaacggtaccgtaacggtccttacccggtcccgttaccgttaacccgg

SEQ ID NO: 178275 - DNA, 749 bp, Homo sapiens
  misc_feature: GYAE6OF01A947A.49.24.C02.1.454.CMB.1.raw
  modified_base (425)..(425): a, c, t, g, unknown or other
  misc_feature (425)..(425): n is a, c, g, or t
  modified_base (605)..(605): a, c, t, g, unknown or other
  misc_feature (605)..(605): n is a, c, g, or t
  modified_base (611)..(611): a, c, t, g, unknown or other
  misc_feature (611)..(611): n is a, c, g, or t
tcagagtcgagagacacgaccggtgctcgatttagtacagatcgttagggaaagggaaaaggccctgaggaaaacaaacccagctggaagcctgagaacacgtagccttcatgagtcgtccccacatcggcctggatgatgtccttctcctcggacttccttgtcttatggatcgaggtgtaggatctcagacttggtggtacgaccgaggacgtcctatttcggttcgtcgtacggtccggggtaccccggggggactacgtcaaccgtactccgtaccgttttaggtcggtctttagggactccgttcggtcgtccgtacctacgttctaaccgtaacgttaccggttaaccctacccgtacgtcgttaccggtaaccgacgaccgtaccggaacccgacggtaccacggtccgtaacccgcnccgaaccgtctacgatacgtaactataacgtaaacgttcgactcgtacttcgggtccggtcctaggtccttcggtacttctaccggtcgttactcctaccgtacgtaaggtaaccgtaacgtccacccgtccctaaccaccggtaacgtaccgggaccgggtacgacgtcagtacgtagngtagtntacgttacgtattacgttcttagtgtcgttacgtcgttaggttcgttagggttcggttcggttttacggtttcgggttaccggtagggggtaccggaaggtacggtacgtaccgtaccgtcccggtaccctaaccggg

SEQ ID NO: 178276 - DNA, 722 bp, Homo sapiens
  misc_feature: GYAE6OF01BTZQU.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtcgtccccaccatgcctggatgatgcttctcctcggactccttgcttatggatcaggtgtggaatctcagactggtggtcgacccaggacgccagtcgttagtcgaggtccgggtcccggggggacagtacacgactcacgttgtggcttggactcgtctggtctacagttccgactaacttcgttaacctacccagtcgtaccggtaacacgaccgaaccgaccccgaggacccacggtccaccgaccgcaaccgtctaccgagtacgtaacgtaacttaaccgaaagtcgtccgtaccttccgttccggtccgggttaccctaggtaccttcgtcgttctcgtacggtccctactacggtccgttaaggaactaacgtcctccgccctacgaccctgtacccggacccgggacctacgcgatacgagtagtacgaagttcgtaacgttatttaacgttagttgtacggttacgtcggttagttacgtttgggtacggggttttcgttggtttttccgttttacgggtcggggttaacccgggaccgggtaaacgggtaccctaagggttcccgttacgggtaccccgtttaccggtaacccg

SEQ ID NO: 178277 - DNA, 514 bp, Homo sapiens
  misc_feature: GYAE6OF02HSEJN.49.24.C02.1.454.CMB.1.raw
  modified_base (234)..(234): a, c, t, g, unknown or other
  misc_feature (234)..(234): n is a, c, g, or t
  modified_base (483)..(483): a, c, t, g, unknown or other
  misc_feature (483)..(483): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcaccatcacggggcccaggcagatgatgaatgtgattatactgtgtgctgtatctgggtggtggtctttttcggngttcggcggagggacaagctgaccgtctacg

SEQ ID NO: 178278 - DNA, 617 bp, Homo sapiens
  misc_feature: GYAE6OF02GR29U.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatagtcgctcttctggggtccctgactcgcttctcgtcgtcctcctcttccgttaggaaacaacgtcgtccgtccctaccacctacgtaccgggacccggggaccgacgggacaagtagtagagtagtaagtggtagttaatttacttacgttgttgtcgtcgttagtacttcgggttggggttgggttcggttttccgttttcggttcgggttccgggtacggggtaccgggtaccgtaacggtccgttaccggtacccgtccgttaacccgg

SEQ ID NO: 178279 - DNA, 519 bp, Homo sapiens
  misc_feature: GYAE6OF02FLX6B.49.24.C02.1.454.CMB.1.raw
  modified_base (234)..(234): a, c, t, g, unknown or other
  misc_feature (234)..(234): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggttactaccccagctggtaccagcagaccccaggccaggctccacgcacgctcatgtacgatacaaatagtcgctcttctgggtccctgatcgcttctctggctccatccttgggaacaaagctgccctcaccatcacggggcccaggcagatgatgaatgtagattattactgtgtgctgtatcgtgggtggtggtctttttcggtgtttcggcggagggaccagctcgaccgtcctacg

SEQ ID NO: 178280 - DNA, 533 bp, Homo sapiens
  misc_feature: GYAE6OF02IX42Q.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgtttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatagtcgctcttctggggtcccctgactcgcttctctggctccatccttggaacaaagctcgccctcaccatccgaccggggcccaggccagatgatgaatgtagtattattactgtgtgctgtatcgtgggtggtggtcttttcggtgttcggcggtaggacctagcgtaggacccgtcctacgtccg

SEQ ID NO: 178281 - DNA, 538 bp, Homo sapiens
  misc_feature: GYAE6OF02IKI8I.49.24.C02.1.454.CMB.1.raw
  modified_base (445)..(445): a, c, t, g, unknown or other
  misc_feature (445)..(445): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcacgaccccaggccaggctccacgcacgctcatgtacatacaaatagtcgctcttctggggtccctgactcgcttctctggctccatccttgggaacaagctgccctcaccatccgaccggggcccaggcagatgatgaatgtntattattactgtgtgcttgtatcgtgggtggttggtcgtttttcggtggtttcggacgggtagggtaccgaggtcgtcgtacccgtcctacgg

SEQ ID NO: 178282 - DNA, 517 bp, Homo sapiens
  misc_feature: GYAE6OF02I9T12.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactacaccagctggtaccagcagaccccaggccaggctccacgcacgctcatgtacgatacaaatagtcgctcttctggggtccctgatcgcttctctggctccatccttgggaacaaagctgccctcaccatcacggggcccaggcagatgatgaatgtgattattactgtgtgctgtatctgggtggtggtcttttggtgtttcggcggtagggacccaaggctgacccgtccg

SEQ ID NO: 178283 - DNA, 568 bp, Homo sapiens
  misc_feature: GYAE6OF02HKGGT.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacaggtcacactcacttgtggcttgagctctggctcagtctcaactggttacctaccccagctggtaccagcagaccccaggccaggctccacgcacgctcatgtacgatacaaatagtcgctcttctcggggtccctgatcgtcttctctggcctcactccttgggaacaagctcgccctcaccatccgacggggcccaggcagatgatgaatgtagtattattactgttgtgtctgttagtcgttgggttgggttggttctttttcgggtggtttcggggtcgggtacggggtaccgtaaggtccgttacggtacccggttccgttaaccgg

SEQ ID NO: 178284 - DNA, 569 bp, Homo sapiens
  misc_feature: GYAE6OF02ICX6L.49.24.C02.1.454.CMB.1.raw
tcagagtcgagagacacgaccggtgctcgatttagtacagatcgttagggaaaggggaaaaggccctgaggaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggacagtcacactcacttgtggcttgagctctggctcagtctcaactggttaacctaccccagctcggtaccagcacgacccccaggcccaggcctccacgcacgctcatgtacgatacaaatagtcgtctcttcgtcggggttcccctggactccgtctttcctcgtcgggtcctcccattcccgttagggaaacaaagctcgccctcaccatcgaccggggcccaggcagatgatgaatgtagattattactgttgtgtctgtatgtgggttggttggttctttttggtcggttacggcgggtacgggaccgtaaggcgtacggtacccgtcctacgg

SEQ ID NO: 178285 - DNA, 517 bp, Homo sapiens
  misc_feature: GYAE6OF02F72VZ.49.24.C02.1.454.CMB.1.raw
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (491)..(491): a, c, t, g, unknown or other
  misc_feature (491)..(491): n is a, c, g, or t
tcagagtcgagagacacgaccggtgctcgatttagtacagatcgttagggaaaggggaaaagggccctgaggaaaacaaaccccagctgggaagccgtgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactgtactaccccagctcggtaccagcagaccccaggccaggcctccacgcacgctcatgtacgatacaaatagtcgctcttctgggtccctgatcgcttctctggctccatcctgggaacaagctgccctcaccactcgacggggccaggcagatgatgaatgtgtattattatgtgtgntgtatcgngggtggtggtcttttcggtgttcggnggaggcgagcgtcgacccgtcgtacg

SEQ ID NO: 178286 - DNA, 525 bp, Homo sapiens
  misc_feature: GYAE6OF02I9UCH.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcaccatccgacggggcccaggcagatgatgaatgtgattattactgtgtgctgtatcgtgggtggtggtctttttcggtgttcggcggtacgggaccagctcggtaccgtcctacg

SEQ ID NO: 178287 - DNA, 550 bp, Homo sapiens
  misc_feature: GYAE6OF02GDGMJ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttcgtcggggtccctgactcgcttctctggctccactccttgggaacaaagctcgccctcaccatccgaccggggcccaggcagatgatgaatgtagtattattactgtgtgcttgtatcgtgggtggttggttcgtttttcggtggtttcgggcgggtacgggtaccgaaggtcgtcggtaccgtccttaccgg

SEQ ID NO: 178288 - DNA, 534 bp, Homo sapiens
  misc_feature: GYAE6OF02IID49.49.24.C02.1.454.CMB.1.raw
  modified_base (507)..(507): a, c, t, g, unknown or other
  misc_feature (507)..(507): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagccagaccccaggccaggctccacgcacgctcatgtacgatacaaatagtcgctcttctggggtccctgatcgctttctctggcctccatccgttagggaaacaaagctcgccctcaccactcgacgggggcccaggcagatgatgaatgtgtattattactgttgtgtctgtatcgtgggtggtggttctttttcggtgttcggnggagggaccagctgacccgtcgtaccg

SEQ ID NO: 178289 - DNA, 939 bp, Homo sapiens
  misc_feature: GYAE6OF02G045R.49.24.C02.1.454.CMB.1.raw
tcagagtcgagagacacgaccggtgctcgatttagtacagatcgttagggaaaggggaaaaggccctgaggaaaacaaaccccagctgggaagcctggagaacacgtagccttcatgagtcgtccccacagtcggcctggatgatgcttctccgtcggaccttccttgtcttagtggatcgaggtgtaggaatctcagacgtggtggtcgaccgaggacgccagttcgttgtcgaggtccggggtccccggggggatacggtaccaacctactcctacgtttggtcggtcgttggacgtccttcgtggtccttcgtacggttcctaccgtaaacgttcggtttaacccctaaccccgagtcgtacgggtaaccagaccaaccggaccccgacggcccgaacggtcctacccgaccgccgaaccgtcctacacgttacggtaaccgtaataaacgtaaaaagttacggtccggtacctttccgtttaccggggttccggggtttccctaggtaacgtttcccggttccttttccgttccgttcgggtcccctttacccgtacgtttaccccggtttaacggggtaaaaaccgtaaacgggtcccgttaccgtacccccgttaacccgaacccgttaaccggttaccccgggggaaccccggggggtacccccgaacggggtaccgaaacgggtaagttacggtaacgttaacggtaaacgtttagggttagttaaacgttttaaacgttttaccggttaggtttacggttcgttaccgtttagttaccggttttcgggttagggggtttcgggttttcgggtttttcccggtttttttcggggttaccggggtttccgggggtacccggggttaacggggtaacccgtaaagggttcccgggtttaacccggttaccccgggttacccgttaaacccggg

SEQ ID NO: 178290 - DNA, 542 bp, Homo sapiens
  misc_feature: GYAE6OF02GKSY7.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttacctaccccagctggtaccagcacgaccccaggccaggcctccacgcacgctcatgtacataacaaatagtcgctcttcgtcgggtccctgactcgtcttctctggctccatcctgggaaacaagctcgccctcaccatccgacggggcccaggcagatgatgaatgtgtatttattactgtgtgctgtatcgtgggtggtggttcttttcggtggttcggacggacgggaccaggtcgtcggtacccgtccgtaccgg

SEQ ID NO: 178291 - DNA, 517 bp, Homo sapiens
  misc_feature: GYAE6OF02I8YLS.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggcctccacgcacgctcatgtacgatacaaatagtcgctcttctgggtccctgatcgcttctctggctccatcctgggaacaaagctcgccctcaccatccgaccggggcccaggcagatgatgaatgtgtattattactgtgtgctgtatcgtgggtggtggttcgttttgtgttcggcggaggcagctgaccgtctacg

SEQ ID NO: 178292 - DNA, 570 bp, Homo sapiens
  misc_feature: GYAE6OF02JZ2DE.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagtcctggtaccagccacgacccccaggcccaggcctccacgccacgctcatcgtacgatacaaatagtccgctcttcgtcgggtcctgactcgtcttctctcgctcctacgtcctgggaacaacgctcgccctcaccactccgacgggtcccgacggcgacgatgatagagtgtagtattattacttgttgtgcgtgtagtcgtgggttggttggttcgttttcggttcggttcggtcgggtacggtaccggaacgtcggtcgtaccggtcccgtaccgg

SEQ ID NO: 178293 - DNA, 609 bp, Homo sapiens
  misc_feature: GYAE6OF02HILRM.49.24.C02.1.454.CMB.1.raw
  modified_base (568)..(568): a, c, t, g, unknown or other
  misc_feature (568)..(568): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactggtggtcgacccagggacgccagttcgttgtcaggttcgggtccccgggggggacaggtccacactctactttggtggtcttggagtccttcgtggcctcgagttcctacaacgttcggttaaccctaccccagccgtcggtacccagcaccgaccccgacggccaggcctaccacgccacgctcagtcgtacgataacaaattagtccgtcttcttcgtcgggtccctgactcgtcttctcgtcggcctctactccgttagggaaactaagctcgcctcaccactcggaccggggcccaggcagatgatagatgtagtattagttacttgtgtgcttgtagtcgtgggttggttggttcgtttttggtcggttcggngggtacgggaccgacggtcgttacggacccgttccgtacgg

SEQ ID NO: 178294 - DNA, 533 bp, Homo sapiens
  misc_feature: GYAE6OF02GUYF1.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatcctgggaacaaagctgccctcaccatccgaccgggggcccaggcagatgatgaatgtgattattactgtgtgctgtatcgtgggtggttggtctttttcggtggtttcggcgggtacgggaccaggcctggtacccgtcctacgg

SEQ ID NO: 178295 - DNA, 555 bp, Homo sapiens
  misc_feature: GYAE6OF02INW09.49.24.C02.1.454.CMB.1.raw
  modified_base (443)..(443): a, c, t, g, unknown or other
  misc_feature (443)..(443): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacaggtcacactcacttgtggcttgagctctggctcagtctcaactggttacctaccccagctggtaccagcacgaccccaggccaggctccacgcacgctcatgtacgatacaaatgtcgctcttctgggtccctgatcgcttctctcggctccatcccgttagggaacaaagctcgccctcaccatcgacgggcccaggcagatgangaatgtgtattattactgtgtgtctgtatcgtgggttggtgggttcgtttttcggtcggtttcgggacgggtacgggaccgtaaggtccgtcggtaccccggtccgtaccgg

SEQ ID NO: 178296 - DNA, 531 bp, Homo sapiens
  misc_feature: GYAE6OF02FTZY5.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctgggtccctgatcgcttctctggctccatccttggaacaaagctgccctcaccatcgacggggcccaggcagatgatgaatgtgattattactgtgtgctgtatcgtgggtggttggtcgtttttcgtggtttcggcgggtagggaccgaaggcgtcgacccgttcctaccgg

SEQ ID NO: 178297 - DNA, 550 bp, Homo sapiens
  misc_feature: GYAE6OF02HGI1E.49.24.C02.1.454.CMB.1.raw
  modified_base (236)..(236): a, c, t, g, unknown or other
  misc_feature (236)..(236): n is a, c, g, or t
  modified_base (440)..(440): a, c, t, g, unknown or other
  misc_feature (440)..(440): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggganagtcacactcacttgtggcttgagctctggctcagtctcaactggttacctaccccagctggtaccagcacgaccccaggccaggcctccacgcacgctcatgtacgatacaaatagtcgctcttcgtgggtccctgatcgcttctctgctccatccttgggaacaaagctcgccctcaccactcgaccggggcccaggcagangatgaatgtagtattattactgttgtgtcgtgtatcgtgggtggttgggttcgttttcggtggttcgggcgggtacgggaccgaggtccgtcggtacccgtccgtaccgg

SEQ ID NO: 178298 - DNA, 588 bp, Homo sapiens
  misc_feature: GYAE6OF02HQX5W.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacaggtcacactcacttgtggcttgagctctggctcagtctcaactggttacctaccccagctggtaccagccacgaccccaggccaggcctccacgcaccgctcatgtacgaataacaaatgtacgctcttcgtcgggtccctgactcgtcttctctggcctccattccgttagggaaacaagctcgccctcaccacgtccgaccggggcccaggcagatgatgaatgtagtattattacttgtgtgcttgtattcgtgggttgggttcggtttcgttttttcggtcgggtttccgggacggggtacggggaaccgtaaggtccggtacggtacccggttcccgttaaccgg

SEQ ID NO: 178299 - DNA, 518 bp, Homo sapiens
  misc_feature: GYAE6OF02IVIJG.49.24.C02.1.454.CMB.1.raw
  modified_base (235)..(235): a, c, t, g, unknown or other
  misc_feature (235)..(235): n is a, c, g, or t
  modified_base (408)..(408): a, c, t, g, unknown or other
  misc_feature (408)..(408): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttactaccccagctggtaccagcagaccccaggccaggctccacgcacgctcatgtacgatacaaatagtcgctcttctgggtccctgactcgcttctctggctccatccttggaacaagctgccctnaccatccgacggggcccaggcagatgatgaatgtgtattattacttgtgtgctgtatcgtgggtggtggtctttttgngtttcggnggaggccaaggctgaccgtctacg

SEQ ID NO: 178300 - DNA, 570 bp, Homo sapiens
  misc_feature: GYAE6OF02I1WXH.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccggggggacagtcacactcacttgtggcttgagctctggctcagtctcaactggttacctaccccagctggtaccagcacgaccccaggcccaggcctccacgcacgctcatgtacgatacaaatgtcgctcttcgtgggtccctgactcgcttctctcggctccactcctaggaacaacgctcgccctcaccactccgaccggggcccaggcagatgagtgaatgtagattattacgtgttgtgtcgtgttattcgttgggttggttgggttcgtttttcgggttcggtttcgggacgggtacgggtaccgtaaggtccgttacggtaccccggttccgtaccgg

SEQ ID NO: 178301 - DNA, 519 bp, Homo sapiens
  misc_feature: GYAE6OF02GT7LT.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacaggtcacactcacttgtggcttgagctctggctcagtctcaactggttactaccccagctggtaccagcagaccccaggccaggcctccacgcacgctcatgtacgatacaaatagtcgctcttcgtggggtccctgactcgcttctctcggctccatccgtggaacaagctgccctcaccactcgaccggggcccaggcagatgatgaatgtgtattatactgtgtgctgtatcgtgggtggtggtcttttggtgttcggcggaggacagctgaccgtctacg

SEQ ID NO: 178302 - DNA, 558 bp, Homo sapiens
  misc_feature: GYAE6OF02GRT40.49.24.C02.1.454.CMB.1.raw
  modified_base (356)..(356): a, c, t, g, unknown or other
  misc_feature (356)..(356): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggacagtcacactcacttgtggcttgagctctggctcagtctcaactggttacctaccccagctggtaccagcacgaccccaggccaggcctccacgcacgctcatgtacgataacaaatagtcncttcttcgtcgggtccctgactcgcttctctcggctccactccgtagggaacaaagctcgccctcaccactccgaccggggcccaggcagatgatgaatgtagtattattactgtgtgcttgtattcgtggggttggttggttcgtttttcggtggttcgggcggtacgggacctaggtccgtacggtacccgtcctaccgg

SEQ ID NO: 178303 - DNA, 556 bp, Homo sapiens
  misc_feature: GYAE6OF02H908X.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggggacagtcacactcacttgtggcttgagctctggctcagtctcaactggttactaccccagctggtaccagcagaccccaggccaggctccacgcacgctcatgtacgatacaaatagtcgctcttcgtggggtccctgactccgctttcctctgggtcctcctactccctttagggaaaccaaagctcgccctcaccatcgaccggggcccaggcagatgatgaatgtgtattattactgtgtgcttgtattcgtggggttggtggttctttttcggtggtttcgggcgggtagggaccaggtccgtcggtacccgttctaccgg

SEQ ID NO: 178304 - DNA, 550 bp, Homo sapiens
  misc_feature: GYAE6OF02FNWW2.49.24.C02.1.454.CMB.1.raw
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
  modified_base (473)..(473): a, c, t, g, unknown or other
  misc_feature (473)..(473): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcacgacccccaggccaggcctccacgcacgctcatgtacgataacaaatagtcgctcttctcggggtccctgatcgcttcnctggctccatcctgggaacaagctcnccctcaccatccgaccgggggcccacgggcagatgatgtaatggtagtattattactgtgtgntgtatgtgggtggttggttctttttcggtgtttcgggcgggtacgggaccgtaaggcctcggtacccgttcctacgg

SEQ ID NO: 178305 - DNA, 552 bp, Homo sapiens
  misc_feature: GYAE6OF02IRN1R.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctgtaccagcacgaccccaggccaggcctccacgcacgctcatgtacgaatacaaatagtcgctccttcgtcggggtccctgtatcgcttctctggctccatccttagggaacaaagctcgccctcacccagtccgaccggggcccaggccgagatgatgaatgtagattatatgtgtgtctgtatcgtgggtggttggttcttttcggtcggtttcggcgggtagggaccaaggtcctacggtacccgttccgtaccgg

SEQ ID NO: 178306 - DNA, 532 bp, Homo sapiens
  misc_feature: GYAE6OF02F2U2A.49.24.C02.1.454.CMB.1.raw
  modified_base (500)..(500): a, c, t, g, unknown or other
  misc_feature (500)..(500): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcagaccccaggccaggcctccacgcacgctcatgtacgatacaaatagtcgctcttcgtgggtccctgatcgcttctctggctccatcctgggaacaagctcgccctcaccatccgacgggggcccaggcagatgatgaatgtgatttattactgtgtgtctgtatcgtgggtggttggtcttttcggtggttcggnggtaggaccaaggctacggtaccgttctacgg

SEQ ID NO: 178307 - DNA, 558 bp, Homo sapiens
  misc_feature: GYAE6OF02GBYXO.49.24.C02.1.454.CMB.1.raw
  modified_base (472)..(472): a, c, t, g, unknown or other
  misc_feature (472)..(472): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgcttcttctcggggtccctgactcgcttctctggctccactcctagggaacaaagctcgccctcaccactccgaccggggcccaggcagatgatgaatgtgtattattacgttgttgtgtnttgtatgtgggtggttcggttctttttcggtggttcgggtacgggtacgggtaccgaacggtccgtcggtacccgtccgttaccgg

SEQ ID NO: 178308 - DNA, 541 bp, Homo sapiens
  misc_feature: GYAE6OF02GWQ9K.49.24.C02.1.454.CMB.1.raw
  modified_base (233)..(233): a, c, t, g, unknown or other
  misc_feature (233)..(233): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggttactaccccagctggtaccagcagaccccaggccaggctccacgcacgctcatgtacgatacaaatagtcgctcttctggggtccctgactcgcttctctcgctcatccttgggaacaaagctcgccctcaccatccgacggggcccaggcagatgatgaatgtgtattattactgttgtgtctgtatcgtgggtggttggttctttttcggtggtttcggcgggtacgggaccgtaaggcgtcggtaccgttccctaccgg

SEQ ID NO: 178309 - DNA, 554 bp, Homo sapiens
  misc_feature: GYAE6OF02JDP3A.49.24.C02.1.454.CMB.1.raw
  modified_base (379)..(379): a, c, t, g, unknown or other
  misc_feature (379)..(379): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatcgtacgatacaaatagtcgctcttctggggtccctgactcgcttcnctggctccatccttgggaacaaagctcgccctcaccactcgaccggggcccaggcagatgatgaatgtagtattattacgtgttgtgctgtatcgtgggtggttggttctttttcggtcggttcgggtacgggtacgggtaaccgaaggtcgtacggtacccgttccgttaccgg

SEQ ID NO: 178310 - DNA, 558 bp, Homo sapiens
  misc_feature: GYAE6OF02IAVLS.49.24.C02.1.454.CMB.1.raw
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctctggctcagtctcaactggttactaccccagcctggtaccagcagaccccaggccaggcctccacgcacgctcatgtacgataacaaaatgtcgctcttctggggtccctgatcgctttctctggcctccatcctgggaaacaaagctgccctcaccntcgaccggggcccaggcagangatgaatgtntattattacttgtgtgcttgtattcgtggggttggtgggttcgtttttcggtggtttcgggcgggtacgggaccgtaaggtcgtacggtacccgttccgttaccgg

SEQ ID NO: 178311 - DNA, 555 bp, Homo sapiens
  misc_feature: GYAE6OF02JYAME.49.24.C02.1.454.CMB.1.raw
  modified_base (459)..(459): a, c, t, g, unknown or other
  misc_feature (459)..(459): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggggacagtcacactcacttgtggcttgagctctggctcagtctcaactggttacctaccccagctggtaccagcacgaccccacggccaggcctccacgcacgctcatgtacataacaaatgtacgctcttctgggtccctgatcgtcttctctcggctccatcctaggaacaaacgctcgccctcaccacgtccgaccggggcccacggcagatgactagaatgtntattattactgtgtgctgtagtcgtgggtggtcggttcgttttcggtggttccggcgggtacgggaccgtaggtcgtacggtacccgtccgtaccg

SEQ ID NO: 178312 - DNA, 534 bp, Homo sapiens
  misc_feature: GYAE6OF02GDYU0.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttactaccccagctggtaccagcagaccccaggccaggctccacgcacgctcatgtacgatacaaatagtcgctcttcgtggggtccctgatcgcttctctggctcatcctggaacaagctgccctcaccactcgacggggcccaggcagatgatgaatgtagtattattactgtgtgtctgtatcgtgggtggttggtcttttcggtgttcgggcggtacgggaccgaaggtctcggtacccgtccgtaccgg

SEQ ID NO: 178313 - DNA, 541 bp, Homo sapiens
  misc_feature: GYAE6OF02F705J.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacaggtcacactcacttgtggcttgagctctggctcagtctcaactggttactaccccagctggtaccagcagaccccaggccaggctccacgcacgctcatgtacgatacaaatagtcgctcttctggggtccctgatcgcttctctgctccatcctgggaacaaagctcgccctcaccatcgacggggcccaggcagatgatgaatgtgtattattacgtgtgtgcgttgtagtcgtggggtggttggttctttttggtcggtttcgggcgggtagggaccaggtcgtcggacccgttcgtaccgg

SEQ ID NO: 178314 - DNA, 525 bp, Homo sapiens
  misc_feature: GYAE6OF02GJDGE.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcacccatccgacggggcccaggccagatgatgaatgtgtattattactgtgtgctgtatcgtgggtggtggtctttttcggtgttcggcggagggacaaggctcgaccgtcctacg

SEQ ID NO: 178315 - DNA, 654 bp, Homo sapiens
  misc_feature: GYAE6OF02GZLN6.49.24.C02.1.454.CMB.1.raw
  modified_base (236)..(236): a, c, t, g, unknown or other
  misc_feature (236)..(236): n is a, c, g, or t
tcagagtcgagagacacgaccggtgctcgatttagtacagatcgttagggaaaggggaaaagggccctgaggaaaacaaacccagctgggaagcctgagaacacgtagcccttcatgagtgtccccgaccatggcctggatgatgcttctcctcggactccttgcttatggatcaggtgtggaatctcagactgtggtgacccaggagccatcgttgtcagtgtcccggggggacngtcgacactcacttgtggcttgagtctctggctcagtctcaacgtggttacctaccccagcctaggtacccagcacgaccccaggccaggcctccacgcacgctcatgtacgatacaaatgtcgcttcttcgtcgggtccctgtactccgtccttccgtcgtcgtcctactacgttacggtaacgaaacgaacgtccgtacccgtccctaccgaacctaccgtaccgggacccggtaccgacgacgagtacgtagtagttaagtagtggtaagttactttaacgttacgtagttacgtacgttacgttagttccggttagggttgggttacggtttcggttttcggttttacgggtcgggttaccgggtacggtaccggtacggtaccgtccgtaccggttcccgttacgtaacccgg

SEQ ID NO: 178316 - DNA, 549 bp, Homo sapiens
  misc_feature: GYAE6OF02GUB43.49.24.C02.1.454.CMB.1.raw
  modified_base (355)..(355): a, c, t, g, unknown or other
  misc_feature (355)..(355): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttactacccccagctggtaccagcacgaccccaggccaggcctccacgcacgctcatgtacgatacaaatgtcnctcttcgtcgggtcctgatcgcttctctgctccatccgtaggaacaagctcgccctcaccactcgaccggggcccaggcagatgatgatgtgtattattatgtgtgctgtatcgtgggttggttggttcgtttttcgggtcggtttcgggcgggtacgggtaccgaaggtccgtacggtacccgtccgtaccgg

SEQ ID NO: 178317 - DNA, 526 bp, Homo sapiens
  misc_feature: GYAE6OF02HKC7R.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggacaggtcacactcacttgtggcttgagctctggctcagtctcaactggttactaccccagctggtaccagcagaccccaggccaggctccacgcacgctcatgtacgatacaaatgtcgctcttcgtgggtcctgatcgcttctctgctcatccttggaacaagctgcctcaccatccgacggggcccaggcagatgatgaatgtagtatttattactgtgtgcttgtatcgtgggttggtggtctttttcggtgttcgggcggacgggaccaagtctacggaccgtctacgg

SEQ ID NO: 178318 - DNA, 541 bp, Homo sapiens
  misc_feature: GYAE6OF02HVD0G.49.24.C02.1.454.CMB.1.raw
  modified_base (235)..(235): a, c, t, g, unknown or other
  misc_feature (235)..(235): n is a, c, g, or t
  modified_base (511)..(511): a, c, t, g, unknown or other
  misc_feature (511)..(511): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttacctaccccagcctggtaccagcagaccccaggccaggcctccacgcacgctcatgtacgataacaaatagtcgctcttcgtcggggtccctgatcgcttctctggcctccatccgtaggaacaaagctgccctcaccatccgacggggcccaggcacgatgatgtaatgtagtaatttattacttgttgtgcttgtatcgttggtgggtggttcttttggtgttcggnggtacgggacagtcgtcgtccgtctaccgg

SEQ ID NO: 178319 - DNA, 559 bp, Homo sapiens
  misc_feature: GYAE6OF02H1478.49.24.C02.1.454.CMB.1.raw
  modified_base (358)..(358): a, c, t, g, unknown or other
  misc_feature (358)..(358): n is a, c, g, or t
  modified_base (475)..(475): a, c, t, g, unknown or other
  misc_feature (475)..(475): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacaggtcacactcacttgtggcttgagctctggctcagtctcaactggttacctaccccagctggtaccagccagacccccagggccaggctccacgcacgctcatgtacgatacaaatacgtcnctcttcgtgggtccctgactcgtcttctctggtctccattcctagggaacaaagctcgccctcaccactccgaccggggcccaggcagatgatagaatgtagtattattactgtgtncttgtattcgtgggtggtggttctttttcggtggtttcggcgggtacgggaccgtaggtccgtacgtacccgttcgtaacccgg

SEQ ID NO: 178320 - DNA, 548 bp, Homo sapiens
  misc_feature: GYAE6OF02GNZZT.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggcctccacgcacgctcatgtacgatacaaatagtcgctcttcgtcggggtccctgactcgcttctctcggctccatccttgggaacaaagctcgccctcaccactcgaccggggcccaggcagatgatgatgtagtattattactgtgtgctgtatgttgggtggttggttctttttcggtggttcgggcgggtacgggacctaaggtcgtacgtacccgtccgtaccgg

SEQ ID NO: 178321 - DNA, 553 bp, Homo sapiens
  misc_feature: GYAE6OF02FV48K.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggctccacgcacgctcatgtacgatacaaatagtcgctcttcgtgggtccctgatcgcttctctggctccatctggaacaagctcgccctcaccactcgaccggggcccaggcagagtgatgaatgtagtattattacttgtgtgtcttgtatcgtgggtgggttggttcgtttttcggtggtttcgggcgggtacggggtaccgtaacggtccgtcggtacccgttccgtaccgg

SEQ ID NO: 178322 - DNA, 554 bp, Homo sapiens
  misc_feature: GYAE6OF02JLZ6M.49.24.C02.1.454.CMB.1.raw
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttacctaccccagctggtaccagcacgaccccaggccaggcctccacgccacgctcatgtacgatacaaatgtcnctcttctcgggtccctgatcgnttctctgctcatccttggaacaaacgctcgccctcacccatccgaccgggggcccacgggcacgatgatagaatgtagtattagttactgttgtgtcgttgtactggttggttagggttggttcgttttggttcgttcggtacggacgggtaccaagtcgtagtacccgtccgtacgg

SEQ ID NO: 178323 - DNA, 575 bp, Homo sapiens
  misc_feature: GYAE6OF02I5CWH.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttacctaccccagctggtaccagcacgaccccaggccaggctccacgcacgctcatgtacgatacaaatagtcgctcttcgtcgggtccctgactcgcttctctcggctccatccgttagggaacaagctcgccctcacctacgtccgaccggggcccaggcagatgatgaatgtagtattattacgttgtgtgtcgttgtattcgttggggttgggttcggttcgtttttcggtcggtttcgggacggggtacgggtaccgtaaggtccgtacggtacccgttcccgtaccgg

SEQ ID NO: 178324 - DNA, 568 bp, Homo sapiens
  misc_feature: GYAE6OF02GMZ5S.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaacttggttacctaccccagctcggtaccagcacgaccccaggccaggcctccacgcacgctcatgtacgataacaaatagtcgctcttcgtcggggtccctgactcgtcttctcgtggcctccactccgttaggaacaagctcgccctcaccacgtccgaccggggcccaggcagatgatgaatgtagtatttattacttgttgtgtctgtatcgtgggtggttggttcgtttttcggtggttcgggtacgggtacgggtaccgaaggtcgtacggtacccgtccgtaccgg

SEQ ID NO: 178325 - DNA, 524 bp, Homo sapiens
  misc_feature: GYAE6OF02HCLGB.49.24.C02.1.454.CMB.1.raw
  modified_base (496)..(496): a, c, t, g, unknown or other
  misc_feature (496)..(496): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctcgccctcaccatccgacggggcccagggcagatgatgaatgtagattattactgtgtgctgtatcgtgggtggtggtcttttcgtgttcggnggtaggacaggctcggtaccgtctacgg

SEQ ID NO: 178326 - DNA, 562 bp, Homo sapiens
  misc_feature: GYAE6OF02H2V12.49.24.C02.1.454.CMB.1.raw
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
  modified_base (463)..(463): a, c, t, g, unknown or other
  misc_feature (463)..(463): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggganaggtcacactcacttgtggcttgagctcttggctcagtctcaactggttacctaccccagctggtaccngcacgaccccaggccaggcctccacgcacgctcatgtacgataacaaatagtcgactcttcgtggggtccctggactcgtcttctctcgggcctcctattccttgggaaaccaaacgctcgccctacacccacgtccgaccgggggcccagggcagangatgaatgtagatttattctgtgtgctgtatcgtgggttggtgttcgttttcggtcgttcgggcgggacgggacaggtccgtagtcccgttcctaccgg

SEQ ID NO: 178327 - DNA, 561 bp, Homo sapiens
  misc_feature: GYAE6OF02HZ86A.49.24.C02.1.454.CMB.1.raw
  modified_base (237)..(237): a, c, t, g, unknown or other
  misc_feature (237)..(237): n is a, c, g, or t
  modified_base (482)..(482): a, c, t, g, unknown or other
  misc_feature (482)..(482): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttgtggcttgagctctggctcagtctcaactggttactaccccagctggtaccagcacgaccccaggccaggcctccacgcacgctcatcgacgataacaaatagtcgctcttcgtgggtccctgactcgctttctctacggctcctatccgttagggaacaaagtcctcgcctacaccacgtcggaccggggtccaggcagatgatagaatgtgtaattattacgttgtgtncttgtagtcgtgggttcggtggttcgttttggtcggttcggcggtagggacctaggtccgtacgtaccgtccgtaccgg

SEQ ID NO: 178328 - DNA, 523 bp, Homo sapiens
  misc_feature: GYAE6OF02HZU42.49.24.C02.1.454.CMB.1.raw
  modified_base (233)..(233): a, c, t, g, unknown or other
  misc_feature (233)..(233): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggganagtcacactcacttgtggcttgagctctggctcagtctcaactggttactaccccagctggtaccagcagaccccaggccaggctccacgcacgctcatgtacatacaaatgtcgctcttcgtggggtccctgatcgcttctctggcctccatccttgggaacaagctgcctcaccatccgaacggggcccaggccagatgatgaaatgtgattatactgtgtgctgtatcgtgggtggtggttctttttcgtggttcggcggagggaccaaggcctgtaccgtcgtacg

SEQ ID NO: 178329 - DNA, 547 bp, Homo sapiens
  misc_feature: GYAE6OF02HEL3F.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctgggtccctgatcgcttctctggctccatccttagggaacaaagtctgccctcaccatcgaccggggcccaggcagatgatgaatgtgtattattacttgtgtgctgtatcgtgggtggttggttctttttcggtggtttcgggtcgggtagggtaccgtaacggtcgtacggtacccgtccgtaccgg

SEQ ID NO: 178330 - DNA, 543 bp, Homo sapiens
  misc_feature: GYAE6OF02GAQ91.49.24.C02.1.454.CMB.1.raw
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctcgggtccctgatcgcttctctcggctccatccgtaggaacaaagctcgccctcaccactccgaccggggcccaggcagatgatgatgtntattattactgtntgtntgtatcgtgggtggtggttctttttcggtggtttcggngggtacgggtaccgaaggtcgtcggtaccgtccgtaaccg

SEQ ID NO: 178331 - DNA, 565 bp, Homo sapiens
  misc_feature: GYAE6OF02IQJJV.49.24.C02.1.454.CMB.1.raw
  modified_base (354)..(354): a, c, t, g, unknown or other
  misc_feature (354)..(354): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtcccgggggggacagtcacactcacttgtggcttgagctctggctcagtctcaactggttacctaccccagctggtaccagcacgaccccaggccaggcctccacgcacgctcatgtacatacaaatagtcnctcttcgtggggtccctgactcgcttctctcggctccattcccgttagggaaacaagtcctcgcccctacaccacgtccgaccggggcccaggccagactgatagatgtagtattattactgttgtgtcttgtattcgttggggttggttggttcgttttggtcggttcgggcgggtagggaccgaggtccgtcggtacccgtccgtacgg

SEQ ID NO: 178332 - DNA, 833 bp, Homo sapiens
  misc_feature: GYAE6OF02I4Y47.49.24.C02.1.454.CMB.1.raw
tcagagtcgagagacacgaccggtgctcgatttagtacagatcgttagggaaaggggaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccggggggacagtcacactcacttgtggcttgagctctggcctcagtcctacgaacttcggttacctaccccgagtccgtcggtaaccagcaaccgaccccgacggccgaggcctacccgaccggccaaccggcctacacgttacgtaaccgaataaacaaaatacgtaccgtcttctttacggttcggggtccctagtacgttccgtcctttctccgttcgggtacctaccctacgttacccggtttaacgggaaactaaaacccggtctacccggtacccctacgtaaacccgtacccgtaaccgggaaccccggggggtaccccgaaccggggaacccgtaaacgggtaacgttacgggtaaccgttaacgggtaaacgttacggttaccgttaaagttttaaacgttttaccggtttaggtttcggttaccggttacgttacggttttaacggtttccgggttttagggggtttacgggttttccggggttttaccggttttttttcgggttaccgggtttcccgggggttaacgggggtaaaccgggttaacccggtaacgggtacccggttacccgggttaccccggtttaccggtttaaccccgg

SEQ ID NO: 178333 - DNA, 544 bp, Homo sapiens
  misc_feature: GYAE6OF02IFF5C.49.24.C02.1.454.CMB.1.raw
  modified_base (235)..(235): a, c, t, g, unknown or other
  misc_feature (235)..(235): n is a, c, g, or t
  modified_base (413)..(413): a, c, t, g, unknown or other
  misc_feature (413)..(413): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttactaccccagctggtaccagcacgaccccaggccaggctccacgcacgctcatgtacgatacaaatgtcgctcttctgggtccctgatcgcttctctggctccatccttaggaacaaagctgccctcaccntcgacggggcccaggcagatgatgaatgtagatttattactgtgtgctgtatcgtgggtggtcggttctttttcggtgtttccgggcggtacggggtaccgtaaggtccgtagtacccgtaccgttaccgg

SEQ ID NO: 178334 - DNA, 536 bp, Homo sapiens
  misc_feature: GYAE6OF02HU37W.49.24.C02.1.454.CMB.1.raw
  modified_base (237)..(237): a, c, t, g, unknown or other
  misc_feature (237)..(237): n is a, c, g, or t
  modified_base (471)..(471): a, c, t, g, unknown or other
  misc_feature (471)..(471): n is a, c, g, or t
  modified_base (508)..(508): a, c, t, g, unknown or other
  misc_feature (508)..(508): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggganaggtcacactcacttgtggcttgagctctggctcagtctcaactggttactaccccagctggtaccagcacgaccccaggccagggcctccacgcacgctcatgtacgataacaaaatgtacgctcttctggggtccctgatcgcttctctggcctcatccgttagggaaacaaagctgccctcaccatcgaccggggcccaggcagatgatgaatgtgattattactgtgtgntgtattgtgggtggtgggttcttttcggtggttcggngggaggacctaggctcggccgtctaccg

SEQ ID NO: 178335 - DNA, 533 bp, Homo sapiens
  misc_feature: GYAE6OF02H73RU.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcagaccccaggccaggctccacgcacgctcatgtacgatacaaatgtcgctcttctggggtccctgatcgcttctctggctccatccttgggaacaaagctgccctcaccatcgaccggggcccaggcagatgatgaatgtgtattattacttgtgtgtctgtattcgtgggtggttggttcgtttttcggtggttcggcgggaggaccaaggctcgtacccgtctaccg

SEQ ID NO: 178336 - DNA, 843 bp, Homo sapiens
  misc_feature: GYAE6OF02JNXVG.49.24.C02.1.454.CMB.1.raw
  modified_base (236)..(236): a, c, t, g, unknown or other
  misc_feature (236)..(236): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcgtccccggggggacngtcacactcacttgtgcttgagctctggctcagtctcaactcggttaactaccccagtctggtaaccagccacgaccccaggcccaggcctaccgacggcccacgtccgtacacgttcggtaccgaataacaaaaacgtcgtaccgtcttcctttcgtccggggttaccctggtaaccttccggtcctttaccgtccgttgggtacccttcccgtaacgtttccccggttttaaggggaaacccttaaaaacgggtccctttaccgggtacccccttacccgtaaacccctaaccggttaccccggggtaaccccgggggggtaaccccccgtaacgggggaccaaacgggtaacgtaggtaacgttaacggtaaagttacggttaacgttaagttttaaccgttttaacgttcgggtttcggttacggtacggttttacgtttaacgtttccgggttttaaggggggtttcgggttttacggggttttcccggtttttttacgggtttcggggtttcccgggggttacggggttaaaccgggggttacccgtaaacggggttcccggtttaacgggttaccccggtttacccggtttaaccccggg

SEQ ID NO: 178337 - DNA, 582 bp, Homo sapiens
  misc_feature: GYAE6OF02H0TL8.49.24.C02.1.454.CMB.1.raw
  modified_base (359)..(359): a, c, t, g, unknown or other
  misc_feature (359)..(359): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggacaggtcacactcacttggtggcttgagctctggctcagtctcaactggttacctaccccagctggtaccagcacgaccccaggccaggcctccacgccacgctcatgtacgataacaaatgtcnctcttcgtcgggtccctgactcgtcttctcgtggcctccacttccgttagggaaacaaacgtctcgccctaccaccactaccgaccggggcccaggcagatgagtgaatgtagtaattagttactgttgtgcgttgtagttcgttgggtggttggtttccgtttttggtcggtttcggcgggtacgggaccgtaacggtccgtacggtacccgtccgtaccgg

SEQ ID NO: 178338 - DNA, 540 bp, Homo sapiens
  misc_feature: GYAE6OF02I6MIZ.49.24.C02.1.454.CMB.1.raw
  modified_base (234)..(234): a, c, t, g, unknown or other
  misc_feature (234)..(234): n is a, c, g, or t
  modified_base (387)..(387): a, c, t, g, unknown or other
  misc_feature (387)..(387): n is a, c, g, or t
tcagagtcgagagacacgaccggtgctcgatttagtacagatcgttagggaaagggggaaaaggccctgaggaaaacaaaccctagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggganagtcacactcacttgtggcttgagctctggctcagtctcaactggttactaccccagctggtaccagcagaccccaggccaggctccgacgcacgctcatgtacatacaaatagtcgctacttcgtgggtccctgatcgcttctctggctccntccgtgggaacaaagctcgccctcaccactcgaccggggccaggcagatgatgaagtgtgtattattactgttgtgctgtattcgtgggtggtggttcgttttggtcggttcgggtcggtacgggtacgacggtctcggtaccgtcgtaccgg

SEQ ID NO: 178339 - DNA, 597 bp, Homo sapiens
  misc_feature: GYAE6OF02I3PKY.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggacagtcacactcacttgtggcttgagctctggctcagtctcaactggttacctaccccagctcggtaccagcacgaccccaggccaggctccacgcaccgctcatgtacgatacaaatagtcgctcttcgtcgggtccctgactcgtcttctcgtgcctccacttccgtagggaacaaagctcgccctcaccactccgaccggggcccacggcagatgagtgaatgtagtatttagttacgttgttgtgtcgttgttagtcgttggggtgggttcggtttccgtttttcgggttcggtttccggggtcgggtaacggggtaccgtaacggtccggtaccggtaccccggttcccgttaacccgg

SEQ ID NO: 178340 - DNA, 528 bp, Homo sapiens
  misc_feature: GYAE6OF02H1O3S.49.24.C02.1.454.CMB.1.raw
  modified_base (234)..(234): a, c, t, g, unknown or other
  misc_feature (234)..(234): n is a, c, g, or t
  modified_base (474)..(474): a, c, t, g, unknown or other
  misc_feature (474)..(474): n is a, c, g, or t
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggttactaccccagctggtaccagcacgaccccaggccaggcctccacgcacgctcatgtacgatacaaatcgtcgctcttcgtggggtccctgatcgtcttctctcggctccattccgttagggaaaccaaagctcgccctcaccatcgaccggggccaggcagatgatgaatgtgtattatacttgtgtgctgtntcgtgggttgtggttcttttgtgttcggnggtacggacagcgtcgccgtctacg

SEQ ID NO: 178341 - DNA, 558 bp, Homo sapiens
  misc_feature: GYAE6OF02HQHA7.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttactaccccagctggtaccagcacgaccccaggccaggctccacgcacgctcatgtacgatacaaatgtcgctcttctcgggtccctgatcgtcttctctggctccatccgtgggaacaaagctcgccctcaccacgtccgacggggcccaggcagatgatgaatgtagtattagttacttgtgtgtcttgtagtcgtgggttggttggttcgtttttcggtggtttcgggcgggtacgggaccgtaaggtccgtacggtacccgttccgtaccgg

SEQ ID NO: 178342 - DNA, 615 bp, Homo sapiens
  misc_feature: GYAE6OF02J3K1E.49.24.C02.1.454.CMB.1.raw
  modified_base (238)..(238): a, c, t, g, unknown or other
  misc_feature (238)..(238): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
  modified_base (415)..(415): a, c, t, g, unknown or other
  misc_feature (415)..(415): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacngtcacactcacttgtggcttgagctctggctcagtctcaactcggttacctaccccagcctggtaccagcacggaccccaggccaggcctccgacgcacgctcatgtacgataacaatcgtcnctcttcgtcgggtccctgctcgtcttcncgtggctccatccgtaggaacaagcncgccctcaccacgtccgaccggggccaggcacgtagacgattacggaattggtagtaactttacgttacgttggtgtcggtcttgttacgttcggttggggtttacgggtttcgggttttcttttccgggttacgggtttccggggaccgggttaacggtaccgaacggttccgtaccgggtacccttaccggtacccgg

SEQ ID NO: 178343 - DNA, 524 bp, Homo sapiens
  misc_feature: GYAE6OF02H6BYJ.49.24.C02.1.454.CMB.1.raw
  modified_base (469)..(469): a, c, t, g, unknown or other
  misc_feature (469)..(469): n is a, c, g, or t
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggggacagtcacactcacttgtggcttgagctctggctcagtctcaactggttactaccccagctggtaccagccacgaccccaggccaggcctccacgcacgctcatgtacgataacaaatacgtcgcttcttcgtggggtccctgactcgcttctctggcctccatccgtagggaacaaagctgccctcaccatcgaccggggcccaggcagatgatgaatgtgtattattatgtgtgntgtatcgtgggtggtggttcttttggtgttcggnggaggacagctgccgtctacg

SEQ ID NO: 178344 - DNA, 640 bp, Homo sapiens
  misc_feature: GYAE6OF02JDUD0.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccggggggacagtcacactcacttgtggcttgagctctggctcagtctcaacttggttacctaccccagctggtaccagccacgaccccaggccaggcctccacgcacgctcatgtacgataccaaaatcggtacgccttcttcggtcgggtccctgactccgtcttctcgtcggtctcctacgtccgttagggaaaccaaacggccttcggcccttacacccaacgtccggaaccggggccctaacgggactaacgacgtacgacgtagaaacgttggtagtaacgtttacttaacgttgttcggtgtacgttggttacgtcgttggggtcggtttcggttcgtttttcgggtcggtttcggggtacgggtaccggggaccgtaaggtccggtaccggtaccggttcccgttaacgg

SEQ ID NO: 178345 - DNA, 553 bp, Homo sapiens
  misc_feature: GYAE6OF02GFOQT.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggctccacgcacgctcatgtacgatacaaatagtcgctcttcgtggggtccctgactcgcttctctggctccatcctagggaacaaagctcgccctcaccactccgaccggggcccaggcagatgatgaatgtagtatttattacgtgtgtgtctgtatcgtgggtggttggttcgtttttcggtggttcgggcgggtacgggaccgtaaggccgtacggtacccgtccgtaccgg

SEQ ID NO: 178346 - DNA, 556 bp, Homo sapiens
  misc_feature: GYAE6OF02HTA6X.49.24.C02.1.454.CMB.1.raw
  modified_base (235)..(235): a, c, t, g, unknown or other
  misc_feature (235)..(235): n is a, c, g, or t
  modified_base (450)..(450): a, c, t, g, unknown or other
  misc_feature (450)..(450): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttactaccccagctggtaccagcagaccccaggccaggcctccacgcacgctcatgtacgatacaaatagtcgctcttcgtggggtccctgactcgcttctctggctccatccgttaggaacaaagctcgccctcaccatcgaccggggcccaggcagatgatgaatgtntattattactgtgtgctgtatcgtgggttggtcggttcgtttttcggtggtttcgggacgggtacgggtaccgaaggtccgttacggtacccgttccgtaacccgg

SEQ ID NO: 178347 - DNA, 546 bp, Homo sapiens
  misc_feature: GYAE6OF02GS26N.49.24.C02.1.454.CMB.1.raw
  modified_base (234)..(234): a, c, t, g, unknown or other
  misc_feature (234)..(234): n is a, c, g, or t
  modified_base (385)..(385): a, c, t, g, unknown or other
  misc_feature (385)..(385): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggttactaccccagctggtaccagcagaccccaggccaggctccacgcacgctcatgtacgatacaaatagtcgctcttctgggtccctgactcgcttctctgctccntccttggaacaagctcgccctcaccatccgacggggcccagggcagactgatgaatgtagtatttattactgttcgtgtcttgtattcgttgggtggttggttcgtttttcggtggtttccgggcggtacgggacctaaggctacggtcccgtccgtaccg

SEQ ID NO: 178348 - DNA, 542 bp, Homo sapiens
  misc_feature: GYAE6OF02J0N3F.49.24.C02.1.454.CMB.1.raw
  modified_base (509)..(509): a, c, t, g, unknown or other
  misc_feature (509)..(509): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagcctggtaccagccacgaccccaggccacggctccacgcacgctcatgtacgataacaaatagtcgctcttgtcgggtcctgactcgcttctcgtgcctcactctcgggaacaagctcgccctcaccatccgaccggggtcccaggcacgagtgatagatgtagtattagttacttagtgtatcgtgtatcgtggttcggtgttcttttggtgttcggnggtacggacgacgtcgtcggtaccgtcgtacgg

SEQ ID NO: 178349 - DNA, 718 bp, Homo sapiens
  misc_feature: GYAE6OF02HX3WT.49.24.C02.1.454.CMB.1.raw
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactccttgcttatggatcaggtgtggaatctcagactgtggtgacccaggagccatcgttgtcaggtggtccccgggggganagtcacactcacttgtgcttgagctctggctcagtctcaactggttacctaccccagctggtaccngcacgaccccaggccaggcctccgacgcacgctcatcgtacgataaccaaaatagtcgcttcgtttcgtcggggttccctaggactccgtccttttctcgtcgggccttcctacttcccgttagggaaacctaaacggccttacggccccttaccgaccctaacgtcccggaacccggggggacccccaggggtaccaacgggtacgtaggaacgttaggtaaacttgggttaacggtaattttacgttttaacgttggttaggttcggtactttaggttacgtttacggtttgggggttgggtttacgggttttccgttttttttacgggtcggggttttaccgggaccgggggtaacggggttaaccggtaaacggttacccggttacgggtaccccggttaccgttaacccggg

SEQ ID NO: 178350 - DNA, 545 bp, Homo sapiens
  misc_feature: GYAE6OF02H07US.49.24.C02.1.454.CMB.1.raw
  modified_base (238)..(238): a, c, t, g, unknown or other
  misc_feature (238)..(238): n is a, c, g, or t
  modified_base (532)..(532): a, c, t, g, unknown or other
  misc_feature (532)..(532): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganaggtcacactcacttgtggcttgagctctggctcagtctcaactggttactaccccagctggtaccagccagaccccaggccaggcctccacgcacgctcatgtacgattacaaatgtcgactctttcgtcggggtccctgatcgtcttctctcggcctccatccttgggaacaaagctgtccctcaccatcgaccggggcccaggcacgatcgaatgaactgtgaatttattactgtagtgcttgtatcgtgggttgggtgttcgtttggtgttcggcggaggaccagtcgtntacccggtctacg

SEQ ID NO: 178351 - DNA, 553 bp, Homo sapiens
  misc_feature: GYAE6OF02I1X00.49.24.C02.1.454.CMB.1.raw
tcagagtcgagagacacgaccggtgctcgatttagtacagatcgttagggaaaggagaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctgtaccagcacgacccacggccaggctccacgcacgctcatgacgatacaaatagtcgctcttcgtggggtccctgactcgcttctctggcctccactcctgggaactaaacgcctcgccctcaccactcgaccggggcccaggcagatgatgagtgtgtattattacgttgtgtgcgttgtatgtgggttggttcggtttcgttttcggttggttcgggtcggacgggtaccgtaaggtccgtacggtaccgttcccg

SEQ ID NO: 178352 - DNA, 591 bp, Homo sapiens
  misc_feature: GYAE6OF02GEKJD.49.24.C02.1.454.CMB.1.raw
  modified_base (434)..(434): a, c, t, g, unknown or other
  misc_feature (434)..(434): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtgcttgagctcgtggctcagtctcaacttggttacctaccccagctcggtaccagcacgaccccaggccaggcctccacgcacgctcatgtacataacaaatgtcgctcttcgtcgggtcctgactcgtcttcgtctcggcctcctactccgttaggaaacaacgctcgccctcacctacnccggaccggggcccaggccagagtcgagtagaagtgtagtatttacttacgttgtgtcgtcgttgtagttcgtgggttgggttcggttcgtttttcggtacggtttcgggacggtacgggtaccgtaggtccgttacggtacccgttccgtaaccgg

SEQ ID NO: 178353 - DNA, 573 bp, Homo sapiens
  misc_feature: GYAE6OF02GMK2H.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggggacagtcacactcacttgtggcttgagctctggctcagtctcaactggttactaccccagctggtaccagcagaccccaggccaggcctccacgcacgctcatgtacgatacaaatagtcgctcttcgtcgggtccctgatcgcttctctggctccatccgttggaacaaagctcgccctcaccactccgaccggggcccaggcagatgatgaatggtagtatttaattacgttgttgtgtcttgtagttcggtgggttgggttggttcgttttttcgggtggtttccgggtacgggtagggtaacccgtaaggtcgtacggtacccgttccgttaacccgg

SEQ ID NO: 178354 - DNA, 614 bp, Homo sapiens
  misc_feature: GYAE6OF02IEXKR.49.24.C02.1.454.CMB.1.raw
  modified_base (236)..(236): a, c, t, g, unknown or other
  misc_feature (236)..(236): n is a, c, g, or t
  modified_base (304)..(304): a, c, t, g, unknown or other
  misc_feature (304)..(304): n is a, c, g, or t
tcagagtcgagagacacgaccggtgctcgatttagtacagatcgttagggaaaggggaaaaggccctgaggaaaacaaaccccagatgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccggggggganaggtcacactcacttgtggcttgagctctggctcagtctcaactggttacctaccccagctggtaccngcacgaccccaggccaggcctccacgcacgctcatgacgatacaaatgtcgctcttctcggggtccctggactcgctttcgtcgtcggtcctcctacgttccgttagggaacctaaagcttcggcccctacaccacgtaccgaccggggcccagggcagatagatgaattgtagtattagttacttgttgtgtcgttagtactcggttgggttacgggttggttttccgtttttacggttcgggtttcccgggacggggtacgggtacccgtaaggtccggttacggtacccggttaccgttaacccggg

SEQ ID NO: 178355 - DNA, 561 bp, Homo sapiens
  misc_feature: GYAE6OF02JGI5Z.49.24.C02.1.454.CMB.1.raw
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggctccacgcacgctcatcgacgatacaaatgtccntcttcgtggggtccctgactcgcttctctggctccatcctgggaactaacgctcgccctcacctanccgacggggcccaggcagatgatgaatgtagatttatacgtgtgtgctgtatcgtgggtggttcggttcgtttttcggtcggtttcgggtacgggtacgggtaacccgtaggtccttacgggtacccgttcccgtaacccgg

SEQ ID NO: 178356 - DNA, 529 bp, Homo sapiens
  misc_feature: GYAE6OF02GV815.49.24.C02.1.454.CMB.1.raw
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccntccttggaacaaagctgccctcaccancacggggcccaggcagntgatgaatgtgtattagttactgtgtgctgtatcgtgggtggtggtctttttcggtgtttcgggcggtacgggaccgtaagcgtggacccgtctaccgg

SEQ ID NO: 178357 - DNA, 665 bp, Homo sapiens
  misc_feature: GYAE6OF02J3KK9.49.24.C02.1.454.CMB.1.raw
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (511)..(511): a, c, t, g, unknown or other
  misc_feature (511)..(511): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggganaggtcacactcacttgtggtcttggagctcgtggctcagtctcaactcggtactacccagctggtaccngcacgacccnggccaggctccacgcacgctcatgtacgactacaaatgtcgctcttcgtcgggtccctgactccgtcttctcgtggcctcctagttcctaggaactaaacgtcctgccctactaccgacgtcccgaccgggggcccacgggaccgaggataggtacgttagtaagtcggttacggtaatttaacgttacgttcggnttacggccgtttaggtacgttcgggttcggggtttcggtttaacgggttttcctttttcgggggttaccggttaccggggggtaccggttaaccgggggtaacccgtaacgggtacccgttaccgggttaccccggttacccgttaaccccggg

SEQ ID NO: 178358 - DNA, 572 bp, Homo sapiens
  misc_feature: GYAE6OF02I1P0J.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggganaggtcacactcacttgtggcttgagctctggctcagtctcaacttggttacctaccccagtctggtaccagccagaccccaggccaggcctccacgcacgctcatgacgataacaaatgtcgctcttcgtcgggtccctgactcgtcttctctggctccatccgtagggaacaagctcgccctcaccagtccgacggggcccaggcagatgactagaagtgtagatttagttacgttgttgtgtcgttgtacgttcgtgggttggttggtttccgtttttggtcggttcgggtcgggacgggtaccgaaggtccgtacggacccgttccgttaccgg

SEQ ID NO: 178359 - DNA, 575 bp, Homo sapiens
  misc_feature: GYAE6OF02HLG60.49.24.C02.1.454.CMB.1.raw
  modified_base (234)..(234): a, c, t, g, unknown or other
  misc_feature (234)..(234): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaacttggttacctaccccagctggtaccagcacgaccccaggccaggcctccacgcacgctcatgtacgataacaaatagtcgctcttcgtcgggtccctggacttcgctttctcgtcggcctccattccgttagggaaacaaacgctcgccctcaccatccgaccggggcccaggcagatgactagaagtgtagtattagttatgttagtgtcgttgttagttcgtggggttggttggttcgttttttcggtcggttcgggtcgggtacgggaccaggtcgtacggtaccgtccgtaccgg

SEQ ID NO: 178360 - DNA, 558 bp, Homo sapiens
  misc_feature: GYAE6OF02H4FWC.49.24.C02.1.454.CMB.1.raw
  modified_base (293)..(293): a, c, t, g, unknown or other
  misc_feature (293)..(293): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctctggctcagtctcaactggttactaccccngctggtaccagcacgaccccaggccaggcctccacgcacgctcatgtacgatacaaatcgtcgctcttcgtcgggtcctgactcgcttctctcggtctccatccgttaggaacaacgctcgcctcaccatccggaccggggcccaggcgagatgatagatgtatattattgtgtgtntnttgtatcgtgggtggttggttcgtttttcggtggttcgggacgggtacgggtaccgtaaggtcgtacggtacccggtacgtaccgg

SEQ ID NO: 178361 - DNA, 543 bp, Homo sapiens
  misc_feature: GYAE6OF02HR7JW.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggctccacgcacgctcatgtacgatacaaatagtcgctcttcgtgggtccctgactcgcttctctggctccatccttaggaacaagctcgccctcaccatcgaccggggcccaggcagatgatgatgtgtattagttactgtgtgcttgtatcgttggttggtggttcgtttttcggtcggtttcgggcgggtacgggaccgaagtccgtcgtaccgtcgtaccgg

SEQ ID NO: 178362 - DNA, 565 bp, Homo sapiens
  misc_feature: GYAE6OF02FUNA2.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatagtcgctcttctggggtccctgactcgcttctctcggctccatccttgggaacaagctgccctcaccatccgacggggcccaggcagatgatgatgtgatttattactgtgtgtcttgtagtcgtggggtggttcggttcgttttttcggtcggtttccgggtacgggtacggggtacccgtaaggtccgttacggtaccccggttcccgttaacccgg

SEQ ID NO: 178363 - DNA, 547 bp, Homo sapiens
  misc_feature: GYAE6OF02HAVC1.49.24.C02.1.454.CMB.1.raw
  modified_base (234)..(234): a, c, t, g, unknown or other
  misc_feature (234)..(234): n is a, c, g, or t
  modified_base (487)..(487): a, c, t, g, unknown or other
  misc_feature (487)..(487): n is a, c, g, or t
  modified_base (521)..(521): a, c, t, g, unknown or other
  misc_feature (521)..(521): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganaggtcacactcacttgtggcttgagctctggctcagtctcaacttcggttaactaccccagctggtaccagcacgaccccaggccaggcctccacgccacgctcatgtacgatacaaatacgtcgctacttcgtcgggtccctgactcgtcttctctggcctccacttccgttagggaaactaacgctcgccctacaccagtccgaccggggtcccaggccaagactgatcgaatgtgtattattactgtgtnctgtatcgtggtggtggttcttttggtgtccggnggacggacaggtctgtcctcctacgg

SEQ ID NO: 178364 - DNA, 557 bp, Homo sapiens
  misc_feature: GYAE6OF02G3KGH.49.24.C02.1.454.CMB.1.raw
  modified_base (469)..(469): a, c, t, g, unknown or other
  misc_feature (469)..(469): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttcgtgggtccctgactcgcttctctgctccatccttggaacaagctcgccctcaccatccgacggggcccaggcagatgatgaatgtagtattagttactgttgtgtcgtgtntcgtgggttggttcgggttcgtttttcggtggttccgggtcgggtacgggtaccgaacggtccgtacggtacccgttccgtaacccgg

SEQ ID NO: 178365 - DNA, 594 bp, Homo sapiens
  misc_feature: GYAE6OF02I1TKE.49.24.C02.1.454.CMB.1.raw
  modified_base (234)..(234): a, c, t, g, unknown or other
  misc_feature (234)..(234): n is a, c, g, or t
  modified_base (330)..(330): a, c, t, g, unknown or other
  misc_feature (330)..(330): n is a, c, g, or t
tcagagtcgagagacacgaccggtgctcgatttagtacagatcgttagggaaaggggaaaaggaccctgaggaaaacaaacccagctgggaagcctgagaacacgtagccttcatgagtgtcccaccatggcctggatgatgcttctcctcggactccttgcttatggatcaggtgtggaatctcagactgtggtgacccaggagccatcgttgtcagtgtccccggggggganaggttcacgactcacttgtggcttgagctctggctcagctcaactggtactaccccagctggtacagcagaccccaggccaggcctcacgcacgcncgactgtacgatacaaaatcgtcgacttcttcgtcggggtccccttggactcggtcttcgtcgtacgggtcctaccgcttcccgttagggaaacctaacgtctggtacccctctaccactccgaccgggggtacccaggccagatcgaattgaaactgtacgatttagtaacttgtaatcgcgttagtacttcgtggttacgggtggttcttttcgggtgttaccggcgggtacgtacggacgtcgacgtacccgttctaccgg

SEQ ID NO: 178366 - DNA, 548 bp, Homo sapiens
  misc_feature: GYAE6OF02F4WU1.49.24.C02.1.454.CMB.1.raw
  modified_base (234)..(234): a, c, t, g, unknown or other
  misc_feature (234)..(234): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggttactaccccagctggtaccagcagaccccaggccaggcctccacgcacgctcatgtacgataacaaatagtcgctcttctggggtccctgactcgcttctctggctccactccttggaaacaaagctcgccctccaccactccgacggggcccaggcagatcgatgaatgtgtattattacgttgtgtgtctgtattcgtgggtggttggttagtttttcggtggttcggcgggacggtaccgtaggccgtcggtaccgtcctaccgg

SEQ ID NO: 178367 - DNA, 545 bp, Homo sapiens
  misc_feature: GYAE6OF02HU9OZ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggacaggtcacactcacttgtggcttgagctctggctcagtctcaactggttactaccccagctggtaccagcacgaccccaggccaggcctccacgcacgctcatcgtacgatacaaatgtcgctcttctggggtccctgactcgcttctctggctccatccgtaggaacaagctcgccctcaccactcgaccggggcccaggcagatgatgatgtagatttatacgtgtgtgtctgtatcgtgggtggttggttccgtttttggtcggtttcgggcggtacgggaccgaggtcgtcgtaccgtccgtaccgg

SEQ ID NO: 178368 - DNA, 569 bp, Homo sapiens
  misc_feature: GYAE6OF02ILUOU.49.24.C02.1.454.CMB.1.raw
  modified_base (236)..(236): a, c, t, g, unknown or other
  misc_feature (236)..(236): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggganagtcacactcacttgtggcttgagctcgtggctcagtctcaactggttacctaccccagctcggtaccagcacgaccccaggccaggcctccacgcacgctcatgtacataacaaatagtcnctcttcgtcgggtccctgactcgtcttctcgtgcctcctattccgtagggaaacaaagcctcgccctacaccactccggaccggggcccaggcagntgatgatgtagtattattactgtgtgcttgtatgtgggttggttcggtttcttttcggtcggttcgggtacgggtacggaccgtaacggtccgtacggtacccgttccgtaccgg

SEQ ID NO: 178369 - DNA, 587 bp, Homo sapiens
  misc_feature: GYAE6OF02GLDPV.49.24.C02.1.454.CMB.1.raw
  modified_base (358)..(358): a, c, t, g, unknown or other
  misc_feature (358)..(358): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttacctaccccagctggtaccagccacgaccccaggccaggcctccacgcacgctcatgtacgataacaaatagtcncttcttcgtcggggtccctgactcgtcttctctcggcctccacttccgtagggaacaaacgcctcgccctccaccacgtccggaccgggggcccacggacgagatgatgaattggtgtatttattacgttgttgtgtcttgttacttcgtgggttgggttggtttcgtttttcggtggtttcgggcgggtacgggaccgtaaggtccgtccggtacccgtccgtaccgg

SEQ ID NO: 178370 - DNA, 674 bp, Homo sapiens
  misc_feature: GYAE6OF02I5K4J.49.24.C02.1.454.CMB.1.raw
  modified_base (246)..(246): a, c, t, g, unknown or other
  misc_feature (246)..(246): n is a, c, g, or t
  modified_base (315)..(315): a, c, t, g, unknown or other
  misc_feature (315)..(315): n is a, c, g, or t
  modified_base (362)..(362): a, c, t, g, unknown or other
  misc_feature (362)..(362): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgacccgaggacgcccattcgttgtcctaggtcggtccccggggggganaggtcacactcacttgtgcttgagctctggctcagtctacaactggttacctaccccagctggtacccngaccacgacccccgaggccaggcctaccacgccacgctcatgtacanaacaaatgcgctacttcgtcggggtccctagacttcgcctttgaccgtggcccttccgtactccggtttacggaaacgtaaacgtcgtacgtcccctccgaacctacgtacccggaacccgggggccctacgggaccgaagaccgttagaagttacgaagtaggttacgtaatttacgttaacgttgttcgtggtacttaggtacgttcggttcgggtcgggtttcggtttcggtttttcggttgggtttacccggggtcgggtaccgggtaaccgtaagggtccgttaccggtacccgttcccgtaaccgg

SEQ ID NO: 178371 - DNA, 552 bp, Homo sapiens
  misc_feature: GYAE6OF02FZU64.49.24.C02.1.454.CMB.1.raw
  modified_base (355)..(355): a, c, t, g, unknown or other
  misc_feature (355)..(355): n is a, c, g, or t
  modified_base (439)..(439): a, c, t, g, unknown or other
  misc_feature (439)..(439): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtgtccccgggggggacaggtcacactcacttgtggcttgagctctggctcagtctcaactggttactaccccagctggtaccagcacgacccccaggccaggctccacgcacgctcatgtacgatacaaatgtcnctcttctgggtccctgatcgcttctctcggctcatcctagggaacaagctcgccctccaccatccgaccggggcccaggcaganagatgaatgtgtattattactgtgtgtcgtgttatcgtgggtggttggttcgtttttcggtggtttccgggcggtacgggacctaaggtcgtacggtacccgttccgtaccgg

SEQ ID NO: 178372 - DNA, 634 bp, Homo sapiens
  misc_feature: GYAE6OF02IY9OD.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggggacaggtcacactcacttgtggcttgagctctggctcagtctcaactggttactactcagctggtaccagcacgacccaggccaggctccacgcacgctcatgacgatacaaatagtcgctcttcgtcgggtccctgtactcgtcttcgtcgtgcctccacttccgttagggaaacaagtctcgccctacacctacgtaccggaccggggtacccacggaccaagtactacggagttaacgaacgttggtacgttaacgtttaacgttacgttggttcgtacggtcgtttacgttacggttcggttaggggttcgggtttcggtttaccggtttttcggttcgggtttaccggggcgggtaacgggtaccgtaacgtccggttaccggtacccgttacccg

SEQ ID NO: 178373 - DNA, 658 bp, Homo sapiens
  misc_feature: GYAE6OF02JI2W1.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatcgtacgatacaaatgtcgctcttcgtcgggtccctgactccgtctttcctcgtcggtcctccgtacttccgttagggaaacctaaacgtccgttaccggcccttcaacccgtacgtaccggacccgggggtacccagggaccacggacgtcgtactacggaacgttcggttagtaacgttttaacgttacgttgttagtcgtaccgttagttacgttcggttaggggtcggtttcgggttaccttttttcgggtacggtttccggggtacgggtacggggtacccgttaacggtccggttaccggtacccgttcccgttaaccgg

SEQ ID NO: 178374 - DNA, 564 bp, Homo sapiens
  misc_feature: GYAE6OF02F87MX.49.24.C02.1.454.CMB.1.raw
  modified_base (235)..(235): a, c, t, g, unknown or other
  misc_feature (235)..(235): n is a, c, g, or t
  modified_base (481)..(481): a, c, t, g, unknown or other
  misc_feature (481)..(481): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganggtccacactcacttgtggcttgagctctggctcagtctcaactggttacctaccccagctcggtaccagcacgaccccaggcccaggcctccacgcacgctcatgtacgatacaaatagtcgctcttctcgggtccctgactcgtcttcgtctcgcctaccattccgtaggaaacaagccttcgccctacaccactcggaccggggccaggcagatgactgaatggtatattattcgtgtgtgtntgtagtcgttgggtggttggttcgttttggttcggttcggcgggtacggaccgtaaggccgttacggtacccgtccggtaccg

SEQ ID NO: 178375 - DNA, 559 bp, Homo sapiens
  misc_feature: GYAE6OF02GAQNN.49.24.C02.1.454.CMB.1.raw
  modified_base (438)..(438): a, c, t, g, unknown or other
  misc_feature (438)..(438): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacaggtcacactcacttgtggcttgagctctggctcagtctcaactggttacctaccccagctggtaccagcacgaccccaggcccaggcctccacgcacgctcatgtacgatacaaatagtcgctcttctgggtccctgactcgcttctctgctcatcctaggaacaagctcgccctcaccagtccgacggggcccaggcagntgatgatgtagtattattacgtgtgtgtctgtgttcgtgggttggttcggttcgtttttcggttcggtttcgggcgggtacgggaccgtaaggtccgtacggtacccggttccgtaaccgg

SEQ ID NO: 178376 - DNA, 880 bp, Homo sapiens
  misc_feature: GYAE6OF02H6DRS.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtgaatctcagactgtggtcgacccgaggacgccagtcgttgtcaggtcgggtcccggggggangtcacactcacttgtggtctgagctcgtggctcacgtctcaacgttcggttacctaccccgagtccgttacggtaacccacggaccgaccggaacccccgacgggacccaacgggtccctaccccgaaccggacccgaaccggtcccttaccgtaacgttaccgggttaaaccgtaaacttaaaacctaaaaaacggttaccggttcccggtaccttttccggttttaccgggtttcccggggggttaccccttagggttaaccgtttcccggttccttttaccgttccggtccgggtcccttacccgtacgtttacccggttaagggtaaaaacctaaacggtcccgttaccgtacccctacccgtaacccgtaccgttacccgggaacccggggggtaccccgaagggaccgtaaccggtaagtacggaaccgtttaaggtaaacgttcgggttaagttaacgttttaagtttaaccggtttgtttacggggttcgttaccgttggtttaacgttccggggttgggggtttcgggttccggttttccggttttttcgggtcgggtttacgggggaccgggttaacgggtaaccggttaacggtaccggttaccggtaccccggttaccgttaacccggg

SEQ ID NO: 178377 - DNA, 757 bp, Homo sapiens
  misc_feature: GYAE6OF02HH9AV.49.24.C02.1.454.CMB.1.raw
  modified_base (259)..(259): a, c, t, g, unknown or other
  misc_feature (259)..(259): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggacaggtcacactcacttgtggcttgngctctggctcagtctacaactggttacctaccccagctaggtaccagcacgacccccaggccacggcctccacgcacgctacatcgtaacgataacaaatacgtcgcttcttcgtcggggtccctaggactccgtcttttccgtcgttcgggtccctcctaacgtttacccgtttacggggaaaacctaaaacggtccgttaccggacccctttacccgaacccctaacggttaccccgggaacccggggggggtacccccaacggggacccgacgggtaacgttacggaacgttacggtaaacgttaggttacgttaaacgttttaagttttaaccgttagggtttacggttacggtacctttaggttaacggtttcggttacggggtttgggtttcggggttttccggttttttcgggttcgggttttccggggtacggggtaacgggtaaccggtaacgggttccgtacggttacccggtacccgttaacccggg

SEQ ID NO: 178378 - DNA, 586 bp, Homo sapiens
  misc_feature: GYAE6OF02IMUJC.49.24.C02.1.454.CMB.1.raw
  modified_base (368)..(368): a, c, t, g, unknown or other
  misc_feature (368)..(368): n is a, c, g, or t
tcagagtcgagagacacgaccggtgctcgatttagtacagatcgttagggaaagggggaaaaggccctgaggaaaacaaaccccagctgggaagcctgagaacacgtagccttcatgagtgtcccaaccatggcctggatgatgcttctcctcggactccttgcttatggatcaggtgtggatctcagactgtggtgacccaggagccatcgttgtcaggtcggtcccggggggacagtcacactcacgttgtggcttggagtctctggctcagtcctcgaactggttacctaccccagccttggtacccaggccacggacccccaggccaggcctccacgcacgctcatgtacgatacaaatagtcncttcttcgtcgggtccctgactcgcttctctggcctcacgtccgttaggaacaagctcgccctcaccactccgaccggggcccaggcagagcgagtcgaatgtagtattattacgtgtgtgcgttgtacgtgtaggggttggttcggtttcgttttcggttggttccgggtacgggtacgggtacctaggtccgtaccggtacccgtccgttaaccgg

SEQ ID NO: 178379 - DNA, 601 bp, Homo sapiens
  misc_feature: GYAE6OF02FYCZZ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacaggtcacactcacttgtggcttgagctctggctcagtctcaacttggttacctaccccagctggtaccagcacgaccccaggccaggcctccacgcacgctcatgtacgataacaaatagtcgctcttcgtcggggtccctgactcgtcttctcgtcggctcctatcctagggaaacaacgtcctcgccctcaccacgtaccggaccggggcccacggacagagtcgatagaatgtagtatttagttacttggttgtgtcttagtagttcggttggggttggttcggtttccgttttttcggttcggtttccgggacgggtacgggtaccgtaaggtccgttacggtacccgttacccgtaccgg

SEQ ID NO: 178380 - DNA, 610 bp, Homo sapiens
  misc_feature: GYAE6OF02GQUZ9.49.24.C02.1.454.CMB.1.raw
  modified_base (261)..(261): a, c, t, g, unknown or other
  misc_feature (261)..(261): n is a, c, g, or t
  modified_base (518)..(518): a, c, t, g, unknown or other
  misc_feature (518)..(518): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttganctctggctcagtctcaacttggttacctaccccagctggtaccagcacgaccccaggccaggcctccacgccacgctcaatcgtacgaataacaaaatagtccgccttcgtttaccgtcgggggttcccctggtactccgtctttcctcgtcggccttccctagttccgttagggaaacaagtcctacgccctacaccgactccggaccgggggacccagggaccagactgatgaagtgtagtatttattacgtgtntgtcttgtattcgtgggttggtggtttcgttttcggtcggttcgggacgggtacggaccgtaaggtccgtacggtacccggttccgtaccgg

SEQ ID NO: 178381 - DNA, 540 bp, Homo sapiens
  misc_feature: GYAE6OF02GNTVM.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggcctccacgcacgctcatgtacgatacaaatagtcgctcttctggggtccctgatcgcttctctggctccatccttgggaacaaagctagccctcaccatccacgggggcccaggcagatgatgaatgtgattattactgtgtgctgtatcgtgggtggtggtctttttcggtggtttcgggtcggagggtacccgaaggtccgtggacccggtccttaacgg

SEQ ID NO: 178382 - DNA, 563 bp, Homo sapiens
  misc_feature: GYAE6OF02IL47D.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtcccgggggggacagtcacactcacttgtggcttgagctctggctcagtctcaactggttaccaccccagctggtaccagcacgaccccaggccaggcctccacgcacgctcatgacgatacaaatgtcgctcttcgtcggggtccctgactcgcttctctggcctcactccgttagggaaacaaagctcgccctcaccacgtccgaccggggcccaggcagatgatgaatgtagtattagttactgttgtgtcttgtatcgtgggttggttggttctttttcggttggttcgggacgggtacgggaccgtaaggccgttacggtacccgtaccgtaccgg

SEQ ID NO: 178383 - DNA, 603 bp, Homo sapiens
  misc_feature: GYAE6OF02JBSY5.49.24.C02.1.454.CMB.1.raw
  modified_base (561)..(561): a, c, t, g, unknown or other
  misc_feature (561)..(561): n is a, c, g, or t
tcagagtcgagagacacgaccggtgctcgatttagtacagatcgttagggaaaggggaaaagggacccgtgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggggacagtcacactcacttgtggcttgagctctggctcagtcctcaacttggttacctaccccagtcctggtaccagcacgaccccaggccaggcctccacgcacgctcatgacatacaaatgctctcttcgtcgggtccctgatcgtcttcctcgtcggtcctctacttccgttacgggaactaaacggcctactcccctacaccctacgtacccgaccgggggtacccacgggaccaggtactgaatacgaagttcgttagactttattacgttgtgtgtctgttactgttcgggtggtttagggttctttttgggtcggttcgggngggtaacgggtacctaaggcgtcgtacccggttccttaacgg

SEQ ID NO: 178384 - DNA, 548 bp, Homo sapiens
  misc_feature: GYAE6OF02H2QF6.49.24.C02.1.454.CMB.1.raw
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggacagtcacactcacttgtggcttgagctctggctcagtctcaactggttacctaccccagctggtaccagcacgaccccaggccaggctccacgcacgctcatgtacgataacaaagtacgtcgcttcttcgtcgggtccctgactcgtcttctctcggcctccattcccgttagggaaactaagcctcgccctacacactccgacgggcccaggcagatgagtgaatgtagtatttattactgtgtgtntgtntcgtgggtggttggttcttttcggtgttccggaggaggacctagcgtcgacccgtctacg

SEQ ID NO: 178385 - DNA, 516 bp, Homo sapiens
  misc_feature: GYAE6OF02IQFAV.49.24.C02.1.454.CMB.1.raw
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacaggtcacactcacttgtggcttgagctctggctcagtctcaactggttactaccccagctggtaccagcagaccccaggccaggcctccacgcacgctcatgtacatacaaatagtcgctcttcgtggggtccctgatcgcttctctggctcatccttgggaacaagctgccctnaccatcgacggggcccaggcagatnatgaatgtgattatactgtgtgctgtatcgtggtggtgtcttttgtgttcggcggtaggacctagcgtcgaccgtcctacg

SEQ ID NO: 178386 - DNA, 552 bp, Homo sapiens
  misc_feature: GYAE6OF02HXVTM.49.24.C02.1.454.CMB.1.raw
  modified_base (238)..(238): a, c, t, g, unknown or other
  misc_feature (238)..(238): n is a, c, g, or t
  modified_base (414)..(414): a, c, t, g, unknown or other
  misc_feature (414)..(414): n is a, c, g, or t
  modified_base (467)..(467): a, c, t, g, unknown or other
  misc_feature (467)..(467): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganaggtcacactcacttgtggcttgagctctggctcagtctcaactggttactaccccagctggtaccagcagaccccaggccaggcctccacgcacgctcatgtacgataacaaatagtcgcttcttctggggtccctggtatcgcttctctggctccatcctagggaacaaagctncctcaccatcgacggggcccaggcagactgactgaatgtgtattatactgtgngtctgtatcgtgggttggtggttcgtttttcggtggttcgggcgggtagggtaccaaggtcgtacggtcccgtaccgttacccgg

SEQ ID NO: 178387 - DNA, 567 bp, Homo sapiens
  misc_feature: GYAE6OF02F452O.49.24.C02.1.454.CMB.1.raw
  modified_base (357)..(357): a, c, t, g, unknown or other
  misc_feature (357)..(357): n is a, c, g, or t
  modified_base (476)..(476): a, c, t, g, unknown or other
  misc_feature (476)..(476): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagccacgaccccaggccaggctccacgcacgctcatgtacgataacaaatacgtcnctcttcgtcgggtccctgactcgcttctcgtgctccacttccgtaggaacaagctcgccctcaccactccgaccggggcccaggcagatgagtgaagtgtagtatttaacttacttgtntgtcgtgtactcgtgggtcggttggttcgttttttcggtggtttcgggacgggtacgggaccgtaaggtcctcggtacccgttccgtacgg

SEQ ID NO: 178388 - DNA, 594 bp, Homo sapiens
  misc_feature: GYAE6OF02HDYF2.49.24.C02.1.454.CMB.1.raw
  modified_base (505)..(505): a, c, t, g, unknown or other
  misc_feature (505)..(505): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtgcttgagctctggctcagtctacaacttggttacctacccagctggtaccagcacgaccccaggccgaggcctccacgcaccgcctacatcgtacgataacaaatcgcgtctcttcgtcgggtccctggtactccgtcttctcgtcgtcctacctacgtccgtaggaacaaagtcctcgccctacacctacgtccggaccggggcccagggcagagtgagtgaagtgtatactttattacgttgttgtgtnttagtagtcggttgggttgggttggtttcgttttcggtggttccgggagggacgggtaccgtaggccgtacggtaccgtacccgtacgg

SEQ ID NO: 178389 - DNA, 546 bp, Homo sapiens
  misc_feature: GYAE6OF02FY84E.49.24.C02.1.454.CMB.1.raw
  modified_base (236)..(236): a, c, t, g, unknown or other
  misc_feature (236)..(236): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacngtcacactcacttgtggcttgagctctggctcagtctcaactggttactaccccagctggtaccagcacgaccccaggccaggcctccacgcacgctcatgtacatacaaatagtcgctcttcgtggggtccctgactcgctttctctggcctccatccttgggaaccaaagctcgccctcaccatccgaccgggggcccaggcagatgatgaatgtagattattactgtgtgtctgtatcgtgggtgttggtctttttcggtggttcgggcggtagggtaccaaggtcctacggtaccgtccgtaccgg

SEQ ID NO: 178390 - DNA, 646 bp, Homo sapiens
  misc_feature: GYAE6OF02IRYUM.49.24.C02.1.454.CMB.1.raw
  modified_base (237)..(237): a, c, t, g, unknown or other
  misc_feature (237)..(237): n is a, c, g, or t
  modified_base (271)..(271): a, c, t, g, unknown or other
  misc_feature (271)..(271): n is a, c, g, or t
tcagagtcgagagacacgaccggtgctcgatttagtacagatcgttagggaaaggggaaaagggccctgaggaaaacaaacccaagctgggaagcctgagaacacgtagccttcatgagtcgtccccaccactggacctggatgatgcttctcctcggactccttgcttatggatcaggtgtgatctcagactgtggtgaccgaggagccatcgttgtcagtcgtcccggggggacngtcacacgtcacttgtggcttgagctctggctcngtctcaactggttactacccagctcgtacagcagccccagccaggctcacgcacgctcatgtaacagtacaaatacgtcgtctcttacgtcgggttccctgactcgtactttcgtccgtggccttccgtacttccgttacgggaaactaacggtactaccggcctacaccgacgtaccggaccggggtacccgacggacgtagtacgtagtacgtagtacttacggtagtaagtttacttacgttacggttacgtcggttacgttcggttacgttcggttagggtttcggttcgggtttcggtttttacggttcggttccgggtagggtaacgggtaccggtaacggtcgtacggtacccgttaccgttaccggg

SEQ ID NO: 178391 - DNA, 543 bp, Homo sapiens
  misc_feature: GYAE6OF02FLMV4.49.24.C02.1.454.CMB.1.raw
  modified_base (404)..(404): a, c, t, g, unknown or other
  misc_feature (404)..(404): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcacgaccccaggccaggcctccacgccacgctcatgtacgataacaaatagtcgctcttctggggtccctgatcgcttctctgctccatctggaacaagcncgccctcaccatccgaccggggcccaggcagatgatgaatgtagattattacttgtgtgcgtgtatcgtgggtgggttggttcgtttttcgtggttcggcgggtacgggaccgaaggtctcggtaccgtccgtaaccgg

SEQ ID NO: 178392 - DNA, 552 bp, Homo sapiens
  misc_feature: GYAE6OF02FY9K3.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttactaccccagctggtaccagcacgaccccaggccaggctccacgcacgctcatgacgatacaaatagtcgcttctcgtgggtccctgactcgcttctctcggctcctatccgtaggaaacaagctcgccctcaccactcgaccggggcccaggcagatgatagaatgtgtattatactgtgtgctgtatcgtgggtggttcggttctttttcgggtcgtttcgggtacggacgggtaccgtaaggccgtacggtacccgtcgtaacccgg

SEQ ID NO: 178393 - DNA, 638 bp, Homo sapiens
  misc_feature: GYAE6OF02H44S0.49.24.C02.1.454.CMB.1.raw
  modified_base (234)..(234): a, c, t, g, unknown or other
  misc_feature (234)..(234): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactccttgcttatggatcaggtgtggaatctcagactgtggtgacccaggagccatcgttgtcagtggtccccgggggganaggtcacactcacttgtggcttgagctcgtggctcagtctcaactggttaacctaccccagtctggtaccagcacgaccccgaggccacggcctccgacggcaacgctcactgtacgataacaaatcgtcnctcttcgtcgggtccctgactcnctttctcgtcggaccttccacgttccgttacgggaaactaaacggctccgtccctacaccctacgtacccggacccgggggtacccagggaccagactcggaattagtaaacgttggtacgtaatttacttacgttgttgtgtcttagttagttcgtggggttaggttcggtttcgttttcgggtcggtttccgggtacgggtacgggtaacccgtagtaccggtaccggtacccgttaccgttacccgg

SEQ ID NO: 178394 - DNA, 524 bp, Homo sapiens
  misc_feature: GYAE6OF02GNBHK.49.24.C02.1.454.CMB.1.raw
  modified_base (235)..(235): a, c, t, g, unknown or other
  misc_feature (235)..(235): n is a, c, g, or t
  modified_base (500)..(500): a, c, t, g, unknown or other
  misc_feature (500)..(500): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttactaccccagctggtaccagcacgaccccaggccaggctccacgcacgctcatgtacgatacaaatgtcgctcttcgtggggtccctgatcgcttctctggctccatccttgggaacaaagctcgccctcaccatccgacgggggcccaggcagatgatgaatgtagtattattactgttgtgtctgtatcgtgggtggtggtcttttggtgttcggnggacggacagctcgaccgtctacg

SEQ ID NO: 178395 - DNA, 598 bp, Homo sapiens
  misc_feature: GYAE6OF02H755M.49.24.C02.1.454.CMB.1.raw
  modified_base (338)..(338): a, c, t, g, unknown or other
  misc_feature (338)..(338): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggacacggtcacactcacttgtggcttgagctctggctcagtctcaactggttactaccccagctggtaccagccacgaccccaggccaggcctccacgcacgcncatcgacgatacaaatcgtcgcttcttcgtcggggtccctgactctctttctcgtggcctccactccgttacggaactaacgctcgccctccaccacgtccggaccggggcccaggcgagacgtgatagaatgtagtatttattacgttgttgtgcgttgtattcggttgggttgggttcggtttcgtttttcggtcgggtttccgggacgggtacgggaccgtaacggtccgttacggtaccccgttccgttaacccgg

SEQ ID NO: 178396 - DNA, 543 bp, Homo sapiens
  misc_feature: GYAE6OF02FGU31.49.24.C02.1.454.CMB.1.raw
  modified_base (362)..(362): a, c, t, g, unknown or other
  misc_feature (362)..(362): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaacttggttactaccccagctggtaccagcagaccccaggccaggcctccacgcacgctcatgtacgatacaaatagtcgctcttcgnggggtccctgatcgtcttctctggcctccatccgttagggaacaaagctcgccctcaccancgacgggcccaggcagatgatgatgngtattntacttgtgtgtctntagttcgtgggtggttggttnttttcggtgttcgggacggtagggtacctaaggtcgtcgacccgttcctaccg

SEQ ID NO: 178397 - DNA, 539 bp, Homo sapiens
  misc_feature: GYAE6OF02F93SL.49.24.C02.1.454.CMB.1.raw
  modified_base (235)..(235): a, c, t, g, unknown or other
  misc_feature (235)..(235): n is a, c, g, or t
  modified_base (510)..(510): a, c, t, g, unknown or other
  misc_feature (510)..(510): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganagtcacactcacttgtggcttgagctctggctcagtctcaactggttacctaccccagctggtaccagcagacccccaggccaggctccacgcacgctcatgtacgataacaaatagtcgctcttcgtggggtccctgactcgcttcctctggctccatccttggaacaaagctcgccctcacccactccgaccgggggcccaggcagactgatgaatgtagtattattactgtgtgtctgtatgtgggtggttggttcttttcggtgttccggnggagggccaggcctcggtaccgtctaccg

SEQ ID NO: 178398 - DNA, 562 bp, Homo sapiens
  misc_feature: GYAE6OF02FYPFA.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggganagtcacactcacttgtggcttgagctctggctcagtctcaactggttacctaccccagctggtaccagcagaccccaggccaggctccacgcacgctcatgtacgataacaaatagtcgctcttcgtcggggtccctgatcgcttctctcggctccatccgtgggaaacaaagctcgccctcaccactccgaccgggggcccaggcagatgatgaatgtagatttattacttgttgtgtctgtattcgtgggtgggttggttcgtttttcggtggtttcgggcgggtacgggtaccgtaaggtcgtacggtacccgtccgttaccgg

SEQ ID NO: 178399 - DNA, 605 bp, Homo sapiens
  misc_feature: GYAE6OF02JAY8B.49.24.C02.1.454.CMB.1.raw
  modified_base (343)..(343): a, c, t, g, unknown or other
  misc_feature (343)..(343): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtcaggtcggtccccgggggggacagtcacactcacttgtggcttgagctctggctcagtcctcaactggttaccaccccagctggtaccacgcacgaccccaggccaggcctccaccgcacgctacntcgacgataacaaatacgtcgcttcttcgtcgggtccctgactcgcttctcgtcgctccacttccgtacggaacaagtctcgccctccaccactccggaccgggcccaggcagactgatagtatggtagtattattacgtnttggtntcgttgttgttcggttggggttggttcgggtttcgtttttcgggtcgggtttccggggtacggggtaccgggtaaccgtaccgggtacctacgggtacccgttaccgtacccggg

SEQ ID NO: 178400 - DNA, 544 bp, Homo sapiens
  misc_feature: GYAE6OF02HYIGR.49.24.C02.1.454.CMB.1.raw
  modified_base (439)..(440): a, c, t, g, unknown or other
  misc_feature (439)..(440): n is a, c, g, or t
  modified_base (449)..(449): a, c, t, g, unknown or other
  misc_feature (449)..(449): n is a, c, g, or t
  modified_base (462)..(463): a, c, t, g, unknown or other
  misc_feature (462)..(463): n is a, c, g, or t
  modified_base (505)..(505): a, c, t, g, unknown or other
  misc_feature (505)..(505): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttaccaccccagctggtaccagcacgaccccaggccaggcctccacgccacgctcatgtacgataacaaatcgtcgctcttcgtcgggtcctgactcgcttctctgcctccatccgttaggaacaagctcgccctcaccatcgacgggcccaggcagnngatgatgtntattatatgtgtnnttgtattcgtgggtggttggttcgttttcggtggttccgggnggtacgggacgtacggtcgtacggtcccggttctaccgg

SEQ ID NO: 178401 - DNA, 542 bp, Homo sapiens
  misc_feature: GYAE6OF02IQ05X.49.24.C02.1.454.CMB.1.raw
  modified_base (467)..(467): a, c, t, g, unknown or other
  misc_feature (467)..(467): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggggacagtcacactcacttgtggcttgagctctggctcagtctcaactggttactaccccagctggtaccagcacgaccccaggccaggctccacgcacgctcatgtacgatacaaatagtcgctcttctcggggtccctgactcgctttctctggctccatcctgggaacaagtctcgccctcaccactcgaccggggcccaggcagatgagtgagtgtagtattattactgtntgctgtatgtgggttggtggttcgttttggtcggttcggacggtacgggactaagcgtcggtaccgtccgtaccg

SEQ ID NO: 178402 - DNA, 599 bp, Homo sapiens
  misc_feature: GYAE6OF02I99FV.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganagtcacactcacttgtggcttgagctctggctcagtctcaactggttacctaccccagctcggtaccagcacgaccccaggcccaggcctccgacgcacgctcatcgtacactaacaaatagctctcttcgtcgggtccctgactcgcttctcgtcggcctcctacgttccgttagggaaactaaacgctcgtccctaccaacctacgtccgaccgggggacccacggcgacgtatacgatacgaattgtagtaacttagttacgtagttgtcgtcgtagttatcggttgggttcggttcggtttcgtttttcggtggttcggtacgggacgggtaccaggtcctacggtaccgtccgtaccgg

SEQ ID NO: 178403 - DNA, 666 bp, Homo sapiens
  misc_feature: GYAE6OF02J2O4N.49.24.C02.1.454.CMB.1.raw
  modified_base (236)..(236): a, c, t, g, unknown or other
  misc_feature (236)..(236): n is a, c, g, or t
tcagagtcgagagacacgaccggtgctcgatttagtacagatcgttagggaaaggggaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtaccagtcgtccccggggggganacggtcacgactcacttgtggcttgagctcgtggctcagtctcaactcggttactaccccagtctggtaccaggccacgaccccaggccaggctccacgcacgctcatgtacgatacaaatgtcgcttacgttcgtcgggtccctaggacttcgaccttttcgcgtcggccttccgtagtccgttagggaaacctaaacggtcctacggccccttacgaaccctacgtacccgggacccgggggacccagggaccctagaaccgttggaacctagtaaacgttcgttagtaacgtttacgttacgttacgtcggttacgtcttacgggtttattccgggtggggtttggttccgggtttctttttcgggtcggtttccgggaggtaacggggtaccaacggttccggtacgttacccggttctaacccgg

SEQ ID NO: 178404 - DNA, 580 bp, Homo sapiens
  misc_feature: GYAE6OF02H38N6.49.24.C02.1.454.CMB.1.raw
  modified_base (238)..(238): a, c, t, g, unknown or other
  misc_feature (238)..(238): n is a, c, g, or t
  modified_base (404)..(404): a, c, t, g, unknown or other
  misc_feature (404)..(404): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganaggtcacactcacttggtggcttgagctctggctcagttctcaactggttactacccccagctggtaccagccagacccccaggccacggcctccacgccacgcacatgtaccgaataaccaaattcgtcgacttcttcgttcggggtccctggacttcgctttcncgttggccttccattcccgttagggaaacctaaagcctcgccctcaccagtccgacggggcccaggcagntgatgaatgtagtattattactgtgtntntgtatcgtgggttgtcggtttcgttttcggtggttcggacgggtaggaccgtaagtccgtacgtacccgtcgtaccg

SEQ ID NO: 178405 - DNA, 706 bp, Homo sapiens
  misc_feature: GYAE6OF02H152K.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggcgccatcgttgtcaggtcgggtccccggggggacaggtcacactcacttgtggcttgagctcgtggctcagtctactaacgtggttacctaccccgagctcggacctagccacgaccccacggccaggtcctccgacgccacgcctcaactcgtacgataacaaacgtgtaccgcttcttcggtcgggtcctcggtatccgtcttcgtctcggtcccttactacgttccgttacgggtaaaccaaacgtcccgtaccgtccctaccgaaccctacggtaccggacccggggaccgaccggacgtacgtaagtcgtaaggtaacgtaacggtagttacggtaactttagtttaaccggtttgtacgggttacgtaccgtttaggttacgtcggggttaggggttcgggtttacgggttttccggtttttcgggtcgggttttcccgggtagggtacggaccggtaacggtcccggtaacggttacccggttacccgtacccgg

SEQ ID NO: 178406 - DNA, 818 bp, Homo sapiens
  misc_feature: GYAE6OF02ISC7A.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcgtccccgggggggacagtcacactcacttgtggcttgagctctggctcagtctcaactggttactaccccagtctggtaccagccaacgacccccagggcccacggcctaccgaccgcacgcctacagtacgtacgaataaccaaaattacggtacctccttcgtttaccgttcgggggttccccttaggacttccggtccttttccgtccgttcgggtcccttaccctacgtttaccccgtttaaggggtaaaacctaaaacggtcccttaaccggcccccttaaccgaaaccccgttaacgttccccggggaaccccgggggggtaccccaacggggtccccgaaaggtaacgtttacggaacgttacgggtaaaagtttcgggttaagtaagtttttaaacgtttaccgttacgggttttcggttacggttccgttttagggtaacgtttccgggttgggggttttcggggttcggggtttttcccgtttttttccggggttggggttttacccgggggtaccgggggtaaccggggaacccggttaaccgggttcccggtttacgggtacccccggttacccgttaacccggg

SEQ ID NO: 178407 - DNA, 561 bp, Homo sapiens
  misc_feature: GYAE6OF02FV5M5.49.24.C02.1.454.CMB.1.raw
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcagaccccaggcccaggcctccacgccacgctcatgtacgatacaaatagtcgcttcttcgtcggggtccctgactcgtcttctctcggcctcctatccgttagggaacaaagtctcgccctcaccatccgacggggcccaggcagatgatgaatgtagtattattctgtntgtctgtntcgtgggtggttggttntttttcggtcggtttcggcgggtacggaccgtaaggtccgtacggtacccgtccgtaaccgg

SEQ ID NO: 178408 - DNA, 621 bp, Homo sapiens
  misc_feature: GYAE6OF02G01TI.49.24.C02.1.454.CMB.1.raw
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (488)..(488): a, c, t, g, unknown or other
  misc_feature (488)..(488): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccattcgttgtcgaggtcgggtccccggggggacagtcacactcacttgtgtcttgagctctggctcagtctcaacgttggttacctacccagtctggtaccagccgacgaccccacggccaggcctccacgcacgctcatgtacgataacaaatcgtcncttcttcgtcgggtccctgtactcgctttcncgtggcctcctatccgttaggaacaagtctcgcctcaccacgtcgaccggggtcccaggccgagtagacgtagtagatgttagtactttnttaacgttgttagtcgtcgttgttagttcgggttgggttcgggttcggtttcggttttttcggttacgggtttccgggtacgggtaacgggaacgttacggtccgtttacgggtacccgttccggtaacccgg

SEQ ID NO: 178409 - DNA, 556 bp, Homo sapiens
  misc_feature: GYAE6OF02FT8RL.49.24.C02.1.454.CMB.1.raw
  modified_base (417)..(417): a, c, t, g, unknown or other
  misc_feature (417)..(417): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaacttggttacctaccccagctggtaccagcacgaccccaggccaggctccacgcacgctcatcgtacgatacaaatgtcgctcttcgtcgggtccctgactcgcttctcgtgctcatctagggaacaagctcgccctcaccntccgacggggcccaggcagatgagtagtatgtgtattattactgtgtcgtcgttgtagtcgttgggtggttgttacgtttttcggtcggttcgggtcgggtacgggtaccgtacggtcctcggtacccgttcgtaccgg

SEQ ID NO: 178410 - DNA, 572 bp, Homo sapiens
  misc_feature: GYAE6OF02GF25S.49.24.C02.1.454.CMB.1.raw
  modified_base (450)..(450): a, c, t, g, unknown or other
  misc_feature (450)..(450): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (566)..(566): a, c, t, g, unknown or other
  misc_feature (566)..(566): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggacgccattcgttgtcaggtcggtccccggggggacaggtcacactcacttggtggcttgagctctggctcgagtctacaacttcggttacctacccccagtccttacggtaccagaccacgaccccgaggcccgaggcctccgacgccacgctcatcgtacgataacaaatagtctacttcgttacgtcgggtccctgactcgtcttctcgtcggcctactctccgttacgggaacaacgtctcnccctcaccactccggacgggtcccaggcagatgatgatgtatattattactgtntntntgtntgtggttgtcggttctttggtcgttcggcggtacgacgtagcgtacgtaccgtntaccgg

SEQ ID NO: 178411 - DNA, 584 bp, Homo sapiens
  misc_feature: GYAE6OF02IRD7P.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctggtaccagcacgaccccaggccaggcctccacgcacgctcatgtacgatacaaatgtcgctcttctgggttccctgactcgcttctctggctccatccttggaacaagctcgccctcaccactccgaccggggcccaggacacgatgatagaagtgtagattttatacttgtgttgcttagtacgttgttggggttgggttcgggttcgttttttacgggtcggtttccggggacgggtacggggtacccgtaaggtcccggtacggtaccccggttcccgttaaccgg

SEQ ID NO: 178412 - DNA, 566 bp, Homo sapiens
  misc_feature: GYAE6OF02FGB3Q.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcgtccccgggggggacagtcacactcacttgtggcttgagctctggctcagtctcaacttggttacctaccccagctggtaccagcagaccccaggccagcctccacgcacgctcatgacgatacaaatagtgcttcttcgtgggtccctgatcgcttctctgctccatccgtaggaacaagctcgccctcaccactcgaccggggccaggcagatgatgatgtagtatttattactgtagtgtctgtattcgtggggttggttcggttctttttccggttggttccgggtacgggtacggggtaacccgtaaggtccgttacggtacccggttcccgttaaccgg

SEQ ID NO: 178413 - DNA, 611 bp, Homo sapiens
  misc_feature: GYAE6OF02GR3JG.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacaggtcacactcacttgtggcttgagctctggctcagtctcaacttggttactaccccagtctggtaccagcacgaccccaggcccaggcctccacgccacgctcatcgtaacgataacaaatacgtcgtcttcgttcgttcggggtccctgactcgtcttctcgtcggctccacttccgtagggaaacaacgtcctcgccctcaacctacgtccggaccgggggtcccagggcaggatgatagaatgtagtattacttacgtgtgtgtcgttgtagttcggttgggttcgggttacggtttcgtttttcgggtcggtttcgggtacgggtacgggtaccgtaggttccggtacggtacccgtccgttaaccgg

SEQ ID NO: 178414 - DNA, 702 bp, Homo sapiens
  misc_feature: GYAE6OF02IL65I.49.24.C02.1.454.CMB.1.raw
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtacggtcgacccaggagcctatcgttgtccaggtcggtccccggggggacaggtcacactcaccttgtcggcttgacgtctcgtggctcgagtctcaacgtggttacctaccccgagtcctaggtacccagtccaacgtacccccgaggcccacggcctaccgacgcaccgctcatcgtaacgataacaaatagtcncttcttcgtcgggtccngtactccgtcttcgtcgtggtcctccgtaagttccgttagggaaacctaaacggcctcggaccccttacaacctacgtacccgggaaccgggggccccaaaggtccgaaggtacgtacggaagtaggtaacgttggttaacgtaatttaacgttacgtttacgggtggttctacgtttacgtaagttcggttaggggttcggttcgggttttccggtttttacggtcgggtttccgggaaggggtaccgggttaaccgtcggttacggtacccgggttaccccgtccgttaacccgg

SEQ ID NO: 178415 - DNA, 629 bp, Homo sapiens
  misc_feature: GYAE6OF02HPRRO.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttacctaccccgagctggtaccagcacgaccccaggccaggcctccacgcacgctcatcgtacgataacaaatagtcgctcttcgtcgggtcctgatcgtcttctcgtgtctcactcctgggaacaaagctcgtccctcacactcggaccgggcccgacggcgagacgtagagtagattagtagtaagttacgttacgttgttagttgacgttagtacgtttcggttcggggttagggtttcggttaccggttttttttcggttcgggtttacccggggacgggttaaccggggtacccgtaaaccggttccggttaaccggttaccccggttcccgtttaacccggg

SEQ ID NO: 178416 - DNA, 584 bp, Homo sapiens
  misc_feature: GYAE6OF02H1L93.49.24.C02.1.454.CMB.1.raw
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (507)..(507): a, c, t, g, unknown or other
  misc_feature (507)..(507): n is a, c, g, or t
  modified_base (551)..(551): a, c, t, g, unknown or other
  misc_feature (551)..(551): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtcccgggggggacagtcacactcacttgtggcttgagctcnggctnagtctcaactggttaactccccagctggtaccngcagaccccaggccaggcctccacgcacgctcatgtacgatacaaatacgtcgtctcttcgtcggggtccctgactccgtctttcctcgtcgggtcccttaccgtagttcccgttacggggaaactaaaacggccttcgccctcctaccacgtaccggacggggtcccaggcagactgaactgaatgtagtattattacgtgtgtntgttagtgttcgtggtggttcggttcgttttcggtgtttccggnggtacgggaccaagtcgtcgtaccgtcctaccg

SEQ ID NO: 178417 - DNA, 579 bp, Homo sapiens
  misc_feature: GYAE6OF02FKQDA.49.24.C02.1.454.CMB.1.raw
  modified_base (323)..(323): a, c, t, g, unknown or other
  misc_feature (323)..(323): n is a, c, g, or t
  modified_base (489)..(489): a, c, t, g, unknown or other
  misc_feature (489)..(489): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtcccgggggggacagtcacactcacttgtggcttgagctctggctcagtctcaacttggttactaccccagctggtaccagcacgaccccaggccacggccnccacgccacgctcatgtacgataacaaatagtcgctcttcgtcgggtccctgactcgtcttctcgtggtcctccattccgtacgggaactaaacgctcgccctcaccatccggacggggcccaggcagatgatcggatgtgtaactttatttacgtgttagtcgtntagttattcggtggggtggttcggttcgtttttcggtcggttcgggacgggtaccgggacgtaggtccgtacggtacccgtccgtaccgg

SEQ ID NO: 178418 - DNA, 790 bp, Homo sapiens
  misc_feature: GYAE6OF02G3ZIR.49.24.C02.1.454.CMB.1.raw
  modified_base (274)..(274): a, c, t, g, unknown or other
  misc_feature (274)..(274): n is a, c, g, or t
  modified_base (316)..(316): a, c, t, g, unknown or other
  misc_feature (316)..(316): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcggacttccttgcttatggatcgaggtgtaggaatctcagactgtggtcgacccgaggacgccattcggttgtcacggtcgggtccccggggggacacgtcacactcacttggtggcgttgnctcgtcggctcgagtctactaacgttcggttaccctaccccngtccgtcggtaccacgcaccgaccccgacggccgacggccctacccaccggccaccgtcctcgacgttcgtaacgaactaacgaaaagttccgtccgtcctttacgttccggttccggggttccctagtacttccgtctttcgtcgtcggtcctacgtacgttccgttaacggaaactaacgcctccgtaccctacacccgacgtacccgggaccggggccccgaaggaccgaagtacgtagtaacgtagtaacgttggttaacgtttaacttttaacgtttacggtttcgtttagggttaccgttcgttttacggttacggtttcgggggtttaggggttttcggggttttacgggttttttccggttttttttacgggggtccggggttttacccggggaggggttaaacccggggtaccggttaaaccggtcccgggtttaccggttaccccggttacccgttaacccggg

SEQ ID NO: 178419 - DNA, 575 bp, Homo sapiens
  misc_feature: GYAE6OF02F3DKC.49.24.C02.1.454.CMB.1.raw
  modified_base (236)..(236): a, c, t, g, unknown or other
  misc_feature (236)..(236): n is a, c, g, or t
  modified_base (491)..(491): a, c, t, g, unknown or other
  misc_feature (491)..(491): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggangtcacactcacttgtggcttgagctctggctcagtctcaactggttacctaccccagctcggtaccagcacgaccccaggccaggctccacgcacgctcatgtacgataacaaatagtcgcttcttcgtcggggtccctgactcgcttctcgtcggctccacttccgtagggaacaaacgctcgccctacaccacgtccgaccgggggcccacggcacggatacgagtagatggtagtattattacttgtgtgtntgtatcgtgggttggttggttcgttttcggtggttcgggtacggtacggggtacctagtcgtacggtacccgtccgttaaccgg

SEQ ID NO: 178420 - DNA, 603 bp, Homo sapiens
  misc_feature: GYAE6OF02H9RNX.49.24.C02.1.454.CMB.1.raw
  modified_base (356)..(356): a, c, t, g, unknown or other
  misc_feature (356)..(356): n is a, c, g, or t
  modified_base (448)..(448): a, c, t, g, unknown or other
  misc_feature (448)..(448): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccgggggggacagtcacactcacttgtggcttgagctctggctcagtctcaacttggttacctaccccagctggtaccagcacgaccccaggccaggctccacgcacgctcatgtacgatacaaatagtcncttcttcgtcgggtccctgactcgctttctctcggctccatccgttaggaaacaagcctcgccctcaccagtccgaccggggccaggcagangatgatgtagtattagttactgttcgtgtcttagttacgttcggttggggttcggttcgggttttccgtttttcgggttcgggtttaccggggtaccgggtacggggtaacccgtaacgggtccgttacgggtaccccggtttccgttaacccgg

SEQ ID NO: 178421 - DNA, 967 bp, Homo sapiens
  misc_feature: GYAE6OF02JYPTD.49.24.C02.1.454.CMB.1.raw
tcagagtcgagagacacgaccggtgctcgatttagtacagatcgttaggaaagggaaaggccctgaggaaaacaaacccagctgggaagcctgagaacacgtagccttcatgagtgtcccaccatggcctggatgatgcttctcctcggactccttgcttatggatcaggtgtggaattctacagactgtggtgacccaggagccatcgttgtcagtcggtccccggggggatacgtcgaccactaccgagtttcggtaggtcctttaggacgtcgttcgtgggtccttacgacggtttccgttacgtaaaccgtttaggtttaaccccgttaaccccccgtaggttaccgttaccggggtttaacccctaacggggtacccgaaacccgggttaaccccccaaaggggttccccgaaacgggggtcccctttaaccccgggtaacccggcccgtaaccggttacccgttttaccgaaaccgggtttaccggtaaccggtaaacttaaaccgtaaacggtttaccggttacccgtaaccgtttccggtttacccgtttacccggggggttccccttagttaacccgttccggtccgtttttcccgtccggttaaccgggtcccgtttacccgttaaccgtttaccccgggtttaaccggggtaaaaccgtaaaccggttcccgttaaccgggtacccctttaccggtaaacccctacggttacccgggtaaacccgggggccccgttaacgggaccgtaacgaacggttacgaacggtttacggtaccgtttaaggtaccgggtttaacttacggtttaaccgttgttccggttaaggtacgttaccgttaggttacccgtttgggttacgggtttcggtttaccgttttttcgggtaccggtttcgggtaacggaccggggttaacctaaggttcccggtacggtttacccgtccgttaacccggg

SEQ ID NO: 178422 - DNA, 650 bp, Homo sapiens
  misc_feature: GYAE6OF02GHCN5.49.24.C02.1.454.CMB.1.raw
  modified_base (397)..(397): a, c, t, g, unknown or other
  misc_feature (397)..(397): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcgggtcccggggggacagtcacactcactttggtggtcttgacgctcgtggctcgagttcctactaaacgttcggttaacctacccccgagtccgttacggtaccagaccgaaccggacccccgaggacccacggtcctacccgacgccacgctacatcgaacataacaaatgtcnctcttcgtcgggtcctagactcgtcttctctcggcctctacttcgtagggaaacaacgctacgtccctacaccacgtaccggaccgggggacccacggaccgagtagtagtataggtaatggtatattattacgtgtgtcgtgttagttagtcggttggggtcggtttcgggtttcgttttttcgggtcgggtttaccgggacgggtaacgggtaaccgtaacggtcgtacggtacccgttaccggtaacccg

SEQ ID NO: 178423 - DNA, 585 bp, Homo sapiens
  misc_feature: GYAE6OF02FPX4G.49.24.C02.1.454.CMB.1.raw
  modified_base (353)..(353): a, c, t, g, unknown or other
  misc_feature (353)..(353): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggctccacgcacgctcatgtacgatacaaatagtcncttctcgtgggtccctgactcgtcttctcgtggcctcctacttccgttagggaaactaaacggcctcgccccttccaacccacgtcccgaccgggggcccagggcagatgatgatgtagtatttattacgttgttgtgtcttgttagtcgttgggttgggttcggttcgtttttcggtggtttcgggacgggtacgggtaccgaaggtccgtcggtacccgttccgtaccgg

SEQ ID NO: 178424 - DNA, 660 bp, Homo sapiens
  misc_feature: GYAE6OF02II2AO.49.24.C02.1.454.CMB.1.raw
  modified_base (208)..(208): a, c, t, g, unknown or other
  misc_feature (208)..(208): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactccttgcttatggatcaggtgtggaatctcagactgtggtcgacccgaggacnccattcgttgtcaggtcggtccccggggggacaggtcacactcacttgtggcttgagctcgtggctcagtctcaactggttacctaccccagtctcggtaccagcgaaccgaccccgaggacccaggcctacccacgaccaccgcctctaagtacgtaacgaactaacaaattacggtcctcttccgtttcgtccggggtcccttgactccgtctttccgtcgtcggtcctacctacgttccgttacgggaactaaacgctccgtccctaccacctacgtaccggaccggggacccaggcagatgagtagtaagtgtagttattacgttacgttgtgtgtcgttacgttagttacggttgggttagggttcggtttccgttttcggttcgggtttaccgggtacgggtacgggtaccggtacgtaccggtacggttacccgtaccgtaccgg

SEQ ID NO: 178425 - DNA, 617 bp, Homo sapiens
  misc_feature: GYAE6OF02JVRBL.49.24.C02.1.454.CMB.1.raw
  modified_base (476)..(476): a, c, t, g, unknown or other
  misc_feature (476)..(476): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactcggttacaccccagctggtaccagcacgaccccaggcctaggcctccacgaccacgctcagtgacgataaccaatagtcgacttcgttcgtacggggtccctgtactcgtcttctccgtcggcctctcgtccgttacgggaataacgctcgccctacacctacgtccggacggggtcccaggcaggatacgacgngtaacgtgtaggtaacttgttacgtgttagtgtcgttagtacgtcgttggggttcggtcggttttcgtttttcgggttcgttcgggggtaccgggtaacggtacccgagggttccgtacggttacccgtcccgttaccggg

SEQ ID NO: 178426 - DNA, 572 bp, Homo sapiens
  misc_feature: GYAE6OF02GX1F9.49.24.C02.1.454.CMB.1.raw
  modified_base (491)..(491): a, c, t, g, unknown or other
  misc_feature (491)..(491): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccccgggggggacagtcacactcacttgtggcttgagctctggctcagtctcaactggttacctacccccagctcggtaccagcacgaccccgaggccaggcctccacgccacgctcatgtacgataacaaatagtcgctcttcgtcgggtccctgactcgtcttctcgtggcctcacttccgttaggaaacaagctcgccctcaccactccggaccgggggcccaggcagagtgaatgaagtgtagtatttattacttgtgtgngtgtgtgtgggtggttggtttcgttttcggtggttcgggcgggtacgggaccgtaaggtccgtacggtaccgtccgtaccg

SEQ ID NO: 178427 - DNA, 789 bp, Homo sapiens
  misc_feature: GYAE6OF02IIF8P.49.24.C02.1.454.CMB.1.raw
  modified_base (216)..(216): a, c, t, g, unknown or other
  misc_feature (216)..(216): n is a, c, g, or t
tcagagtcgagagacacgaccggtgctcgatttagtacagatcgttagggtaaagggggtaaaaggccctgaggaaaacaaacccgtagctgggaagccttgagaacacgtagccttcatgagtgtcccacatgcctggagtgatgcttctcctcggactccttagcttactggatcgaggtcgtggaatctcagactgtggtcgaccctaggacncctagtcgttcgtcgacggttcggtacccggggggactacggtcacgtacgtcgtacgtttcgtcggtacttggacgtctcgtcggctacgagttcctactaacgttcggttaacctaccccgagccgttacggtaccgtaacggccgaaccggtacccccgaggtacccgaggtccctaccgacgacctacgtaccctacgaacgttacggtaactaacttaaaccgaaacgtttacgtaccgtacgtttaccggttccgtacggggtttcccctaggtacttccgtaccttttcgaccgtacgggtcccttacgtaacgtttcccggttaaagggtaaacctaacggccgttaccgtacccgtacgtaccgtaacggttacccgggaccggggtaacctaggaccgtaaaggttctaggtacttaggtaaccgttggtaaccgtacgtttaacgttcgtacggttcgtacgtcgttacgtacttacgggttgggttcgttcggttttcgtttcggtcggttaccggacggtaccggtacctacggtccggtacggtacccgtacgtaccgg

SEQ ID NO: 178428 - DNA, 669 bp, Homo sapiens
  misc_feature: GYAE6OF02I8I9Y.49.24.C02.1.454.CMB.1.raw
  modified_base (305)..(305): a, c, t, g, unknown or other
  misc_feature (305)..(305): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgaccaggagccatcgttgtcaggtcggtccccggggggacagtcacactcacttggtggcttgagctcgtggctcagtctcaactggttaccaccccagctcggtaccncgcacgaccccaggccaggcctccacgcaccgctcatacgtacgaactaacaaatacgtcgcttcttacggtcgggtcctgactcgtctttctcgtcggcctccacgttcccgttagggaaacctaacggtcctccgccctacaccgtacgtcccggaccgggggcccacgggctaacggattacgagtaggtaacgttagttacgttattttaacgttacgttcgttggtacgttcgttacgttagttccgggttagggttcgggtttacgggtttccgtttttcggggtcgggtttccgggggtacgggtacggggtaacccgtaacggttccggtaccggttacccggtacccgttaccgg

SEQ ID NO: 178429 - DNA, 751 bp, Homo sapiens
  misc_feature: GYAE6OF02GOBIC.49.24.C02.1.454.CMB.1.raw
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtcaggtcggtccccggggggacagtcacactcacttgtggcttgagctctggctcagtctacaactcggttacctaccccagcgtggtaccagcacgaccccnggccacggccnccacgcacgctacagtcgtaacgaataacaaaatcgtccgtcttccgttcggtcggggttccctagtacgttccgtcctttcgtcgtcggtcctacctacgttcccgttaaggggaaacctaaacgtccgttccgacccctaccgaacccgtaccgtacccgggaacccgggggcccgaacgggtacccgtaaggacgttacggaacgttaagggtaaacgttagggttaacgtttaaactttttaacgttaacgtttagggttcgttcggtacgtttaggttacgtttccgggttgggggtttcggggtttcgggttttacccggtttttttcgggttcggggtttaccggggtacggggtaaccgggtacccggtaaacggttccggttaaccggtaccccggttaccgttaacccggg

SEQ ID NO: 178430 - DNA, 606 bp, Homo sapiens
  misc_feature: GYAE6OF02GFWME.49.24.C02.1.454.CMB.1.raw
  modified_base (305)..(305): a, c, t, g, unknown or other
  misc_feature (305)..(305): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactggttacctaccccagctggtaccngcacgaccccaggccaggcctccgacgcacgctcatgtacgataacaaatcgtctctcttcgtcgggtcctgactcgtcttctcgtcgcctcactccgtaggaacaacgctcgccctcaccacgtccgaccggggtccaggcgagatgatgaagtgtacgtatttagttacgtgttgtcgtcgttagttagttcggttggggttcgggttcggttttcggttttttcgggttcgggtttccgggtaccgggtaacgggtaccgtaacggttccggtacggtacccggttccgtaacccggg

SEQ ID NO: 178431 - DNA, 614 bp, Homo sapiens
  misc_feature: GYAE6OF02H0A51.49.24.C02.1.454.CMB.1.raw
  modified_base (293)..(293): a, c, t, g, unknown or other
  misc_feature (293)..(293): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcagtcggtcccggggggacagtcacactcacttgtgcttgagctctggctcagtctcaacttcggtacctaccccngctggtaccagcacgaccccgaggccaggcctccgacgccacgctcatcgtacgaataacaaatacgtcgcttcgttcgtcgggtcctgactcgtctttctcgtggtcctccactaccgttaggaactaaacgctcgccctaccacctacgtccggaccggggcccaggacagtagtgtatgtaagtgtagtattaagttcgtgttgtgtacgttgttcttcggttggggttgggttcggtttccgtttttcggttcgggtttaccgggtcgggtaacgggtaccgtaaggtccggtacggtacccgttccgttaacccgg

SEQ ID NO: 178432 - DNA, 575 bp, Homo sapiens
  misc_feature: GYAE6OF02GNRCV.49.24.C02.1.454.CMB.1.raw
  modified_base (487)..(487): a, c, t, g, unknown or other
  misc_feature (487)..(487): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccgggggggacagtcacactcacttgtggcttgagtctcgtggctcagtctcaacttggttacctaccccagctcggtaccagcacgaccccaggccaggcctccacgcacgctcatcgacgataacaaatcgtcgcttcttcgtgggtccctgactcgcttctcgtggtcctcctactccgttagggaacaaagctcgccctacaccacgtccggaccggggccaggcagatgatgaatgtatattattacgttgtgtgtntgtacgtcgttgggtggttcggttcgtttttcggtcggttccgggacgggtacggtaccgtaggtccgtcggtacccgttcgtaccgg

SEQ ID NO: 178433 - DNA, 561 bp, Homo sapiens
  misc_feature: GYAE6OF02GQWDB.49.24.C02.1.454.CMB.1.raw
  modified_base (450)..(450): a, c, t, g, unknown or other
  misc_feature (450)..(450): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (533)..(533): a, c, t, g, unknown or other
  misc_feature (533)..(533): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttgagctctggctcagtctacaacttcggttacctaccccagcctaggtacccagcacgaccccaggccaggcctccgacgccacgctcatcgtacgaataaccaaatcgtacgtcttccgttcgtcggggtccctgtactcgtcttctcgtcgtcctctactccgtaggaaacaacgctcgccctcacctacnccggaccggggccacggcagagtgatgatgtagtatttatagtgtntgntgtntgtggtggtgtttcgtttggtcggttcggngggacggacgagcgtcgtaccgtctacg

SEQ ID NO: 178434 - DNA, 653 bp, Homo sapiens
  misc_feature: GYAE6OF02FU6B3.49.24.C02.1.454.CMB.1.raw
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
  modified_base (441)..(441): a, c, t, g, unknown or other
  misc_feature (441)..(441): n is a, c, g, or t
  modified_base (467)..(467): a, c, t, g, unknown or other
  misc_feature (467)..(467): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccagganccagttcgttgtcaggtcgggtccccgggggganagtccacactcacttgtggcttgagctcgtggcctcgagtcctactaacgttcggtttaaccctaacccccgagtccgttacggtaaccacgaccgaccgaacccccgacggcccaggccctacccgacgccacgcctcagtgtaacataacaattcgcgcttcttcgtcgggtcctgactcgtcttcctcgtcgcctcncgttccgtaggaaaccagtcctaccnccctacaccgtacgaccggaccggggcccaggacagacgtgacgtagtagagttacgtattacgttacgttgttntcggtntgttagttcggtgggttacggttcggtttccgtttttcggttcgggttccgggtagggtaaccggtaccgtacggttaccgtaccggtaccccgttcgtacccgg

SEQ ID NO: 178435 - DNA, 541 bp, Homo sapiens
  misc_feature: GYAE6OF02FNBK3.49.24.C02.1.454.CMB.1.raw
  modified_base (234)..(234): a, c, t, g, unknown or other
  misc_feature (234)..(234): n is a, c, g, or t
  modified_base (514)..(514): a, c, t, g, unknown or other
  misc_feature (514)..(514): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggganagtcacactcacttgtggcttgagctctggctcagtctcaactggttactaccccagctggtaccagcacgaccccaggccaggctccacgcacgctcatcgtacgatacaaatagtcgctcttctggggtccctgatcgtcttctctggctccatcctagggaacaaagtctcgccctcacccactccgaccgggggcccaggccagatagatagaattggtagtaactttattactgtgtgtctgtatcgtggtggtggttcgttttcgtggttcggngggacggctacggctcgccgtcgtacg

SEQ ID NO: 178436 - DNA, 569 bp, Homo sapiens
  misc_feature: GYAE6OF02GK7XQ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccgacgcacgctcatgtacgatacaaatagtcgctcgttcgtggggtccctgactcgcttctcgtggctcatcctagggaaccaaagctcgccctccaccacgtccgaccgggggcccagggccagactacgagtagatggtacgtaatttacttacgttgtcgtgtcgtgtagtcgtgggttggttcggttcgtttttcggtggttcggcgggacggtaccgaaggtccgtcggtacccgtctaccgg

SEQ ID NO: 178437 - DNA, 762 bp, Homo sapiens
  misc_feature: GYAE6OF02FY5VW.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttgtggcttgagtctcgtggctcagtctctaacttcggttacctaccccagcgtcggtaccagcaccgaccccgaggccgacggcctaccgaccgaccgaccgctcagtacgacgaatacaaatcgtcgtcttcgttcgtcgggtccctgactcgtctttctcgtcggtcctaccgtacgttaccggttaacggaaaccgtaaacgtccgtaccgtccccgtacaacccgtacgtcccgggaacccgggggccctaacggggcctaacggacgttacggtagtacggtaaagttgggttaacgtttacttttaacggttacgttacggtttcgttacggttgtttacgggttacgtttccggggtttagggggttttacggggttttccgggtttttccggtttttttaccggggttcggggtttcccggggggtaaccggggtaacccggggtaacccgtaccggggttacccggttaccgggttacccccggttacccgttaaccccggg

SEQ ID NO: 178438 - DNA, 614 bp, Homo sapiens
  misc_feature: GYAE6OF02FVVBD.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttgtggcttgagctctggctcagtctcaacttggttacctaccccagctcggtaccagcacgacccccaggccaggcctccacgcaccgctacatgtacgataacaaatgtcgcttcttcgtggggtccctgactcgctttctctcggacctcctatcccgtttagggaaaccaaacgtctccgccctacaccacgtccgggaccggggcccaggcagactggaagtcgaagtgttagtaatttaacgtttcgttgttagtcgtcgttgttattcggttaggggttcgggttgggttcgttttttcggtgggttccgggtacgggacggtaaccgtaggtctacgggaccccgttcgtacccgg

SEQ ID NO: 178439 - DNA, 748 bp, Homo sapiens
  misc_feature: GYAE6OF02H13TQ.49.24.C02.1.454.CMB.1.raw
  modified_base (238)..(238): a, c, t, g, unknown or other
  misc_feature (238)..(238): n is a, c, g, or t
  modified_base (607)..(607): a, c, t, g, unknown or other
  misc_feature (607)..(607): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcgggtcccgggggganacgtcacactctacttgtggcttgagctcgtggcctcagttctctaacgtcggttacctaccccgagccttcggtaacccagacccacggaccccgaggccgacggcctccgacgccacgtctacgatacgtacgaactaacaagtacgtccgtacttcttccggtacgggtccctagtacttccggtccttttccgttcgtcgggtaccctttccgtacgtttacccggtaagggaaacctaaacggtccctaccgtaccccttaccgacctaccggtacccgggaacccgggggtcccacggggtacaacgtacgtagacgttagtaacgtggttaagttaattttacgtttacgttggtcgttcgngtttacgtaggttcgggtttaggggtttcgggtttacggtttttccggttttcggggttcgggtttacccgggggacggggttaaccgggtaaccggtacggttacccgtaccggggttaccccttccggttaaccccggg

SEQ ID NO: 178440 - DNA, 686 bp, Homo sapiens
  misc_feature: GYAE6OF02JHYWD.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacnggtcacactcacgttgtgcttgagctcgtcggctcagtctacaactcggttacctcccagcgtcgtaccagccacggaccccaggccacggcctccacgccacgctcatcgtacataacaaatgtacgctcttcgtcgggtccctggactcggtccttcgtcgtacggtcctccgtacgttcccggttaggaaaccgtaaacgtccgttaccgacccttacccgaaccgtacgtacccgggacccgggggaccccgtacgggaaccgtacggtaacgttacggaacgttacgtaagttcggttaacggtaactttagttaccgttgttcggtacgtcgttaggtaccgttcggttcgggtggtttcggtttcgtttttcggtacggtttcgggtacgggtacgggtaaccgtaggttacccgttcgggtacccgtcccgttaaccggg

SEQ ID NO: 178441 - DNA, 808 bp, Homo sapiens
  misc_feature: GYAE6OF02ICZ01.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcaggtcggtcccgggggggacacggtcacactcacgttggtggtcttgagtctctggctcagttctctaactggttacctaccccagctcggtaaccagcacgaccccaggccaggtcctccacgccacgctcagtgtacgataacaaatcgtctactcgtttcgtcggggttccctggtacttccgtctttccttcgtcgggtcccttaccgtactttacccgtttacggggaaaacctaaacggtccgttaccggtcccctacccgtaaccctaaccggttacccgggaaccccggggggacccctaagggtacccgaagggttaacgtacggtaaaggttacggtaaacgtttacgggttacgtaaacgtttttaacgttttaaccgtttagggtttcggtttacggtccgtttaacgggttacgtttaccgggtttaggggggttttccgggtttcggggtttttacccggttttttccggggtttcccggggttttccggggtaccgggggttaaccgggtaaacccggttaacggggttacccgttacccggggttacccccggttacccggtttaacccccggg

SEQ ID NO: 178442 - DNA, 661 bp, Homo sapiens
  misc_feature: GYAE6OF02JYXBY.49.24.C02.1.454.CMB.1.raw
  modified_base (232)..(232): a, c, t, g, unknown or other
  misc_feature (232)..(232): n is a, c, g, or t
  modified_base (539)..(539): a, c, t, g, unknown or other
  misc_feature (539)..(539): n is a, c, g, or t
tcagagtcgagagacacgaccggtgctcgatttagtacagatcgttagggaaaggggaaaaggccctgaggaaacaaacccagctgggaagcctgagaacacgtagccttcatgagtgtccccaccatggcctggatgatgcttctcctcggactccttgcttatggatcaggtgtggaatctcagactgtggtgacccaggagccatcgtgtcagtcggtcccgggggganaggtcacactcacttgtggcttgagctcgtggttcagtctcaactggttactacccagctggtaccagcacgaccccagccagcctccacgcacgctcatcgtacgatacaaatagtccgcttacttcgtcggggtccctgacgtcgtcttcctcgtggcctaccgtacgttaccgttacggggaaacctaaaggtccgttcgaccccttacgaaccctacgtcccggaaacccgggggcccacgggaccacggactacggtaataccggtaagttcgtagtacgttaagttaacgtcggttaacgngttccgtaggttaacttcggtaggggttcggtttggttccggtttttaccggtgggtttaccgggaccgggtacggtaccgtaagggtccgttacggtaaccccggttccgtaacgtcccgg

SEQ ID NO: 178443 - DNA, 613 bp, Homo sapiens
  misc_feature: GYAE6OF02GIT38.49.24.C02.1.454.CMB.1.raw
  modified_base (360)..(360): a, c, t, g, unknown or other
  misc_feature (360)..(360): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttaacctaccccagctggtacccagccacgacccccaggccaggcctccacgcacgctcatgtacataacaaatgtccncttcttcgtcggggtccctgactccgtcttctctcggcctccattccgttagggaaacaaacggtctacgccctacacccacgtccggaccgggggcccagggccagagtgagtagtaagttgtagtatttattacgttgttcgtgtcgtagttactcggttgggttgggttggtttcgtttttcggttcgggtttaccgggcgggtaacgggtaccgtaacggtccgtcggtacccggtcccttaacccggg

SEQ ID NO: 178444 - DNA, 908 bp, Homo sapiens
  misc_feature: GYAE6OF02HXZIO.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggacacgtcacactctacttggtggtcttgacgtctcgtcggtcctcgtacgtcctactaaacgttcggtttaacccctaacccccgtagtaccgttaccgggtaacccacggacccaaccggaaccccccggacgggaccccgacgggtccctaccccgaccgcccgaccgtccctacgtaacgttacgtaaacgtaacttaaacgtaaaacgttcggttaccgtacctttccgtttcccggtttccggggttaccccttggtaccgttcccgttccttttccgttaccgttcgggtccccttacccgtaacgttccccgggtttaagggaaaaccgtaaacggtcccgttccgtaccccgtaccgaacccgttaaccggtacccggaaccccggggggtaccccgaacggggaccgtaaaggtacgtacgggtaaacttaggtaaacgttggtttaacgtttaacgttttaacgtttaaccgttggtttacggttacgtacggttttacgtttaacggtttcggggttttacgggggtttcggggttttccgggttttttacggtttttttccggggttccgggtttccgggggtaacccgggggtacggggtaaccccggttaaacggtccggtttaacccgggttacccccggttacccggttaaccccggg

SEQ ID NO: 178445 - DNA, 632 bp, Homo sapiens
  misc_feature: GYAE6OF02HYV22.49.24.C02.1.454.CMB.1.raw
  modified_base (236)..(236): a, c, t, g, unknown or other
  misc_feature (236)..(236): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganagtcacactcacttgtggcttgagctcgtggctcagtctacaactggttacctaccccagtctaggtaccagcacgaccccaggccaggcctccaccgcaccgcctcagtacgtacgataacaaatgtccgtcttcgttcgtacggggttccctagtacgtcgtccttcgtcgtcggccttacctactccgtttacgggaaacctaaacgtcctcgcccttaccaacctacgtacccggaaccgggggtaccccgtaggacgagagtagatagaattgtagtattacgttacgtgttgtcgtcgttgtgttcggttggggttggtcggtttcgtttttcggtggtttccgggacggtacgggaccgtacgtccgtacggtacccgtccgtaaccgg

SEQ ID NO: 178446 - DNA, 877 bp, Homo sapiens
  misc_feature: GYAE6OF02HYM7K.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggggacagtcacactcacgttgtggtcttggacgctctgggtctcagtcctctaaacgtcggttaacctaacccccgagccgttacggtaaccacggccaaccggacccccgacggcccaaggccctacccgaccgtccgaacccgtcctacgacgtacggtaaaccgtaactaaacctaaaagttacgtaccgtcctttacctttccgggttccgggggttccccttacgggtacttccggtccttttaccttcggtcgggtccccttccgtaacgtttcccgggtttaacggggtaaaccttaaaaccggtccgttacccggtccccttacccaacccgtacgtaaccccggggaaccccggggggtccccgaagggaccgtaaacggtaacgtaggtaacgttaagggtaaaccgttgggttaacgttaaagtttttaaaccggtttacgttttcggggtttaggtccggtttacgttaacgggtttaaccggtttccggtttggggggtttcggggtttaccgggtttttccggttttttaccgggggttacggggtttccggggtaccgggggtaaccgggtacccggttaaccggggtaccccggtttacggttaccccccggttaccgttaaccccggg

SEQ ID NO: 178447 - DNA, 726 bp, Homo sapiens
  misc_feature: GYAE6OF02HBPN2.49.24.C02.1.454.CMB.1.raw
  modified_base (237)..(237): a, c, t, g, unknown or other
  misc_feature (237)..(237): n is a, c, g, or t
tcagagtcgagagacacgaccggtgctcgatttagtacagatcgttagggaaagggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccgaggacgccatcgttgtcaggtcggtccccgggggganaggtcacactcacgttgtggcttgagctcgtggctcagtcctactaacttcggttacctaccccgagtctcggtaaccagcaaccgaccccgaggcccaggcctaccgacgccacgctcatcgtaacgaataacaaattcgtaccgtctccgtttcggtccgggttccctaggtacttccgtcctttccgtcttacgggtcccttcccgtacgttcccggtttaacggggaaacctaaacggtcccgttccgccctacctaacccgtacgtacccgggaacccgggggaccctacgggaccgaaggtactaggagttacggaaacgttggtagttaagtttacttacgtttagttggttagtccgtttaggttagttcgggtttggggtttacgggtttcgggtttcgttttttacgggtcgggtttcgggtacggggtaacggtaaccggtacgtaccggttccggtaccccggttaccgttaaccgg

SEQ ID NO: 178448 - DNA, 689 bp, Homo sapiens
  misc_feature: GYAE6OF02I87YX.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtcccggggggacagtcacactcacttgtgcttgagctctggctcagtctcaactggttacctaccccagctggtaccagcacgaccccgaggccaggtcctaccgacgccacgctacacgtgtaaccgataacaaagttagtccgcttcttcgtcggggttccctggtaactccgtctttcgtctacgggtctccctaagtttcccgttaagggaaacctaaaggcccgttacggtacccctacgtacccgtacgttacccggacccggggggttacccctaaggggacctacggtaacgtcggtaacgttacgtaagttcgtagtaactttagttaacgtgttcgtcgtcgttacgtacgttcgggtcgggtttcggttcggtttccggtttttcgtcgggtttccgggacgggttaacgggaccttaacggttcccgtaacggttacccgttccgttaacccggg

SEQ ID NO: 178449 - DNA, 966 bp, Homo sapiens
  misc_feature: GYAE6OF02F9EOT.49.24.C02.1.454.CMB.1.raw
tcagagtcgagagacacgaccggtgctcgatttagtacagatcgttaggtaagggaaaaggccctgacggaaacgaaaccccacgctgggaagacctacgagaacaacgtaagccttcagttgtacgttgtccccaccgatcggcctcggactgatggccttctcccgtcggactccttgcttagtcggagtcagggtcgtggaatcgtcgaagaccttggtcggtacgacccgtacggacgaccctagtccgtttgtccgtacggttcgggtcccccggggggggactaccggtccaacgtaccctaccgttaacgtttcgttacgggtccgtttacggacggtccttccggtcggaccgttcccgaggttaccggtaccgtaacgtttcgggttaacccttaccccggaagtccgttacggtaacccgtaacggtaccgtaaccggaacccccgacggtaaccccgacggtacccctacccccgtaccggacccaaccggtccgttacctaagttccgtaaacgacttaaaacctaaagttaccgtaccggtaccttccgttaccgggtaccgggttaaccctagtaccttaccgtccgtttacgtcgttccggtactcccgtagtcccgttaacgggaataacgccgtaccgtcccgtactaaccgtaccgtacccggtaccggggtacccaagggcctaacggtagtaccgggtacttacggggttaaggttcggttaaccgtttaacgttttaacggttacccgtttacgggaccggtttacgttaccgttacgggtttaccgtttaccggggtcggggttttacggttacccggggtttttaccggtttttacccggttacggggtttaaccccggggacccgggtttaacccggggttaaccccgttacccggggtaccccgtttaccggggttaccccgtttacccccggttaaccgg

SEQ ID NO: 178450 - DNA, 841 bp, Homo sapiens
  misc_feature: GYAE6OF02JG5WH.49.24.C02.1.454.CMB.1.raw
tcagagtcgagagacacgaccggtgctcgatttagtacagatcgttagggaaaggggaaaaaggacccgtgaggaaaacaaaaccccaacgctgggaagcctgagaacacgtagccttcatgagtgtccccaccactcggcctggatgatgcttctcctcggactccttgcttatggatcaggtgtggaatctcagactgtggtgacccgaggacgccagtcgttgtcgtaggtcggtcccgggggggacacggtcgaccactcacgttcggtggtcgttgacgtctcgtcggctcagtctcaacgttcggttacctaccccagtccgtggtaccacgccacgaccccgaggtcccaggccctaccgacgccgtaccggctcgacgttcgtaaccgtaactaacgtaaactacggtccgtacttcgtttaccggttcggggttacccttcggtaacgtttccgtaccgtttccgttccgtcggtcccttacccgtacgtttacccggtttaaggggaaacctaaacggccgttaccggtacccttaccgaacccgtaccgtaccgggaacccgggggtccctaacgggacgaacgtacgtacggtaacttacggtaagttcggttaagttacgtttaacgtttaccgttagttacgggtcttaacgttcgttaacgtttaccggggtttgggggttaccgggttttccgggttttttaccgggtttttttcgggttacccgggggtttaccggggttaaccgggggttaacggggtaacccgttaacggggttcccggtttaaacccggggtttccccggtttacccggttaaacccgggg

SEQ ID NO: 178451 - DNA, 635 bp, Homo sapiens
  misc_feature: GYAE6OF02IJUOZ.49.24.C02.1.454.CMB.1.raw
  modified_base (416)..(416): a, c, t, g, unknown or other
  misc_feature (416)..(416): n is a, c, g, or t
tcagagtcgagagacacgaccggtgctcgatttagtacagatcgttagggaaagggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccattcgttgtcgaggtcgggtcccggggggacagtccacactcacttgtgcttgagctctggctcagtctacaactcggttacctaccccgagcgtacggtaccagccgacgaccccgaggacccgaggcctaccaccgcacgcctactaatagtacaataacaaatgtcgcttcgttcggtcgggtccctgtactcgtcctttntccgtggtcctcctacttaccgttacgggaaactaaacgcctacgccctacaccctagtacccggaaccggggcccaggcagacgtgaacgtgtaagtgtagtatttattacgtgttggtgtacgttgtagtcggttagggttcggttcggtttcgtttttcggtcggttcgggacgggtacgggtaaccgtagtccggtaccgtaccgtacctaccgg

SEQ ID NO: 178452 - DNA, 638 bp, Homo sapiens
  misc_feature: GYAE6OF02FGVD6.49.24.C02.1.454.CMB.1.raw
  modified_base (236)..(236): a, c, t, g, unknown or other
  misc_feature (236)..(236): n is a, c, g, or t
  modified_base (391)..(391): a, c, t, g, unknown or other
  misc_feature (391)..(391): n is a, c, g, or t
  modified_base (451)..(451): a, c, t, g, unknown or other
  misc_feature (451)..(451): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganacgtcactactcacttgtggcttgagtctctggctcagtcctcaacttcggttacctaccccagctcggtaccagccacgaccccagccgagcctccacgccacgctcatgacgatacaaatgcgcttcttcgtcgggtcctgatccgtctttcncgtgctccacgttccgtaggaacaagtcctcgccctcaccacgtacggaccggggacccngggacctagatgaacgtagtaagttagtagttaagtttagttaacgttggtacgttacggtctttacgtagtttcgggttagggggttcggttttggggtttacctttttcggggttacggttccggggtacggggtaccggtaaccggtaccgggtcctacgggttacccgttacccgttaccggg

SEQ ID NO: 178453 - DNA, 535 bp, Homo sapiens
  misc_feature: GYAE6OF02FU2PF.49.24.C02.1.454.CMB.1.raw
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcacgaccccaggccaggcctccacgcacgctcatgacgatacaaatagtcnctcttcgtggggtccctgatcgcttctctcggctccatccttagggaacaaagctcgcctcaccanccgacggggcccaggcagatgatgaatgnattattactgtntgntgtatcgtgggtgtggtgttttcgtggtttcggcggtacgggaccaaggtcgtacggtaccgtccgtaccgg

SEQ ID NO: 178454 - DNA, 757 bp, Homo sapiens
  misc_feature: GYAE6OF02IDSJC.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgcagtcggtcccgggggggacagtcacactcacttgtgcttgagctctggctcagtctacaactggttacctaccccagctggtaccagcacgaccccaggccaggcctccacgcacgctcatgtacgataacaaatcgtcgccttcgttccgtcggggttccctaggtacttccgcttttcctacgtcgggtcccttacccgtacgttacccggtttaacgggaaaacctaaaacggtccgttaccgtaccccctaccgaacccgtacggttacccgggaacccgggggggtaccccgtaacggggaccgtaaacggtacgtaggaaacgttaggtaaacggtttaggttacgttaaacttttaacgtttacggttaggtttcggtacggttaccgttaggtttacgttccgggtttaggggggtttcggtttccggggttttaccgttttttcggggttccgggttttaccgggggaccgggtaaccggggtaccgtaacggttcccggttaccgggtaaccccggttcccgttaacccgg

SEQ ID NO: 178455 - DNA, 688 bp, Homo sapiens
  misc_feature: GYAE6OF02I0AGV.49.24.C02.1.454.CMB.1.raw
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (293)..(293): a, c, t, g, unknown or other
  misc_feature (293)..(293): n is a, c, g, or t
tcagagtcgagagacacgaccggtgctcgatttagtacagatcgttagggaaagggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcagttcggtcccgggggganaggtcacactcacttgnggctgngctctggctcagtcctcaactggttaccaccccngctggtaccagcacgacccaggccaggctccacgccacgctcatgtacgatacaaattgctctcttcgtgggtcctgactcgtctttcgtcgtcggtctcctacttccgttaggaaacaaacggcctacggtccctaccgaccctaacgtccggtaaccgggggaccctacgggacgacggtaacgtagtacgtagttaaacgttggttaacgttaacttttaagtttaccgttaggtttcgttacggttactttcgggttaacgttcggtttcggggtttggggtttacgggtttcccgttttttttacggggtccgggtttaaccgggggtaccgggttaacggggtaacccgttaaggttcccggtacggttacccggtcccttaacccggg

SEQ ID NO: 178456 - DNA, 709 bp, Homo sapiens
  misc_feature: GYAE6OF02HE58Z.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgtgtcaggtcgggtccccggggggganacggtcactacctcgacttggtacggtcttagacggtcttcgtgggtccttacgtacgttccttacgtaacgtttaccggtttaacccctaccccgacggtccgttacggtaacccagacctaaccggacccccgaaggcccgacggcctacccacggccacgtctacacgtcgtaacgtataaacaaacgttcgtacgtccttcgtttcggtccgggttccctagtacttccggtccttcgttccgtacggtcctacctacgtccgttaacggaacgtaacgcgtccgcctaccacctacgccggaccgggaccgacgcgacgatacgtagtacgtagtagtgtatttacttagttgtgtacgtcttagttacgttcggttagggttcggttcggtttcgtttttcggtacgggttcgggtacgggtacggaaccggtagttaccggtcgtacccggtaccgttaccgg

SEQ ID NO: 178457 - DNA, 693 bp, Homo sapiens
  misc_feature: GYAE6OF02HWNOQ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacaggtcacactcacttggtggcttgagctctggctcagtctcaactggttacctaccccagctcggtaccagccacgaccccaggcccaggcctcccgacgccaccgcctacgtacgtacgtaacgaactaaactaaagtcgtcgtccttcgttcgggtccgggtcctgtactcgtccttccgtcgtcggtccttaccgtacttccggttaaggaaactaacgccgtaccgtccctacaccctacggtacccgggaccggggacccgacgggcgaagtacgtagtaacgtagtaacgttgttacgttaatttacgttacgtggttgtcgtcgttaggttacgtttcgggttcggggttgggttccggttttcggtttttacgggtcgggttaccggggacgggtaaccgggtaccgtaacggtccggtaccggtaccccggttaccgtaacccggg

SEQ ID NO: 178458 - DNA, 736 bp, Homo sapiens
  misc_feature: GYAE6OF02H0HYY.49.24.C02.1.454.CMB.1.raw
  modified_base (233)..(233): a, c, t, g, unknown or other
  misc_feature (233)..(233): n is a, c, g, or t
tcagagtcgagagacacgaccggtgctcgatttagtacagatcgttagggaaagggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgaccaggagccatcgttgtcaggtcggtcccgggggganacggtcacactcacttgtggcttgagtctctcggcttcaggttctactaaacgtcggttaacctaccccgtagtccgtacggtaacccaggccaacggacccccaacggccaggcctccacgcacgctacatcgtacgactaacaaaactcgtcgacttcgtcgttcggggtccctggtactccgtcttctcgtcggtcctctacgtccgtttacgggaaacctaaacgtccgtcgtacccttaccaaccgtacgtacccggaaccgggggttccccgtacgggacgaacgtaacgtacgtaacgtagtaaacgttacgtagtaacgtttaacgtttaaccgttagttacggtagttaccgtaggtttaccgttacggttacgggggtttcgggttacggttttccggtttttttaccggtggggttttacccgggaccggggtaacgggtaacccggtaaaggtacccggtaccggttaccccggttacccgttaacccggg

SEQ ID NO: 178459 - DNA, 702 bp, Homo sapiens
  misc_feature: GYAE6OF02I2PGC.49.24.C02.1.454.CMB.1.raw
  modified_base (237)..(237): a, c, t, g, unknown or other
  misc_feature (237)..(237): n is a, c, g, or t
  modified_base (320)..(320): a, c, t, g, unknown or other
  misc_feature (320)..(320): n is a, c, g, or t
  modified_base (561)..(561): a, c, t, g, unknown or other
  misc_feature (561)..(561): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggagccatcgttgtcagtcggtcccggggggacnggtcacactctacttgtgctgagtctctaggctcagtctacaacgttggttaccaccccgagtctggtaccagcacgtacccnggccaggcctaccacggacacggtccactacgtagaacgataaccaaagttacgccgtactacgtttcgcgggtacctgactaccggtctttcgcgtccggtcctactacgttacccgttaaggggaaacctaaacggtcctcggtaaccccacggtacaccgtccgggaaaccggggcctaacgggactaggaccgtaggaaaccgtgtaaccgtagttacgttaacttacggttaacgngtttacgtacggtacgtaacgggtttatccgggttaggggttacggtttcgggtttaccggtttttcgggtacgggttaccgggacgggttaacccgggtaacctaccggtcggtacccggttaccctaccgggtaacccg

SEQ ID NO: 178460 - DNA, 708 bp, Homo sapiens
  misc_feature: GYAE6OF02HCDPH.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcgggtaccccgggggggacaggtcacactcacttgtggcttgagctctggctcagtctacaacttcggttaccaccccagctggtaccagcacgaccccgaggccaggcctccacgcacgcctacatcgtaacgataaccaaagtagtcgactccgtttcgtcggggtccctgtactcgtccttcttcgtgtcctcacgttcccgttagggaaacctaaacggcctacgtccctaccacctacgtaccggaccgggggtacccacgggtaccaaggtacgtacggtaagtacggtaaagttgtttaacggtaatttttacgttacgttaggtttcggttacgttacgtttagggttaacgttcgggtttaggggggtttcggggtttcggttttccggttttttacgggttcgggtttccgggggtaccgggttaacgggaaccgttaccggtaccggtaccgggttacccgttacccgttaaccggg

SEQ ID NO: 178461 - DNA, 555 bp, Homo sapiens
  misc_feature: GYAE6OF02F5TJJ.49.24.C02.1.454.CMB.1.raw
  modified_base (263)..(263): a, c, t, g, unknown or other
  misc_feature (263)..(263): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtgacccaggagccatcgttgtcaggtcggtccccgggggggacaggtcacactcacttgtggcttgngctctggctcagtctcaacttggttacctaccccagctcggtaccagcacgaccccaggcccaggcctccgacgcacgctcagtgtacataacaaatgcnctctcgtcgggtccctgactcgtcttctcgtgctctntccgtggaaacaacgctcgccctcaccagccggacggggcccaggcagactgatgagtgtntattattagtgtgtntcgtntagtgtgggtggttggttcgttttcggtggttcgggacggtacggacgtacggtcgtacgtaccgtcctaccgg

SEQ ID NO: 178462 - DNA, 655 bp, Homo sapiens
  misc_feature: GYAE6OF02IIDK8.49.24.C02.1.454.CMB.1.raw
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (414)..(414): a, c, t, g, unknown or other
  misc_feature (414)..(414): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtacaggtcggtcccgggggganaggtccacacctcactttgnggtcttgagctctggctcgagtctccaactcggttacctaccccgagcgtcggtaccagcacgacccccgaggcccaggcctaccgacgcacgtctcatacgtacgaataacaaatacgtctctcgttcgtcgggtccctgtactcgtcttcgtcgngtcctctactccgtaggaaacaacgtctacgtccctaccaccacgtccggaaccggggcccaggctagagtagaatagaagtagtataattagttacgtgtcgtgtacgttagttagttcggttgggtttacgggttcggttttaccgtttttcgggttacgggtttacccgggtacggggtaaccgggtaacccggtaaggtccggttaaccggttaccccggttaccggttaaccccgg

SEQ ID NO: 178463 - DNA, 720 bp, Homo sapiens
  misc_feature: GYAE6OF02G731H.49.24.C02.1.454.CMB.1.raw
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
tcagagtcgagagacacgaccggtgctcgatttagtacagatcgttagggaaagggaaaggccctgaggaaaacaaacccagctgggaagcctgagaacacgtagccttcatgagtgtccccaccatggcctggatgatgcttctcctcggactccttgcttatggatcaggtgtggaatctcagactgtggtcgacccgaggagccatcgttgtcaggtcgggtcccgggggganacgtcacactctacttgtgcttganctctggctcagtctcaacttgttacctaccccngtcgtcggtaccagccacgaccccaggccgacggctccacgcacgctcatgaacataacaaagtcgtcgtcttcttcggtcgggtccctgtactcgtcttcctcgtcgtccttccacgttcccgttaagggaaaccaaaggtaccgtccgtaccctacccaacccgtaccgtacccgggaacccgggggtaccccgacgggtaccgaaacgtacgttacggtaagttacgtaaagtttcgttagtaacgttttaactttacgttggtttacggttacgtcgtttaggttacgtttccgggtttggggtttcggggtttcgggttttaccggtttttttcggggttcgggtttccgggggtacggggtaaccggtaacccggtacgtacccgggttacccggtacccggttaacccgttaacccggg

SEQ ID NO: 178464 - DNA, 719 bp, Homo sapiens
  misc_feature: GYAE6OF02F4OJ9.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacaggtcacactcacttgtggcttgagctctggctcagtctcaacttggttacctaccccagtctcggtaccagccaacggccccaggcccgaggcctaccacgcaccgctcatgtacgatacaaatgtcgcttcgttcgtcggggtcctgacgtcgtcctttctccgtcgtacctccgtacttccggtaacgggaaactaaacggtcctaccgtaccccgtacaacccgtacgtacccgggaacccgggggtcccgaaccgggctaaacggtacgtacgtaacggttacggtaaagttcggttacgttaagttttaacgttaccgtttaggttcggttacgttacgtttacgttacggtttccggttaggggttgggttttcggtttccggttttttacggggtcggtttacccggggtaccggggtacgggttaacccgaacgggttccgttaccgggttaacccgttacccgttaacccgg

SEQ ID NO: 178465 - DNA, 682 bp, Homo sapiens
  misc_feature: GYAE6OF02HVG68.49.24.C02.1.454.CMB.1.raw
  modified_base (245)..(245): a, c, t, g, unknown or other
  misc_feature (245)..(245): n is a, c, g, or t
  modified_base (392)..(392): a, c, t, g, unknown or other
  misc_feature (392)..(392): n is a, c, g, or t
  modified_base (446)..(446): a, c, t, g, unknown or other
  misc_feature (446)..(446): n is a, c, g, or t
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcggactccttgcttatggatcgaggtgtggaatctcagtactgtggtcgacccgaggacgccattcgttgtcaggttcgggtccccggggggganacggtccacactctacgttgtggtcttgacgtcttcgtgggtcctcaagttcctactaaaccgttggtttaacctacccccaaggccttcgggtaacccagccaacggacccccagggcctaagggccctcccgacgcaccggcctnatacgtacgactaaccaaatgtccgtctcgttccgtgggtcctgatctccttcnctcggcctctactccgttaggaactaaacgctacgccctaccactaccgtccgaaccggggcccaggcagatggatgaagttagtcgtaattaccgttattcgggttagttcgcgtttagtcgtttacggttacgggttcgggtcgggttttcccgtttttgggttccgggttaccggggtacggtaccggggtaaccacggttacccgtccggttacccgttacccgtaacccgg

SEQ ID NO: 178466 - DNA, 576 bp, Homo sapiens
  misc_feature: GYAE6OF02GERAG.49.24.C02.1.454.CMB.1.raw
  modified_base (236)..(236): a, c, t, g, unknown or other
  misc_feature (236)..(236): n is a, c, g, or t
  modified_base (294)..(294): a, c, t, g, unknown or other
  misc_feature (294)..(294): n is a, c, g, or t
  modified_base (494)..(494): a, c, t, g, unknown or other
  misc_feature (494)..(494): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccggggggganagtcacactcacttgtggcttgagctctggctcagtctacaacttggttactaccccngctcggtaccagcacgaccccaggcccaggcctccacgcacgctcatgtaacgataacaaatacgtcgactcgttcgtcggggtccctgactcgtcttctctcggctcactccgtagggaaacaagtctcgccctacaccactccggaccgggcccaggacgagactgaatgtaatgtatatttattacgtgttgtcgtntgtagtcgttgggtggttggttacgtttttcggtcggttcgggtaggtacgggacctagtcgttccggaccgttcgtaccgg

SEQ ID NO: 178467 - DNA, 880 bp, Homo sapiens
  misc_feature: GYAE6OF02H24CG.49.24.C02.1.454.CMB.1.raw
  modified_base (239)..(239): a, c, t, g, unknown or other
  misc_feature (239)..(239): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgctatggatcaggtgtggaatctcagactgtggtcgacccaggagccatcgttgtcaggttcggtccccgggggggacnggtacacactctacttggtggtcttgacgtctcgtggccttcgtagtctacgtaacgtacggttacctaaccccgtagccgtacgggtaacccaaggacccaaccggtaacccccgaacgggccccgaacgggcccttacccgaaccggccgaaccggaccttaccgaacgttacggttaaccggaaacttaaacgtaaaaacgttacggttaccggttcccttaccggttttaccgggtacccgggggtttaccccgttagggtaacccgttcccggttaccgttttcccgttaccgtcgggtacccccttacccgtactttacccggtttaacggggtaaaaccgtaaacggtccccgttacgtaccccttacccgtaacccgaaccggtttacccgggaacccggggggttaccccaaggggtacccgtaacgggtaactacgggtaactacgggtaaatttagggttacgttaacgttttaagtttaccgtttaagttgggtttacgtacgttaggtttcgtccgggtttgggggttacgggtttcgggttttcgtttttcgggttcgggtttaccgggacggggtaacggtacccggtaaggttcccggttacgtaccccggttccgttaacccgg

SEQ ID NO: 178468 - DNA, 662 bp, Homo sapiens
  misc_feature: GYAE6OF02H23UJ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggggacaggtcacgactcacttggtgcttgagctctggctcagtctctaactcggttactaccccagtctggtaccagcacgaccccaggccacggctaccacgcacgctcatcgacaatacaaatacgtcgctcttcgtcggggtccctgactcgctttcgtctcggcctcctagttcccgttagggaaacctaaaggtcctacgccccttacaacctaccgttaccggacccgggggccccgtaagggaccaaggtaactggaacttaggtaagttggtagttaatttaacgttacgttgttagttcgtcgttagttacgttcggttaggggttgggttcggtttccggtttttttcggtcgggtttccgggacgggtaacgggtaccggtaacgtccggttacgggtacccgttacccggttacccgg

SEQ ID NO: 178469 - DNA, 795 bp, Homo sapiens
  misc_feature: GYAE6OF02FGDKB.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggagccagtcgttgtcgacggtcggtcccccgggggggacacggtccaccacctcacgttggtcggtcttggacgtcgtcgtcggtcctacgacgttcctaccaacgttaccggttaaccctaccccgagtaccgttcggtacccacggccaaccgaccccgaggtaccaacggtcctacccgacgacccgaccgtctaccgagttacgtaacgtaactaaacctaaacgtacggtcccgtacgttaccgtttcggtccggggttaccctggtaaccttccggttcctttccgtccgttcggacccttaccgtacgttacccgtaacgggaaaccaacggtccctaccgaccccttaccgaacccgtacggacccgggtacccggggcccaagggacgacggtactacggaacttacggtaagttacggtttataaacgtttttagttaaccggttgtacgttacgtacgttagttacgggtttggtacggggtttcggttttaacgggttccggttttaccgggtacgggttcgggaaccgggttaacggactaccggttccgtaccggtacccgtttacccgtaacccgg

SEQ ID NO: 178470 - DNA, 804 bp, Homo sapiens
  misc_feature: GYAE6OF02GP4J0.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcgggtccccgggggggacaggtccaacacctcacttggtggtcgttaggacgtccttcgtgggtcctcgtacggtccttacaacgttcggttaacctacccccgagccttcggtacccagccacgaccccaggccaggcctaccgacgccgacgtctcgatagtaccgaataacaaagtacgtcgtactcgttcgtcgggtccctgtacgtcgtacttcgtcgtcggtacctccgtacgtttacccggttacgggaaaacgtaaacgtcccgttaccggtccccttaccgacccgtaaccggtcccggggtaaccccggggggtacccgaaccgggaccggtaacgggttaacgttacggaacgttaacgggaaacgtttgggttacgtaaacgtttttaacgtttaccggtttggttacggtttaccggtaattacggtttacggtttcgggttacgggggtttggggtttaccggttttaccggttttttcggggttacgggtttaccggggtaacggggtaaccggttaacgggtaacccggttcgggtacccggtttacccggtccggttaaccccggg

SEQ ID NO: 178471 - DNA, 748 bp, Homo sapiens
  misc_feature: GYAE6OF02HUZF1.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggganaggtcacactcacttgtggcttgagctctggctcagtctcaactggttacctaccccagctggtaccagccagacccccaggccaggcctccacgcacgctcatcgtaacgataacaaatgtcgcttcgttcgtcggggtccctacggatccggtctttcgtccgtgggtacccttccgtaactttcccggtttaaggggaaaacctaaaacggtccgtaccggtcccccttaccgaacccctaacgttacccggaaacccggggggtcccccaagggacccgaacggtaagttacggaacgttaggaaacgtttggttagtaacttttaacgtttaacgttggttacggttagtccgttaggttaacgttcgggtttagggggtttcggggtttcgggtttccggttttttttccgggttcgggttttcccggggtaccggggtaaccggggttaaccccgaaacgggttcccggtttaccgggtaccccggtttacccgttaaaccccggg

SEQ ID NO: 178472 - DNA, 704 bp, Homo sapiens
  misc_feature: GYAE6OF02I8JLG.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccgggggggacagtcacactcacttgtggcttgagctcgtggctcagtctcaactggttacctaccccagtctggtaccagccacgaccccaggccaggcctccacgcacgctcgatgtacgataacaaatgctactcttcgtcgggtccctgactccgtctttcgtcgtcggccttaccgtacgttacccggtttacgggaaacctaaacggtcccgttacggtccccttaccgaaccctaccgttacccgggaacccgggggtacccaacgggcctaaggacgtcgaagttagaaagttcggttaagtaacttttaacgtttacgttaggtttacgttcggttacgttacgttacggttccggtttgggggttcgggttttcggttttccggttttttcgggttcgggtttccggggtaccgggtaacgggtacccgtaacggtaccggtaccggtacccggttaccgttacccggg

SEQ ID NO: 178473 - DNA, 701 bp, Homo sapiens
  misc_feature: GYAE6OF02F98AN.49.24.C02.1.454.CMB.1.raw
  modified_base (236)..(236): a, c, t, g, unknown or other
  misc_feature (236)..(236): n is a, c, g, or t
  modified_base (357)..(357): a, c, t, g, unknown or other
  misc_feature (357)..(357): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggganagtcacactcacttgtggcttgagctcgtggctcagtctcaacttggtactaccccagctcggtaccagacacgaccccgaggccaggcctccgacgcacgctcatgtacatacaatgtcncttcttcgtcgggtccctgtacgtcgtcttcctcgttacggccttcctacgttccgttagggaaacaacgtcctcgccctacgaccctacgtccggacccgggggcccagggcgaagtacgtacgaacgtaggtaaacgttggtagtttaactttaacgttacgtttaggttacgttcgttcggttaggttacgttacggggtttggggtttcgggtttcgggtttttacccggtttttttccgggttcggggtttacccgggggtaccgggggttaaccggggtaacccggtaacgggttacccggtttacccgggttaaccccggttcccggttaaccccgg

SEQ ID NO: 178474 - DNA, 586 bp, Homo sapiens
  misc_feature: GYAE6OF02F35S0.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtcaggtcggtccccgggggggacaggtcacactcacttgtggcttgagctgtggctcagtctcaacttggttacctaccccagctggtaccagccacgaccccaggccaggcctccgacgcgaccgctcagtgacgataacaaatagtcgcttctcgtcgggtccctgactcgcttctcgtcgctcctacttccgtaggaacaacgtctacgccctacaccacgtccggaccggggcccaggcagatgatgatggtatattattacgtgtgtgtcgtgttacgttcggtgggttgggttcgtttccgtttttcgggtggttccgggtacgggtacggtaccgtagtcgtaccggtaccgttaccgtacgg

SEQ ID NO: 178475 - DNA, 627 bp, Homo sapiens
  misc_feature: GYAE6OF02GT1V8.49.24.C02.1.454.CMB.1.raw
  modified_base (531)..(531): a, c, t, g, unknown or other
  misc_feature (531)..(531): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggacagtcacactcacttgtgcttgagctctggctcgagtcctacaactggttacctaccccagcgtacggtaccagcacgaccccgaggccaggcctccacgcacgctcagtcgtacgataacaaagtacgtacgtcttcgttccgtcggggtccctgtactccgtcttctcgttcggccttcctacttccgttaggaaactaacgtcctcgccctcaaccacgtacccggaccggggacccgacgggacgagacgtagagtacgtagttagttagtatttacttagttgttgtcgtntgttacgttcggttgggttcggttcgggttcgtttttcggtcggtttcgggacgggtacggtaccgtacggtcggttacgtacccgtccgtaccgg

SEQ ID NO: 178476 - DNA, 598 bp, Homo sapiens
  misc_feature: GYAE6OF02HN0ER.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcattagtgtccccaccatggcctggatgatgcttctcctcggactccttgcttatggatcaggtgtggaatctcagactgtggtgacccaggagccatcgttgtcagtcggtccccggggggacagtcacactcacttgtggcttgagctctggctcagtctcaactggtacctaccccagctggtaccagcacgaccccaggccaggctccacgcacgctcatcgtacgataacaaatagtcgcttcttcgtcggggtccctgacttcgtcttctcgtggtcctccactcgttacgggaacaaacgtctcgccctcacctacgtccggaccggggcccaggcgagatgatagaatgtatattattactgttgtgtcgtagttagtcggttggggttggttcgggtttcgttttttcgggtcgggttccgggtacgggtacgggtaccggtaggtccgttacggtacccgttccgtaccgtaccgg

SEQ ID NO: 178477 - DNA, 661 bp, Homo sapiens
  misc_feature: GYAE6OF02HTI05.49.24.C02.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgagganccatcgttgtcaggtcggtcccggggggacngtcacactcacgttgtggtcttgagtctcgtggctcgagtcnctaacgtcggttaccaccccagtcgtcggtacccagtccgacgaccccgaggccacggcctccacgcacgcctcagtcgtacaatacaaatcgtacgtcttcgttaccggtcgggttccctagtactcgtcttcgtctcggtcctactacgttccgttaagggtaaaccaaaggccctgtcccctaccacctacggtaccggacccggggccgtaggcgagactaggacgttagagttaggtagtgttttaacgttacttggtagttcgtacgttagttcgttgggttaggggttcgggtttcggtttttccgtttttacgggtcggtttaccgggcggggtaagtaccggacgtcggtaccgtaccggtacgttacccgg

SEQ ID NO: 178478 - DNA, 574 bp, Homo sapiens
  misc_feature: GYAE6OF02HHKNL.49.24.C02.1.454.CMB.1.raw
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggggacagtcacactcacttgtggcttgagctctggctcagtctcaactggttacctaccccagctggtaccagcacgaccccaggccaggcctccacgcacgctcatgtacgataacaatagcgctcttcgtcgggtcctgactcgtcttctctgcctcactccgttaggaacaacgtctcgccctacaccacgtccgaccggggcccaggcagtatgatagagtgtagtattatacttgtgtntgtnttagtggttggttgggttcgggtttcgttttcgggtcggttcgggtacgggtacgggtaccgtaacggtccgtacggtacccggtccgtaccgg

SEQ ID NO: 178479 - DNA, 623 bp, Homo sapiens
  misc_feature: GYAE6OF02II94M.49.24.C02.1.454.CMB.1.raw
  modified_base (204)..(204): a, c, t, g, unknown or other
  misc_feature (204)..(204): n is a, c, g, or t
  modified_base (429)..(429): a, c, t, g, unknown or other
  misc_feature (429)..(429): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtgtgacccaggngccatcggttgtcagtcggtcccggggggacagtcacactccgacttgtggcttgagctcgtggctcagtctcaactcggttacctaccccagctggtaccagcctacgaccccaggccaggcctccacgactaccgctcgatcgacgatactaaatcgtcgcttcttacgtcgggtcctgactcgcttctcgtcgcctcacttcgtacgggaacaacgtctacncctaccacctacgccgacggggccaggaccngtacngtacgtagagttacgtagtatttaagttacgtgttcgttcgtcgttgttatcgggttacgggttcgggttcgggttttcgttttaccgggttcggttcgggtaccgggtaacggggtaccgtaacgggtcccgtcggttacccggttccttaacccgg

SEQ ID NO: 178480 - DNA, 880 bp, Homo sapiens
  misc_feature: GYAE6OF02GHZ9W.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccgggggggacagtcacactcacttgtggcttggagctcgtggctcagtcctacaacttcggttaacctacccccaagtccgttacgggtaaccacggtacccaaccggacccccgacggaccccgacggccctaccccgaccggaccaccggtcctccgacgttacggtaaccgtaataaactaaacgttacggtccggtaccttacgtttaccggtttccgggggtaccccttggacttccgtccttcgttcgtccggtacctaccgtacgttcccggttaagggtaaacctaaacggtcctacccggtaccctacccgaacccgtaaccgttacccgggaacccgggggtacccgaacgggtaccgtacggaaccgttaggtaacgttaaggttaaacggttgttaaacgggttttaactttaacggttttacgtttacgggtttcgttacgggtacgtttacggtttacggtttccggggtttaggggggttttaccggggttttgggttttttacccgggtttttttccggggttaccggggtttaccgggggttaaccggggggttaaccggggttaacccgggttaaaaccgggggtttaccccgggtttaacccggtttacccggggttaaccggttaaccccggg

SEQ ID NO: 178481 - DNA, 597 bp, Homo sapiens
  misc_feature: GYAE6OF02HRXU7.49.24.C02.1.454.CMB.1.raw
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
  modified_base (514)..(514): a, c, t, g, unknown or other
  misc_feature (514)..(514): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactggttaacctaccccagctcggtaccagcacgaccccgaggccaggccnccaccgcacgctcatgacgatacaaatcgtcnctcgttcgtgggtccctgactcgtcttctcgttgggtcccttccactttccgttacgggaaacaaacgtccgtcgccctaccacctacgtaccggaaccggggcccgacggcagagtacgagtagaattgtagtatttagttactgttaggtntcttagtgtcgttgggtggttcggttcgttttcgtcggttcgggtacggtacggaccgtagccgtcgtacccgtccgtaaccg

SEQ ID NO: 178482 - DNA, 630 bp, Homo sapiens
  misc_feature: GYAE6OF02GTIEQ.49.24.C02.1.454.CMB.1.raw
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccagggagccatcgttgtccaggtcggtccccgggggggacacggtcacacgtcacttgtggcttgagctctggctcagtctcacttcggttacctaccccgatccgtggtaccagccacgaccccgaggcccgaggcctaccgaccgtcacgtcctcacgtgtacgaatacaaaagtgtccacttcttccggttcgggtcctgtactcgtcttctcgtcgcctctactccgttaggaactaactcctcgtccctacaccactaccggaccgggcctacggcagtnacgntagatggtatattatattcgtnttagtcgttacgtgttacggtggggttcggtttcgggttacgtttttccgggagggtttccgggacgggttacgggtaaccgtacgggtcccttacgggtacccgtcccgttaaccggg

SEQ ID NO: 178483 - DNA, 712 bp, Homo sapiens
  misc_feature: GYAE6OF02H5SS8.49.24.C02.1.454.CMB.1.raw
  modified_base (413)..(413): a, c, t, g, unknown or other
  misc_feature (413)..(413): n is a, c, g, or t
  modified_base (598)..(598): a, c, t, g, unknown or other
  misc_feature (598)..(598): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactccttgcttatggatcaggtgtggaatctcagactggtggtcgacccgaggagccaagttcggttgtcagtcgggtccccgggggggacacggtacgaccactccaactttggtggcttggagcctacgtggactcagtcgtctaaccttggttaaccaccccagccgttggtaccagccacggacccccaggccaggcctccaccgcaccgctacattcgacgaatacaaatcggtcgccttgttcgtcgggtcccngtactcgtcttacgtctcggtcctaccctacttaccgtacgggtaaactaaacgccgtacgtcccctacgtaacccgtacggtaccgggacccggggtaccgaccgggtacgaagtaccgtaggtaacgtaggtaacgttagggtacgttacgttttaactttagttacgttcggtagtacgttnttaacgtcggttcgggtttagggttcggtttaccgttttttcggtaccggtttacggggtccgggtacggggtaacctacggtccggttacgttaccccggttcggtaacccgg

SEQ ID NO: 178484 - DNA, 684 bp, Homo sapiens
  misc_feature: GYAE6OF02HHVIN.49.24.C02.1.454.CMB.1.raw
  modified_base (236)..(236): a, c, t, g, unknown or other
  misc_feature (236)..(236): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggganagtcacactctacttggtggtcttgagtctcgtggtctcgagtcctacgtaacgttcggttaaccctaccccgagtccgtacggtaacccacgaccaaccggaacccccgacgggacccgtacggcctacccgaccgccgaccgctacagttacgtaacgaactaacaaacgtacgtcgtcttcgttcgtcgggtccctgactcgtcttctcgtcggtcctacgtactccgtaggaaacaacgtctaccgccctaccactacgtaccggaccggggtacccagggacgagtaacgtagagtaagtaagttagttagtaatttaacgttacgttgttcgtagtcgttagttacgttcggttgggttggtttcggtttcggtttttcggtcgggttacgggtacgggtacggaaccgtggtacccgttaccggtaccgttaccgtaccgg

SEQ ID NO: 178485 - DNA, 781 bp, Homo sapiens
  misc_feature: GYAE6OF02GN417.49.24.C02.1.454.CMB.1.raw
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccgaggacgccatcgttgtcaggtcggtccccgggggganaggtcacnctcacttgtggcttgagctcgtggctcagtctacgtaacgttcggttaacctaccccgagtcgtacggtacccaggaccaaccggaacccccgagggaccccgacggggtaccctaccccgaaccggccctaaccgtcccgtacgtaacgttacggtaaaccgtaacttaaaccgaaaaagttccggttaccgtaccgtttccgttttaccggtccgggggttcccctaggtaccgttccgtccttttaccgtccgtcggtcctacccgtacgttacccgttagggaaaccgtaaacgtcctaccgtaccctaccacctaccgtaccggaccggggacccagggtacagtacgtagtacgtacgtaagttacggtagtaactttacgttacgttggttagtacgtacgttagttacgttcgggttggggttcgggttacgggttttcggttttttccgggtcgggtttaccgggtaccgggtaacgggttacgaacgttccggttaccggtacccggttaccgttaacccggg

SEQ ID NO: 178486 - DNA, 589 bp, Homo sapiens
  misc_feature: GYAE6OF02G7KED.49.24.C02.1.454.CMB.1.raw
  modified_base (397)..(397): a, c, t, g, unknown or other
  misc_feature (397)..(397): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtcacactcacttgtggcttgagctctggctcagtctcaactggttactaccccagctggtaccagcacgaccccaggcccaggcctccgacgcacgctcatcgtacgatacaaactagtcgctcttcgtgggtccctgactcgcttctctcgctccntccgtaggaacaacgctcgcctacaccagtccgacggggccacggcagatgagtagagtgtagtattattacgtgttgtgtacttgtagttcggtggggttggttcggtttcgtttttcggttgggtttaccgggacgggtaacggggtacccgtaagggtccgttacggtacccggttaccgttacccggg

SEQ ID NO: 178487 - DNA, 835 bp, Homo sapiens
  misc_feature: GYAE6OF02IZ4U5.49.24.C02.1.454.CMB.1.raw
  modified_base (240)..(240): a, c, t, g, unknown or other
  misc_feature (240)..(240): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtgacccaggacgccatcgttgtcaggtcggtccccggggggganacggtcacactcacttggtcggtcttgagctctggactcagtctcgaacttcggttaacctacccccaggtcctcgggtaacccaggaccacgtacccccgagggtcccacgggtccctacccgaccggtccaaccggccttcctaacgttacggttaacccgattaaaaccgaaaactttacgggtaccgtaccttccgtttacccgggttcgggggttaccccttaggtaccgttccggtacctttccgtaccgttcgggacccttacccgtacggttccgttaacgggaaaccgtaacgtcctcccgtaccctaccaaccgtacgtaccgggaacccgggggtccaacggtaccgtaggtaacgtcggtaacgtaaggtaaccgttacggttagttaagtttaacgttacggttacggtggttacggttaccgttagggtttccggtttagggtttacggggggttcgggttttaccggggtttttaccggttttttcggggtcccgggtttaccggggtccgggtaaacggggttaaccccggtacggttaccgggtaccccgggtttaccgtaccccggtttaacccggg

SEQ ID NO: 178488 - DNA, 728 bp, Homo sapiens
  misc_feature: GYAE6OF02HHFLH.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccgggggggacagtccacactcacttgtggcttgagctctggctcagtctacaacttggttaacctaccccgagtcctaggtacccacgccgaacgacccccgaggcccacggcctacccgacggaccaccgcctacagtacggtaacgaactaactaaaagttcgtaccgtcttaccgtttccgtacggggtccctaggtacttccgtcctttcgtccgtcggtccttacctacgttccgttacgggaaactaaacggtctaccgtaccctactaaccacgtacccggaaccgggggtcccaacgggaccgaacgagtggaacgtagtaagttacggtagtaacgtttagtttaccgttggttcgttcgtacgttagttacgtcgggtttaggggttcgggtttcggtttccgggttttttcgggtaccgggtttcggggaccgggtaacgggtacccgaacggttcccggttaccggtaccccggttaccgtaacccggg

SEQ ID NO: 178489 - DNA, 681 bp, Homo sapiens
  misc_feature: GYAE6OF02FQM38.49.24.C02.1.454.CMB.1.raw
  modified_base (237)..(237): a, c, t, g, unknown or other
  misc_feature (237)..(237): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganaggtcacactcacttgtggcttgagctctggctcagtctacaacttggttacctaccccagctcggtaccaggcacgaccccaggccgaggcctccacgcacgctcatgtacataacaatagtcgtctcttcgtcgggtcctgactcgtcttctctcggtctccgtacttcccgttagggaaacctaaacggtcccgtaccgtcccctaccaaacccgtaccggtacccggggaacccgggggtccccgaacgggaccgtaaggtacgtacgtagttacggtaagttagtagttatttacgttacgttgttgttcgtacgttagttcgttacgggttggggttcgggtttcgggttttccgtttttcgggttcgggtttacgggtaccggggtaacgggtacccgtaaggtaccggtaccggttaccccggttcgttaacccgg

SEQ ID NO: 178490 - DNA, 790 bp, Homo sapiens
  misc_feature: GYAE6OF02GGZW7.49.24.C02.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagtactgtggtgacccgagggacnccatcggttgtcgaggtcgggtccccgggggganaggtcacactcacgttgtggcttgagtcttcgtcggctcgtagtcctactaacgttcggttaaccctaccccagtccgttacggtaaccagaccaacggaacccccgtagggccgacggcccgtaccgacgaccgtacgtcctcgaagttcggtaaaccgtaactaaacgaaacttacggtaccgtctttccgtttacggttacggggttcccctaggtacttccggtcctttaccgtccttcgggcccttacccgtacttaccgggttaacgggtaaacgaaacggtccgttaccgcccctaccgaccgtaaccggtacccgggacccgggggacccgagggaccgaaggtacgtagtaagttacgtaagtaggttagtaactttaagttacgttggttcgtgttacgttagttaccggttcggttaggggttcgggtttcggttttaccgggtttttcgggtttcgggttaccgggttaccgggtaacggggtaacccggtacggttacccgtaccgggttaaccccggtttaccgtaacccgg

SEQ ID NO: 178491 - DNA, 856 bp, Homo sapiens
  misc_feature: GYAE6OF02G5ZEF.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagacgtggtggtcgacccgaggacgcctagttcggttgtcgtaggttcgggtccccgggggggactacggtccaccacctctacgttggtggcttgagtctcgtggctcagtctactaacgttcggttaacctaccccgagtcgtacggaccagtaccgaaccgaccccgtaggaccctacggccctccgaccggccaccgtcctcagttcgtaacgtaataacctaaagtcgccgtacttccgtttacggtcgggtccctgtacgtcccgtctttaccgtcgttcgggccttacctacgttacccggttaagggaaaaccctaaacggccgttaccggtacccctacgaacccgttaccggtaccccggggacccgggggtaaccccgacggggaacgtaacggtaacggtaggtaaacgttacggtaaaggtttacggtttaacggttttaaattttaaccggtttacgttacggggtttcgttacggttaccgtttacggtttacggtttccgggggtttggggtttccggggttttcggggtttttccggttttttaccgggggttaggggtttaccccgggggtaacgggggtaacccggggttaacccggtaacgggttacccggttaacccgggtttaccccggtaccccgtttaacccgggg

SEQ ID NO: 178492 - DNA, 911 bp, Homo sapiens
  misc_feature: GYAE6OF02IDB9Y.49.24.C02.1.454.CMB.1.raw
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctnagactgtggtcgcccgaggcgcctntcgttgtcgtacggtcgggtcccgggggganacggtcactactctacgttggtcggtcttgacgtcttcgtggcctcgtacgttctaccgtaacgttcgttaaccctaaccccgagtccgtcggtaccacggacccgtaccgaacccccgacgggaccgtaacgggtccctaccgaccgtcccgaccgtcctaccgtacgttacggtaaccgtaaacttaaaccgttaaaacgtacccggttacgttacccctttccggtttccggggtttccggggtacccctttaggtacccgtttcccggttcccgttttacccgttccggttaccggtcccttaccgtaccgtttacccgggtaaacggtaaaccgtaaacgtcccgttaccgtaccccgtacgaacccgtaccggtaaccggggacccgggtacccgacggtacgaacgtacgtacgtaagttacggtaacgttaaggtttacttaacgtttaacgtttacggttcgttacggttacgttaccgtttagggtttaccggttcgggggttttaggggttttccggggtttttcgggtttttaccggttttttacccgggggttcggggttttacccgggggtaaccgggggttaaccggttaccggggttaacccgtttaccggggttaacccggttaccccggggtttaccccgtaaccccggg

SEQ ID NO: 178493 - DNA, 786 bp, Homo sapiens
  misc_feature: GYAE6OF02JNPSK.49.24.C02.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggatctcagactgtggtcgaccagggacgccagtcgttgtcgaggtcgggtccccgggggganagtcacactcacttgtggcttgacgctcnggctcagtctcaacgtcgttacctaccccgagcgtggtaccagccgaacggccccaggcccgacggcctaccaccggacctaccggtctccgaacttcggtaaccgattaacgaaacgttggtccgtacttccgtttacggttcggggtaccctggtacttcccgtctttaccgtccggtcgtccctcgtaccgttacccggttaccgggaaacgtaaaccggtccgttaccggtaccccgtacccgtacccggtaaccgtacccgggtaccccggggacccggtaccggtaccgtaagtacgggtacgtaacgtacggtaaatcggttaagtttaacgtttaacgtttacgttacgttcggttacgttacgttcgtttacgttgggtttacggggttgggtttacgggttttcgtttttcggggttccgggtttaccggggtacgggggttaacccgggtaccgggttaaccggttaccggtaccccggtttacccggttaccgttaaccccggg

SEQ ID NO: 178494 - DNA, 738 bp, Homo sapiens
  misc_feature: GYAE6OF02FLFS0.49.24.C02.1.454.CMB.1.raw
  modified_base (418)..(418): a, c, t, g, unknown or other
  misc_feature (418)..(418): n is a, c, g, or t
tcagagtcgagagacacgaccggtgctcgatttagtacagatcgttagggaaaggggaaaaggcccgtgacggaaaacaaacccccaggcttgggaagccttgagtaacacgtagccttcatgagtgtcccacatggcctggatgatgctctcctcggacttccttgcttatggtaatcaggtgtggaatctcagactgtggtgacccaggagccattcgttgtacacggtgggtcccccggggggatacggtctacctacctcctacttcggtacggtctttcggacgtcttacttcggcgtaccaaggttcctcgaaaccttcggttacctaaccccagtccgtagggtacccaggtaccaccggaccccgagggtcccaaggccttccgaccgtcgacgtctacaagtcggtaanacgtaactaaagtcgtcgcttaccttcggtcgggtacctgaacgttcgtacttccgtcgtccgctacccgtactacccgttagggaaacctaacggtcctcgtacccgtacctaaccaacttaccggaccggggtacccaacgggtaccaacgtaactacggtacttacgaacggttaggtaccgtaagtttaacgtaacgtttacggttcgtacgtcgttaggtactcggtaggggtcggttcggtttacgttttacggtcgggtttacgacgggtacgggtaccctaaggtccgtacgttacccggttcgttaaccgg

SEQ ID NO: 178495 - DNA, 658 bp, Homo sapiens
  misc_feature: GYAE6OF02GEB6Q.49.24.C02.1.454.CMB.1.raw
  modified_base (334)..(334): a, c, t, g, unknown or other
  misc_feature (334)..(334): n is a, c, g, or t
  modified_base (392)..(392): a, c, t, g, unknown or other
  misc_feature (392)..(392): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggagccatcgttgtcaggtcggtccccgggggggacacgtcactactcacgtttggtggcttgagcttcgtggctctagtcctcaacttggttaccctacccccagtcctggtaccagccaacgaccccgnggcccacggcctacccacgccgacgcctacacgtgtaacgaactaacaaactagtccncttcgttccgtcggggtccctagacgttccgtcttcctcgtcgccttccgtacttccgtaggaaaccaagtcctacgccctacacctcgtccggaccgggcccaggcagtagtgtaagtagtagtgtattaagtttattacgttgtcgttctgtgtacgttcggttgggttcggttcggttttccgtttttacggggtcggttaccggggtcgggaaccgggtaccgttacgggtccgttaccggttacccgtccgttaacccggg

SEQ ID NO: 178496 - DNA, 675 bp, Homo sapiens
  misc_feature: GYAE6OF02IYEPZ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggttcgggtccccgggggggacacggtcaccgactctaccgttggtcggcttgagtctcgtggctcacgttctctaaacgttcggttaacctacccctagcttcggtaccacgccaacggaccccgaggccacggcctccgacgcaccgctcatcgtaacgataacaaatcgtctctcttcgtcgggtcctgtactcgtcttctcgtcgtcctcgtactccgtaggaacaacgtctacgtccctacaccagtacccgggaccggggaccctaggccgtaagtacgtaggtagtagggtaattcggttagttaatttaacgttacgttagttcggtacgtacgttagttacgttcgggttggggttcgggtttacggtttccggtttttcggtagggtttaccgggacgggtacgggtaccgtaggtacccgttacggtaccccggttacgttaccgg

SEQ ID NO: 178497 - DNA, 712 bp, Homo sapiens
  misc_feature: GYAE6OF02JYKPS.49.24.C02.1.454.CMB.1.raw
  modified_base (278)..(278): a, c, t, g, unknown or other
  misc_feature (278)..(278): n is a, c, g, or t
  modified_base (602)..(602): a, c, t, g, unknown or other
  misc_feature (602)..(602): n is a, c, g, or t
tcagagtcgagagacacgaccggtgctcgatttagtacagatcgttagggaaaggggaaaaggccctgaggaaacaaacccagctgggaagcctgagaacacgtagccttcatgagtgtcccaccatggcctggatgatgcttctcctcggactccttgcttaatggatcgaggtgtggaatctcagactggtggtgacccagggctccatcgttgtacgaggtcggtccccggggggatagtcacgactcacttgtggccttgacgctctggcctanacgtctctaaacgttcggttaacctaccccgagtccgtacggtacacggaccagacccccgaggccaaggcctacccgacaccacggcctacgaactagtaaccgaacttaaacaaagttcgtccgtcttaccgttccgttaccgggggttccctgaacttccggtccgtttcgtcgtccgggtccttaccgtacgttaccggttaacgggaaactaaacgtccgttcgacccttaccgacctaggtaccccggcggggaacccctagggactaccgaataccgggataacgtaaagttcgtagtaacgtttgtaacttgggtnttacgtcttagtcgttcggttaggtttcgggttaccggtttgtttcgggttcgggtaacgggtacgggtacgggtaccgtacggtccggttaaggtacccgtcgttaccg

SEQ ID NO: 178498 - DNA, 709 bp, Homo sapiens
  misc_feature: GYAE6OF02HGPWR.49.24.C02.1.454.CMB.1.raw
  modified_base (427)..(427): a, c, t, g, unknown or other
  misc_feature (427)..(427): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtcccgggggggacagtcacactcacttgtggtcttgacgctcgtggctactacgtctacaacgttcggttaaccctaccccgagccgttacggtacccagaccgacgacccccgagggcccgaggcctacccgacgcacgctcgatacgtacgactaacaaatcgtccgacttcttcggtcgggtccctgtactcgtctttcncgtcggtcctccgtacgttccggtaggaaactaacgtcctaccgtcctaccaacctacggtaccgggaacccggggacccgacgggctaaggacgtaggtaacgtgtaaacgttggttaagtagttttaacgtttgttggttcgtacggttctttaggttacggttgggtttcggggtttacgggtttcgggttttccgtttttcgggtgggtttacccgggggtacgggtacggggaaccctagggttcccgtaccgggttacccgttcccggtaacccgg

SEQ ID NO: 178499 - DNA, 601 bp, Homo sapiens
  misc_feature: GYAE6OF02F41B3.49.24.C02.1.454.CMB.1.raw
  modified_base (238)..(238): a, c, t, g, unknown or other
  misc_feature (238)..(238): n is a, c, g, or t
  modified_base (378)..(378): a, c, t, g, unknown or other
  misc_feature (378)..(378): n is a, c, g, or t
  modified_base (417)..(417): a, c, t, g, unknown or other
  misc_feature (417)..(417): n is a, c, g, or t
  modified_base (517)..(517): a, c, t, g, unknown or other
  misc_feature (517)..(517): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacgttgtggcttgagctcgtggctcagtctacaacttcggttacctaccccagtcctacggtaaccagaccaacgaccccgaggccgacggcctccgaccgccacgctcatcgtacgatacaaatagtcncttcttcgtcgggtcctgactcgtcttctgtcgctaccncttcgtacggaacaacgtctacgccctacacctacgtccggaccgggcccaggcgagagtagtagtagagtgtacgtaatttagttacgttgttgtcgtnttgtagttcggtgggtcggtttggttcgttttcggtggttccgggacggtacggaccgtagccgtacgtcccgttacgtaccgg

SEQ ID NO: 178500 - DNA, 573 bp, Homo sapiens
  misc_feature: GYAE6OF02H14FR.49.24.C02.1.454.CMB.1.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccgggggganagtcacactcacttggtggcttgagctctggctnagtctcaactggttaccaccccagctggtaccagcacgaccccaggccacggcctccgacgcacgctcatcgtacgataacaaatgtcgcttcgttcgtcgggtccctggactccgtcttctcgtcggccttccattccgtagggaaacctaagtcctcgccctacaccacgtaccgaccggggcccaggcagatgatgaatgtatattatacgtgtgtgtctgttactcggttgggtggttcgtttcgttttggtcggttcgggacggacggtacctacgcgtacggtacccgttccgtacgg

SEQ ID NO: 178501 - DNA, 652 bp, Homo sapiens
  misc_feature: GYAE6OF02F1CNE.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganagtcacactcacttggtggcttgagctcgtggctcagtctcaacttcggttacctaccccagtctcggtaccagcacgaccccgaggccaggcctccgacgcacgctcatgacgataacaaatcgtcgtcttcgttcgtcgggtccctgactccgctttcgtcgtcggctcctattcgtacgggaacaacgctccgccctacaccgacgtaccgggaccggggacccgaggacctagagtagacgtagtaagtgtagttactttattacgttgttcggtagtcgttagttcgttgggtttggggttacgggttttcggtttccggttttttcggggtcgggtttaccggggtacggggtaacgggtacccgttaagggtcccggttaccgggttacccgttcccgttaacccgg

SEQ ID NO: 178502 - DNA, 630 bp, Homo sapiens
  misc_feature: GYAE6OF02H3489.49.24.C02.1.454.CMB.1.raw
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggttgtggaatcgtcagactgtggtgacccgaggacgccagttccgttgtcaggtcgggtccccggggggganaggtcacactcacgttgtggtcttgagctcgtggtctcagttcnctaacttggttaccacccagtcgtcggtaccngactacgacccgaggccaggcctcgacgctacgctcgatgtaacgataacgaatacgtcgcttcttcggtacgggtccctgacttcgtcgtttctcgtcgctccagttcccgtaagggaaactaacgctaccgtccctacgaacctacgtaccggaccggggccaggtaccagactgagtacaagtgtagtactttaagtcgtggttcgtagcgttgtactttcgggtgggtacggtttcggtttacgttttggtacgggttccggcgggttaacggacgtagttccgtacggttcccgtacgtccgg

SEQ ID NO: 178503 - DNA, 750 bp, Homo sapiens
  misc_feature: GYAE6OF02HRAS5.49.24.C02.1.454.CMB.1.raw
tcagagtcgagagacacgaccggtgctcgatttagtacagatcgttagggaaagggaaaaggccctgaggaaaacaaaccccagctgggaagcctgagaacacgtagccttcatgagtgtccccaccatggcctggatgatgcttctcctcgactccttgcttatgatcaggtgtggaatctcagactgtggtgacccaggacgccatcgttgtctaggtcgggtcccgggggggacagtccacgactctacttgtggtcttgagctctggcctcagtctacaacgtgttaacctacccagtcgtggtaccagcacgaccccgaggtcccaggcctccgacgccaccgcacagtagtacgaataacaaagttgtcgtctcgtttaccgtcgggttccctagtaccgttaccgtcgtttccttcgtacggtccttacccgtacgttccccgttaagggtaaacctaaggacctccggaccctcaacccgtacgtccgggaacccggggtcccgacggacgaacggtaacgtgtaacgtagagttacgtaggttaactttacgttacgttcgttcggttacggtacgtttacgttacgtttacggtttagggggtttccgggttttcggtttccggtttttttaccggggttccgggtttacccgggggtaaccggggtttaaccggggttaacccggtaaaccgggttaccggtttaccggttaacccccgggttaccctttaaccccggg

SEQ ID NO: 178504 - DNA, 778 bp, Homo sapiens
  misc_feature: GYAE6OF02JNOR6.49.24.C02.1.454.CMB.1.raw
  modified_base (475)..(475): a, c, t, g, unknown or other
  misc_feature (475)..(475): n is a, c, g, or t
tcagagtcgagagacacgaccggtgctcgatttagtacagatcgttagggaaaggggaaaaggaccctgaggaaaacaaacccagctgggaagcctgagaacacgtagccttcatgagtgtcccaccatggcctggatgatgcttctcctcggactccttgcttatggatcaggtgtggaatctcagtactgtggtgacccaggagccattccggttgtcgtagttcgggtccccggggggggacacggtcaacacgtcctactttggtcggtctttaggagtccgtcgttggcttcgaggtcctcctaaacgtcggtttacctacccgtagctcggtaccaacggccgaccgtaccccgaggcccaggacctccaccgcaccgccttcacttcggtaaccgattaaaccgaaagttaccgtacgtctccgtttacgtcggggtccctgtactccgtctttactcacggtttccncctactttccccggtttaaggaaaccgtaaacgtccttacggtcccctacgacctaccgtaccgggtacccggggccccgtaagggaccgtaccgacgtacggaacttacggtaaacgttcgttacggttaacgtttatttaaccgttgttcggttacgtacgtttacgtacggtttcgggttggggtttaccgggttgggtttttccttttttacggggtcgggtttccgggaacgggggtttaacccggtaacggttaaccggtcggtttccgggttaaccccggtcccgtttaaccgggg

SEQ ID NO: 178505 - DNA, 1180 bp, Homo sapiens
  misc_feature: GYAE6OF02FTBLI.49.24.C02.1.454.CMB.1.raw
tcagagtcgagagacacgaccggtgctcgatttagtacagatcgttagggaaaggggaaaaggccctgaggaaaacaaaccccagctgggaagcctgagagcacgtacgtccttcagtgagtccgtaccccacctagtcggtccgtaggatgtagtcgtctttcctccgtaccggtaccttccgttgtacttagtggactacggtaggttggtaggtaacttcctacgaacgtcgttgggttcggtaccgaacccggagggtaccgtaccttacgtttcggtttcgtaccggttacggggttaccccgggggggtaccccgggggtataccggtaacctaaccgtaccttaccgttacggtttcggtacggttaccgttggaccgtccgttcgtcggtccttacgttaccgtaccttacgttaaccggtttacccggttaacccctaacccgtggttcccggttaaccggtaaccgacggaccccggaaacccccggtacccgggtaccgggacccgtaccgggtacccctacccggaacccgtaccgaacccgtcctaagttacggttaaccgttaacgaaaccttaaacgtaaacgttcccggtaaccgtttacccgtttccggtttacccggggttacccggggtacccctaggtttaccccgttcccgtttaaccgttttcccgttcgggtacccgtttccctaacccgggtttaacccggttttaacccgggtaaaaccgggtaaacctaacccgggttcccgttaaccccgtaccccgttaacccggtaaccggtacccccggggttaaccgggggacccccgggggtaaacccgttaggaaccggttaaacgtaccggtaagggtttaaccgttacgggaaaggttttttcccggttaaagggttttttaaaccttttcccgggttaacgggttttacgggttaccggtcggttttaacccgggtttacgggtttttacggggtttaccgggggtttccggggggttttttaacccggggtttttttaaccggtttttttccggggggttttttacccccgggggttaaggggggtttaacccgggggtaaccccgggggtttaaacgggtttaaccccggtaacgggttccccgggtttttaaccccggtttaccccggtaaacccccgggg

SEQ ID NO: 178506 - DNA, 650 bp, Homo sapiens
  misc_feature: GYAE6OF02FTD5L.49.24.C02.1.454.CMB.1.raw
  modified_base (125)..(125): a, c, t, g, unknown or other
  misc_feature (125)..(125): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (510)..(510): a, c, t, g, unknown or other
  misc_feature (510)..(510): n is a, c, g, or t
tcagagtcgagagacacgaccggtgctcgattagtacagatcgttagggaaagggaaaggccctgaggaaaacaaaccccagctgggaagcctgagaacacgtagcctcatgagtgtccccaccntggcctggatgatgcttctcctcggactccttgcttatggatcaggtgtgaatctcagactgtggtcgacccagganccatcgttgtcagtcgtcccccggggtanagtcacacctcacttggtggctttggacgctcgtgctcngtcctcaaccgttcggtacctacccccgagtcctcggtacccagcacgacctagcgacggtctccaccgccaccgctccactcgtaaccgataccaacttacgcgtccttcgttcggtcgggtacccctgacgtccgtccttccgtccgtcgcctccgacttccgtacgggaacaacgcctcgcccctacacccacgtccgaccgggtcccaaggtcaagtcgttcgacttagtaacgtnttacgtaactttacgtttaacgttcggtattcggtcttcgttacttcggtggttacggttggtccgtttaccggttcggtacccgggtaccgggacgggtacccaaggttcccgtacggtaccccggtacccgttaccgg

SEQ ID NO: 178507 - DNA, 956 bp, Homo sapiens
  misc_feature: GYAE6OF02HR2UO.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgaccgaggtagccagtcgttgtcgaggtccgggtccccgggggggatacggtcacgtactcgtaccgttggtcggtcgttaggacgtccttcgtcggtccttcgtacgttccgttaccgtaaacgtttacggtttaaccccgtaacccccgtacggtaccgttaccgggtaacccgacggacccaaccggtacccccggacgggacccgtaccgggcccgttacccgaaccgtcccgaccggtccttaccgagttaccggtaaaccgtaacgttaaaccgtaaacgttaccgtacccgtcctttaccggttttaccggttacccgggggttccctaaccggttccttcccggtttacccttttccgttcccggttccggttaccccgtttaccccgtttaccggtttaccccggggttttaaaccgggaaaacccggttaaaacgtccccggttaccgtacccccgttaaacccggtaccccgttaaccgggtaaccccggggtaccccggggggaaccccgttacgggaccgtaaacggtccggtaagtaaccggttaagtacgggtttacgttaacgtacgtttttaacgttcggtttacgttggtaccgtaggtttaggtacggtttcggggttagggtttccggggtttcgtttttccgggtttttgggtcccggggtttaccggggtcggggtaaaccggttaccggtacggttacccggttacccggttacccggttacccggttacccggg

SEQ ID NO: 178508 - DNA, 977 bp, Homo sapiens
  misc_feature: GYAE6OF02HBFOX.49.24.C02.1.454.CMB.1.raw
  modified_base (235)..(235): a, c, t, g, unknown or other
  misc_feature (235)..(235): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtcccaccatggcctggatgatgcttctcctcggactcctgcttatggatcaggtgtaggaatctcagactgtggtgacccaggacgccagtcgtgtcgaggtcggcccgggggganacgtccgtaccactcaaccgtttgtacggtcgttggacgtcctcgtacggtcctcgtacgtccttactaaccttacggttaaccctaaccccgtagtccgttacggttaacccgacggacccgtaaccggacccccggtaacggaccccgaacggccctaaccgaccggaccgtacccggaccttaccgtaacgttaccggttaaacccgaaaagttaaaccgtaaaacgttaacgggttacccgtaccgtttaacccggttttcccgggtttaccgggggttacccctttcgggtaaaccgtttcccgttaccgtttttacccgtaccggtttccgggtaccccgtttaccccgttaaccgtttaccccgggtttaaacggggtaaaaccctaaaacgggttcccggttaaccctacccccggttacccgaaaccccggttacccggttaaccccggggaaccccgggggggttacccaaacggggttaaccccgtaagggtaaccgtaacggtaacggtaacggtttaacggttacggtaacgtttaacgtttaaacggtttacggttacgtttcgggttacggttacgtttaacggttcgggttaccgggttaggggtttacggtttccgggtttttccggtttttacggggtccgggtttaccggggtaaccgggtaccgggttaacggtaaccgggttccgtaaacccggttaccccggttacccgttaaccccggg

SEQ ID NO: 178509 - DNA, 550 bp, Homo sapiens
  misc_feature: GYAE6OF02F6DSG.49.24.C02.1.454.CMB.1.raw
  modified_base (476)..(476): a, c, t, g, unknown or other
  misc_feature (476)..(476): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagctcggtaccagcagaccccaggccaggcctccacgcacgctcatgtacgatacaaatgtcgctcttcgtcggggtccctgactcgcttctctcggctccatccgttaggaacaagctcgccctcaccatccgaccggggcccaggcagatgatgaatgtagtatttattactgtgtgtctgtntcgtgggtggttggtcgttttcggtcggtttcggcgggtacgggtaccgaggtcgtcggtacccgtcctaccgg

SEQ ID NO: 178510 - DNA, 574 bp, Homo sapiens
  misc_feature: GYAE6OF02F23YI.49.24.C02.1.454.CMB.1.raw
  modified_base (238)..(238): a, c, t, g, unknown or other
  misc_feature (238)..(238): n is a, c, g, or t
  modified_base (364)..(364): a, c, t, g, unknown or other
  misc_feature (364)..(364): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtggtccccgggggggganagtcacactcacttgtggcttgagctctggctcagtctcaacttggttaacctaccccgagctggtacccagcacgaccccaggccaggcctccacgccacgctcatcgtacgatacaaatcgtcncttcttcgtcggggtccctgactcgcttctcgtcggcctctatcccgttaggaacgaaagctcgccctcaccacgtccggaccggggcccagggccagatgatgaatggtgtattattacgtgtgtgtcgttgtagttgtgggttggttggttcgtttttcggtggttcgggtgggacgggtaccgaggtccgtcggtaccgtctaccgg

SEQ ID NO: 178511 - DNA, 806 bp, Homo sapiens
  misc_feature: GYAE6OF02IDJFD.49.24.C02.1.454.CMB.1.raw
  modified_base (643)..(643): a, c, t, g, unknown or other
  misc_feature (643)..(643): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggatctcagactgtggtgacccaggacgccatcgttgtcaggtcggtccccgggggggacaggtcacactctacgttgtggtcttgagtctctggtctcagtctctaactggttacctaccccgagcctacggtacccagcccgaaccggacccccgacgggacccgtacgggccctaccccgaccggtaccaaccggtcctccgtaacttacggttaacccggtaaataaaaccgaaaacgtttacgggttaccgtccttaccgtttccggttacggggttccccttaggtacttaccgtccttttccgttccgtacgggtccttaccctacgtttacccgtttaacggggaaaacctaaaccggtccctccggtaccccgtaccaaacccgtacggttaacccgggacccggggggacccctaaggggtccaaggtacgtacgaaagttacggaattagggtntaaagtttaacgttacgtttgtacggttgaccgttgtttagttcgggttaggggttttgggttcggttttacgtttttccgggttcgggtttaccgggggaccggggttaacgggacccttaaacgggtcgtttacccggtaccccggtttcccgtaacccgg

SEQ ID NO: 178512 - DNA, 689 bp, Homo sapiens
  misc_feature: GYAE6OF02HUX4T.49.24.C02.1.454.CMB.1.raw
  modified_base (482)..(482): a, c, t, g, unknown or other
  misc_feature (482)..(482): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatcggcctggatgatgcttctcctcggactccttgcttatggatcgaggtgtggtaatctcagactgtggtcgaccaggacgccattcgttgtctaggtccgggtacccgggggggacacgtccacgtactctacttggtggtcttgacgtctcgtggtctctacgttctacgtaacgttcggttaccctacccctagtcgtacggtaccacgccaccgaccccgtacggaccacggtcctccgaccgcaccgtctcgtatcggtacgaactaaactaaatacgtccgtcttcgttacggtcggtcctgtcgtcgttcttctcgtcgcctctacgtcgtaacggaactacgtcncgtacctacacctcgacggaccgggacctaggccagtactacggatgtaacgtgttagtatttagttacgttggttcgtacgttagttacgtagttcgggtttgggttccggtttggtttttccgggtttttccggtagggtttcccggacgggtaacgggtaccgtaccggttaccggttaacccggtcccggtttaacgtcccgg

SEQ ID NO: 178513 - DNA, 572 bp, Homo sapiens
  misc_feature: GYAE6OF02FG2H9.49.24.C02.1.454.CMB.1.raw
  modified_base (238)..(238): a, c, t, g, unknown or other
  misc_feature (238)..(238): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcggtccccggggggganaggtcacgactcacttggtggccttgagctctggctcagtcctacacttggttacctaccccagctggtaccagcacgaccccaggccaggcctcgacgcacgctcatcgtacgatacaaatgtcgctcgttcgtcggggtccctgactccgtcttctcgtcggtcctacctacttccgtagggaaacaaacggtcctacgccctacaccacgtccggaccggggccaggcagatgatagatgtagtattattcgtgtgtgatgtatcgtagggtggttgttcgttttcggtgtccgggtaggacggactacggtctcggtccgtaccgtacgg

SEQ ID NO: 178514 - DNA, 914 bp, Homo sapiens
  misc_feature: GYAE6OF02H02IO.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtaggaatctacagactggtggtcgacccgaggacgcctagttcgttcgtacgtacggttccgggtaccccgggggggactacggttaccgacctaccttaccgtaccgtttggtcggtccgttggacgtcttacgtcggtcctctacgttcctactaacgttcggttaaccctaccccgagtccgttacggtaaccacgaccgaaccggaccccgtacgggacccgacgggtaccctacccgaaccggccgaccgtccttacgtaacgttacggtaaccggtaaacttaaaaccgtaaacgttcggtacccgttccgtttaccggtttaccgggtttcccggggttaccctaggtaccgttccgttaccgttttccgtccgttccgggtcccttacccgttaacgtttcccggttaaagggaaaccctaacggtcccttacccggtacccaaccgtacccgtaccggtaccggggaccccggggtacccgaggtaccgaaggttacgtacgaacggttagtaacggttaggttacgttaagttttaacgttcggttacgtttgggtaccgtttacgttaggtttccgtttacgggggtttcgggtttacgggttttaccggttttttccgggtttttaccggggttcggggttacccggggtaacggggttaacccgggtaccggttaaccggttacccgggttaacccggtcccccggtttaccggtaaacccgg

SEQ ID NO: 178515 - DNA, 793 bp, Homo sapiens
  misc_feature: GYAE6OF02FJKWF.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgaccgaggcgccagttcgttagtctaggtccgggtccccggggggatacggtccgacacctctacgttggtcggtcttggagtctcgtggctctgtctcgaacgttcggttacctacccccagcgtacggtaccacgtcaaccgaccccgaggcccaggcctaccaccgcacgcctacattcggtaacgactaacgaaactaggtcgtacttccgtttaccgtccggggttccctaggaacttcccgtactttccgtccgtcgggaccttcctaccgttccggtaacgggtaaaccaacggtccgtacctccccgtacctaacccgacgttacccggggaccccgggggtacccgaaccgggtccgaacggtacgtacggtaaacgtacggtaacggttacggttagttaaacgttttacgtttaacggttgggttcttagggtcctttacgttaaggttccgggtttggggttacgggtttacggggttttcccgttttttcggggttaccgggtttccgggggtaaccggggtacggggtaacccgtacgggttcccggtaacgggttaccccggttacccgtttaacccggg

SEQ ID NO: 178516 - DNA, 553 bp, Homo sapiens
  misc_feature: GYAE6OF02FQEW2.49.24.C02.1.454.CMB.1.raw
  modified_base (237)..(237): a, c, t, g, unknown or other
  misc_feature (237)..(237): n is a, c, g, or t
  modified_base (426)..(426): a, c, t, g, unknown or other
  misc_feature (426)..(426): n is a, c, g, or t
  modified_base (486)..(486): a, c, t, g, unknown or other
  misc_feature (486)..(486): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggganaggtcacactcacttgtgcttgagctctggctcagtctcaacgttcggttacctacccagctggtaccagcacgaccccaggccaggcctccacgccacgctcgatcgacgatacaaagtgtccgctcttcgtcgggtccctggacttcgctttcgtcgtcgcctctactcgttaggaacctaagctcncctcacctcgcggaccggggccaggcagtctagatgatgtatacgttattcgtgtgtgtntgtattcggtgggtgttgttcgtttcgtcggttcgggcgtacggactacgtgccggttactcgtacg

SEQ ID NO: 178517 - DNA, 585 bp, Homo sapiens
  misc_feature: GYAE6OF02GFR21.49.24.C02.1.454.CMB.1.raw
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
  modified_base (460)..(460): a, c, t, g, unknown or other
  misc_feature (460)..(460): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttacctaccccagcctggtaccagcacgaccccaggccaggcctccgacgccacgctcatcgtacgataacaatagtcnctcttcgtcggggttccctggactctctttctctggcctccncttccgtaggaaccaaagctacgccctcaccacgtccgacgggggtcccagggcaggancggtatagaagtgtgtaatttactacgttgtcgtgtctgttatcgtgggtgggttcgttcggttttggttggttcgggcgggtacgggtaccgtacggtccgtacggtcccgttaccgtaaccgg

SEQ ID NO: 178518 - DNA, 689 bp, Homo sapiens
  misc_feature: GYAE6OF02FSS0F.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgacccaggacgccatcgttgtcaggtcgggtcccgggggggacacgtcaccactctacgttggtggtcttggagtcctcgtggctcagtcctacaacgttcggttaaccctacccagtcctcggtaccacgccaaccgaccccgacggccacggcctaccacgccacgtctacatacggtaactataacaagtagtccgtcttccgttcggtccggggtcctggtactccgtctttccgtcgtcggccttccgtacttaccggttaacgggaacaaacgtcctaccgtccctacctaccgtacggtacccggacccggggaccgaggtacgtagacgtacggatacgtagtacgtcgttaatttacgttacgttggttagtcgttgttagttcgttcgggttggggtggtttcggtttccgttttgggttaccggttcgggtacgggtacgggtaactacggtccggttaccgtacccgtaccgttacccgg

SEQ ID NO: 178519 - DNA, 656 bp, Homo sapiens
  misc_feature: GYAE6OF02JFMU3.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcgagtcgggtccccgggggggacacgtcacactctacttgtggcttgagctcgtggctcgagtcctactaacttcggttaacctaccccgagcgttcggtaacccaggccaaccggaccccacggcccgacggtcctccgaccggccaccgcctacatacgttaaccgaattaacaaaacgttacgtcctacttcctttacggtcggggtccctgtactccgtccttctcgtcggctcctagttccgtacgggtaaacaacggtctccgtccctacacccacgtccggaccggggtcccgaggacacgtactgacgtagtaactgtagttattagttacgttgttcgtgtcgttgtacgttggttagggtggttcggtttcgttttcgggttggtcgggtacgggacggtaaccgacggtctacgtacccgtgtacccg

SEQ ID NO: 178520 - DNA, 834 bp, Homo sapiens
  misc_feature: GYAE6OF02IQPDL.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtgatctcagactgtggtcgaccaggagccatcgttgtctaggtccgggtcccggggggacagtaccacactacctacgttgtcggtcgttagcgtccgttcgtagggtcctacgtacggtccttaccgtaacgttcggtttaaccccgtaaccccctaggtacccgttaacggtaaccccgacgtaccgaaacccgaacccccgaacgggtacccggaacgggcccttaaccccgaaccggcctacccggtaccttacacgttacggtaacgtaactaaacctaaaacgttaccggtcttacgttcctttacggacccgggttccctaggtacctccgtactttcggtccgttacggtccctaccgtacgttacccgtttaaacgggaaactaacggccgtaccctaccctaccgtaccctacggacccgggtacccggggaccgtaacccggtacgaacggtccgtaaggaacttacggtaattagggttaacttaagtttaactttccggttagttacggtcgttaacgttcgttacggttaccgggtttggggttcggtttaacggtttttcccggtttacgggtttcgggtaccggggtaccggtaacggtaccgtacggttaccgtacccggttaccgttaccgtaaccgg

SEQ ID NO: 178521 - DNA, 660 bp, Homo sapiens
  misc_feature: GYAE6OF02HESOJ.49.24.C02.1.454.CMB.1.raw
  modified_base (207)..(207): a, c, t, g, unknown or other
  misc_feature (207)..(207): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggganccatcggttgtcagtcggtccccggggggacaggtcacactcacttgtggcttgagctcgtggctcagtctcaacttggttacctaccccgagctcggtaccacgtcacgaccccagggccctaggcctccacgcaccgctcgatacgacgaatacaaatgtcgtctcttcgtcgggtcctgacgtcgtcttcgtcgtcggcctccgtacttccgtaagggtaaaccgaaacgtccgtaccgtccctaccgtacccgtaacgtacccgggacccgggggaccccgaacggtccgaacgtacgtacgtagtacgaagttacgttagtaatttacgttacgtggttagttgtacgttgtacgttaggttcggggttgggtttcggttcggttttttcggtacggttacggggacggtacgggtaccgaagtccgtacggtacccgtccgtaacgg

SEQ ID NO: 178522 - DNA, 726 bp, Homo sapiens
  misc_feature: GYAE6OF02HW2VV.49.24.C02.1.454.CMB.1.raw
  modified_base (92)..(92): a, c, t, g, unknown or other
  misc_feature (92)..(92): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
tcagagtcgagagacacgaccggtgctcgatttagtacagatcgttagggaaagggggaaaagggaccctgaggaaaacaaaccccaagacngggaagcctgagaacacgtagccttcatgagtgtccccaccatggcctggatgatgcttctcctcggactccttgcttatggatcaggtgtggaatctcagactgtggtgacccaggcgccagtcgttgtcaggtcgggtcccggggggganacggtcacnctctacgtgtggcttgagtctcgtgtctctacggtctactaactcggttaccacccgtagtcgtacgtaccacggtaccacgtacccacggccacggcctaccacgcaccgctacacgtcgtacgaactaactaaacgtattccgcttacttcggtccgggttcctggtactcgttaccgttccttcgtccgtcctaccgtacgttccggttacggaaaccgtaacgtccgtaccgtcccgtaccaacccgtaccgtaccgggacccggggacccggaccggtaccgaacggtacggtacgaacggttacggtacgttacgtaggtttaactttacgttacgttacggtcgttacgtcgttagttacgtacgggtttggggtaggtttccgggtttgtttttcggtacggggtttcgggtcggggtaccggtacggtacggttccgtaccggttaccggtaccgttacccggg

SEQ ID NO: 178523 - DNA, 576 bp, Homo sapiens
  misc_feature: GYAE6OF02GEZL4.49.24.C02.1.454.CMB.1.raw
  modified_base (357)..(357): a, c, t, g, unknown or other
  misc_feature (357)..(357): n is a, c, g, or t
  modified_base (483)..(483): a, c, t, g, unknown or other
  misc_feature (483)..(483): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtggtccccgggggggacagtcacactcacttgtggcttgagctctggctcagtctcaactggttacctaccccagctggtaccagcacgaccccaggccaggctccacgcacgctcatgtacgataaccaaatagtcnctcttcgtggggtcccctgactccgctttctcgttcggcctccattccctagggaaaccaaagctcgccctcaccactcgaccggggcccaggcagatgatagaatgtatattattacttgtgtcncttagtacgttcgtgggttgggttggttcgtttttcggtcggtttccggagggtacggaccgtaaggtcgtacggtacccgttcctaacccgg

SEQ ID NO: 178524 - DNA, 599 bp, Homo sapiens
  misc_feature: GYAE6OF02FL77U.49.24.C02.1.454.CMB.1.raw
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
  modified_base (510)..(510): a, c, t, g, unknown or other
  misc_feature (510)..(510): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggtaatctcagactgtggtcgacccgaggagccatcgttgtcaggtcggtccccgggggganagtcacactcacttgtgtcttgagctcgtggctcagtctacacttggttacctaccccagcgtcggtaccngacacgaccccgaggccgaggcctaccgacgccacgtctacagtcgtaacgaataactaaatcgtctcttcgttacgtcgggtccctgtactcgtctcgtcgtcgtctcctagtccgtaggaactaacgtctcgccctacaccgtagcccggacgggcccaggcgagagtgagagtagtgtatattagttcgtagtgtncgttgtagttcgtgggtggttgtttccgttttgggtcgggttcggacgggtacggaccgtaggtaccgtacggttacccgtacctacgg

SEQ ID NO: 178525 - DNA, 714 bp, Homo sapiens
  misc_feature: GYAE6OF02IV93I.49.24.C02.1.454.CMB.1.raw
tcagagtcgagagacacgaccggtgctcgatttagtacagatcgttagggaaaggggaaaaggccctgaggaaaacaaacccagctgggaagcctgacgaacacgtagccttcatgagtcgtccccaccatggcctggatggatgcttctcctcggactcctgcttagtggatcgaggtgtggaatcgtcagacttgtggtcgaccgaggacgccagtcgttgtcgaggtcggtcccggggggatcgtcacgtactcgtaccgtgtcggtcttgacgtcttcgtcgcctatacgtctactaacgttcggttaacctcccgagtcgtcggtaccgagtccgacgaaccccgtacggcctacggcgtaccgacgcgaccgctacgacgtacgtaacgtaactacgaaagtacgtccgtacttccgttcggtacgggttccacgttacgtccgtccttcgtccgtaggccttaccgttaccgtacgtaacggaaacctaacggtacctcctaacccgtcaaccgtcgtaaccgggacccggtcgaccggacgtaacgtacaggtacgtagaacgttagtaccgtaatttagtaccgttagtcgttcgacgttagttcgttagggttcggttacggttaggtttccggtttggtccgggttacggacgggtaccgtaccggtaaggttcccggtaacgttcccggtacttacccgggg

SEQ ID NO: 178526 - DNA, 729 bp, Homo sapiens
  misc_feature: GYAE6OF02H63GI.49.24.C02.1.454.CMB.1.raw
  modified_base (246)..(246): a, c, t, g, unknown or other
  misc_feature (246)..(246): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccacatggcctggatgatgcttctcctcggactccttgcttatggatcaggtgtggaatctcagactggtggtacgacccgaaggcgccagttcggttgctaggtcgggtacccggggggganacggtccactacctacgtacgttgtgggtcttagacgtcttcgtggctgagtctctaacgtcggtaacctacccgagtcgtcggtaaccagtccaacgaccccgaggccctacggcctaccacgcacgtaccgtactacgtcgttaaccggaacttaaacgaaatacgggttcacccgtttcgtttaccggtcgggggttaccctaggtcttaccggtacttttccgcgttacggtcccgtccttacgtacgtacgggtaaaaccgtacgtaccgtccgtaccctaccgtacccacgggtaccggacccggggacctacggagacgtacgtagagtagtagttacgtatacttacgttacgttggtcgttagtcgttaggtacgttacggttagggttcgggttcggtttccggtttttacggcgggtttacgggaccgggtacggaacggtaccgtacggtaccgtaccgttaccgtaccgg

SEQ ID NO: 178527 - DNA, 767 bp, Homo sapiens
  misc_feature: GYAE6OF02IQTDN.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactccttgcttatggatcagtgtggaatctcagactgtggtgacccaggtacgccattcgttgtcaggtcggtcccggggggacagtcaacgtactcaccgttgtcgacttgacgctaccgtggtcctcgacgtcctacgaacgttcggtttaaccaaccccgagtcgtcggtaacccagcccgaacggaccccgaggccgtaggccttaccgaccgccaacgtccgtacactacggtaacgtaataactaaaactacgtaccgtactccgtttaaccggtcgggtacccttaggtacttccgtacccgtttcccgttagggaccctttccgaacgtttcccgttacgggtaaaactaaaacggtcctaaccggccccttaacgaccaacgttccccggaaccggggtaccccgaagtacccgaagtacctagaacgtcgtaacgttctaggttaactttaacgttacgttaggtacggtttaccgtacggttaagttcgtacggttcgggggttagtttccgggtttacgttttttccgggtacgttacggggtaccggtaaagggtacccgtaaggtttcccgacggtacccggtaccgttacgtaacccgg

SEQ ID NO: 178528 - DNA, 576 bp, Homo sapiens
  misc_feature: GYAE6OF02HY8FH.49.24.C02.1.454.CMB.1.raw
  modified_base (236)..(236): a, c, t, g, unknown or other
  misc_feature (236)..(236): n is a, c, g, or t
  modified_base (538)..(538): a, c, t, g, unknown or other
  misc_feature (538)..(538): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtcccggggggganagtcacactcacttgtggcttgagctctggctcagtctcaactggttacctaccccagtctggtaccagccacgaccccaggccaggcctccacgcacgctcatgacgataacaaatcgtcgcttcttcgtcgggtccctgactcgctttctcgtcgcctccatccgttaggaaacaagcctcgaccctcacctacgtccgaccggggacccaggcagacgtgatgtaagtgtagtattagttagtgttagtgtcttgtagttcgttgggtggttcggtttcgttttcggttggttccgggngggtacgggtacctagtccgtcgtacccggtctaccgg

SEQ ID NO: 178529 - DNA, 869 bp, Homo sapiens
  misc_feature: GYAE6OF02GSM97.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacctccttgcttatgatcaggtgtggaatctcagactgtggtcgacccaggagccattcgttgtcgaggtcgggtaccccgggggggacagtcacacctctacgttggtcggtcttggacgtcttcgtggtctcgtacgtcctacgtaaccttacggttaccctaccccgagtccgtcggtaaccacgaccaccgaaccccgtacggaccgtacggcctacccgaccgcacccgtacctctacgttacgtacggtaactaaacgtaaagtccgttcgtccctttcgttacggtttcggggtacccttgtacgttcttccgttcctacggtccggtcctcccgttacgttacccggttacgggaaaaccgtaacgtcccgttacccgtacccgtacccgaaccgtacccggttacccgggacccgggggaaccgtaccgggaccgtaacgggtacgtacggtaacggttaacggttaacttacggttaagttttaaccgttttaacgttttaccggttaggtttacggttacggttacgtttaacgggttcgggttttcggggttaggggttttaccgggttttaccgggtttttcggtttttttccgggggttaaccggggtttccgggggtaaacccgggggttaccgggtaaaccgggttaaccgggttacggtttacccccggttaaccggttaccccggtttaaccccggg

SEQ ID NO: 178530 - DNA, 788 bp, Homo sapiens
  misc_feature: GYAE6OF02GIPQ4.49.24.C02.1.454.CMB.1.raw
  modified_base (246)..(246): a, c, t, g, unknown or other
  misc_feature (246)..(246): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggatctcagactgtggtcgacccaggacgccattccgttgtccgaggttcgggtcccccgggggganacggtcaccacgtctacgttgtcggtcttaggctctcgtcggccttcgacgttctacctaacgttcggttaacccgtaccccaggtcctacgggtacccacggacctaacccggacccgtacggacccgtaacggccctaccgaaccggcctaccgtctaccgagttactaacgtaactacgtaaacgtacgtccgtcttaccgtttcggtccgggtcctacgtacttcgttcttcgtcgtcggtactcctacgtttcgtacggtaactaacgtccgttaccgccctctaaccgacgtcccgggaaccggggtaccacgggtacgagtacgtacgtagtacggtagttacggttagttaacgttttacgttacgttacggtcggtttacgtaacggtttacgtttacgggtttccggggttttaggggtttccggggttttcggtttttacccgggtttttggggttcccgggtttaccggggacgggttaaccggtaccggtaccgggttccgtaacccggttacccgtcggttaacccgg

SEQ ID NO: 178531 - DNA, 698 bp, Homo sapiens
  misc_feature: GYAE6OF02FQ82M.49.24.C02.1.454.CMB.1.raw
  modified_base (264)..(264): a, c, t, g, unknown or other
  misc_feature (264)..(264): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtcgagtcggtccccgggggggacaggtcacactcacttgtggcttganctctggctcagtctcaactgttacctacccagctggtaccagcacgacccgacggccacggcctccacgccacgctcatgtaacataacaaagtcgtcgtcttcttcgtcggggttccctggtactccgctttccgtcgtcggccttccctacgttccgttacgggaaaccaaacgtccgtacgtcccctaccaacccgtacgtacccgggacccgggggtacccgacgggacgaacggtagtacggtagtaacggtaagttggttacgtaagttttaagttaacgttaggtttagtcgtacgttcggtttacgttcgggttcgggttgggtttcggtttacccgttttttcgggtcgggtttaccggggtaccgggttaacggggtaacccgtaacggttccgttaccggtacccggttacccgttacccggg

SEQ ID NO: 178532 - DNA, 909 bp, Homo sapiens
  misc_feature: GYAE6OF02IB4J2.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcgaggtcgggtccccgggggggacacggtcacactcacgttggtggcttgacgctcgttggcctcgacgttcctactaacgttcggttaacctaaccccgaagtccgttacgggtaacccaggccaaaccggacccccgaacgggacccgacggtccctaccccgaaccggccgaaccgtcctaccgtaacgttacggtaaccgtaataaaccgaaaaacgttacggtaccgtaccgttccggtttaccggttccggggttaccccttagtacgttccgttacctttcctccggttcgtcccgtaccgtaacttacccgggttaacggggtaaacctaaacggtccgttccgtaccccgtaccctaacccggtaacgtacccggggaaacccggggggtaccccgaacgggaaccgtacggttaacgttaggtaacggttagtaaacggttagggtttagtttaacgttttaaacgttacggtttacgggttacggttacggttaaccggtttaggtttcggtttacggggtttacggggggtttttcgggtttccggggttttttaccggtttttttacgggggttcccgggttttaccgggggggtaacccgggtaaacgggggttaacccggtaaaccgggttccggtttaaccccggggttacccccgttttacccggttaaccccggg

SEQ ID NO: 178533 - DNA, 679 bp, Homo sapiens
  misc_feature: GYAE6OF02JB23L.49.24.C02.1.454.CMB.1.raw
  modified_base (426)..(426): a, c, t, g, unknown or other
  misc_feature (426)..(426): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcaggtcgggtcccggggggacagtcacactcgtacttggtggcttgagcttcgtcggctcacgtcctactaacgttcggttacctaccccgagtcgtcggtaccagccaacgaccccgaggtcccgaggcctcccgacgccacgctactacgtcgtaacgactaacaaagtcgtctccgttcttaccggtcggtcctgtactcgtcttcncgtcgctctacgtcgtaggaacaacgtcgcgtccctacaccgtacgtaccggaccgggacccgtacggacgacgcgtagtaccgtaaggtaacttaggtacgttaagttttaacgttcgttacggttgtacggttaccgttggttaaccgttcggggttgggttacgggtttcggttttaccggtttttcggtcggtttcggggacggtaaccgggtacgtaacggtccggtacggtcccggtaccgtaccgg

SEQ ID NO: 178534 - DNA, 816 bp, Homo sapiens
  misc_feature: GYAE6OF02HTRFV.49.24.C02.1.454.CMB.1.raw
  modified_base (525)..(525): a, c, t, g, unknown or other
  misc_feature (525)..(525): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactcctgcttatgatcaggtgtaggaatctcaagactggtggtcgacccgaggacgtaccagtcgttacgtcgtaggtcgggtccccgggggggatacggtccacaccgtacacgttggttggccttggacgtctcgttggacctgtacgtctacctaacgttcggttaacccctaccccgtagtaccgtacggtaaccgaccgtaccgaaccggtaccccccaaggggaccccaacgggttcccaccgaccggcctaccggtcgtactacggttacgtaaccggtaacttaaacgaaacttacggtaccgtctttaccgttaccgggtccggggttacctaggacttcccggtctttcgtacggttaccnccgttacccgtacgttccgttaaacggaaaccgtaaactccgtcccgttaacccacccgtacctaggtaccccgggtaccgggacccgacggaccgtaaggtacgaggtaacgtacgtaacgttggttaactaacgttttcgtaccgttgggttacgtcggttaccgtttaggtcctttcggggtgggtttacgggttcgttttccggttttccgggtacgggttccggggtaaccggttacgggtacccgtaggttacccgtaccgggttccccgttacggttaacccgg

SEQ ID NO: 178535 - DNA, 658 bp, Homo sapiens
  misc_feature: GYAE6OF02ITUEC.49.24.C02.1.454.CMB.1.raw
  modified_base (305)..(305): a, c, t, g, unknown or other
  misc_feature (305)..(305): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccccaccatggtcctggatgatgcttctcctcggactccttgcttatggatcgaggtgtggaatctcagactgtggtgacccaggagccatcgttgtcagtcggtcccggggggacacggtcacactcgtacttggtggtcttgacgctctggctgagtctctaacgtgttaccctaccctanctcggtaccacgcaccgaccccacggccaacggcctcccgacgcctacgctactatacgtacgaactaaacaaagtacgtcgtccttactttcggtcgggttccctggtaactccgtctttccgtcgtcggtccgttacctctccgtaacggtaaccaaggtcctcgtaccctccacctacgtccggacccggggtacacgacgacgactagagtacgtaagtcgtagtttagttaacttgttagtgttcgtacgttacgtggtttccgtgggtttcgggttcgtttcggttttcggtacgggtttacgggccggtaacggacgtacggtccgtaccgtaccggtcctaccgg

SEQ ID NO: 178536 - DNA, 727 bp, Homo sapiens
  misc_feature: GYAE6OF02FX4GT.49.24.C02.1.454.CMB.1.raw
  modified_base (245)..(245): a, c, t, g, unknown or other
  misc_feature (245)..(245): n is a, c, g, or t
  modified_base (393)..(393): a, c, t, g, unknown or other
  misc_feature (393)..(393): n is a, c, g, or t
tcagagtcgagagacacgaccggtgctcgatttagtacagatcgttagggaaaggggaaaggccctgaggaaacaaaccccagctgggaagcctgagaacacgtagccttcatgagtgtcccaccatggcctggatgatgcttctcctcggactccttgcttatggatcaggtgtggaatctcagactggtggtcgacccgaggacgccattcggttgtcgaggttcgggtcccccggggggganaggtccacctacctcacttggtcggtcttggagtctacgtggctcagttctactaacgttcgttacctaccccgagctacggtaccagcgaacgacccgaggccaggcctccgacgcacgctacgataggtaacataacaatagtccncttcgttccggtcgggtaccctgtaccgtcgtaccttctcgtacggcctcctacgttccgtaggaaaccaacgtcgtccaccctcaccacgtcccgggaccggggacccacgggacacggtacgtagtagtacgtaagtggttaacgtacgtttaacgtttaacggttcggtttaaagtcggttaccgttaggtttacgttacggggtttaggggttcggggttttccgttttaccgggttttttcggggtcgggttacccggggtacggggtaaccgggtaacccggttaacggtaccggtaccggttacccccggttacggttaaccccggg

SEQ ID NO: 178537 - DNA, 636 bp, Homo sapiens
  misc_feature: GYAE6OF02HUDQI.49.24.C02.1.454.CMB.1.raw
  modified_base (315)..(315): a, c, t, g, unknown or other
  misc_feature (315)..(315): n is a, c, g, or t
  modified_base (504)..(504): a, c, t, g, unknown or other
  misc_feature (504)..(504): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatgatcaggtgtggaatctcagactgtggtgacccaggacgccatcgttgtcgtaggtcgggtccccgggggggactacgtccactactctaccgttggtcggcttgacgtctcgtggactcagtctactaacttcggttacctaccccgngtcttacggaccagtccaaccgaccccgaggccaggtcctaccgacgcacgctcatcgtacataacgaaatcgtcgtcttcttcgtcgggtcctgactcgtcttcgtcgtcgtcctctactccgttaggaaacctagtccgtcctccctaccaccgtacgtcccggaccggggccctagggacaggtanaggacgtagtaagtgtagtaattagtcgttagttgctgttcgtattcgggttaggtcggttgttccgttttgggtcggttaccgggacgggtaaccggtctaaggtccgttaacgtccggttacctacccgg

SEQ ID NO: 178538 - DNA, 595 bp, Homo sapiens
  misc_feature: GYAE6OF02FLC7D.49.24.C02.1.454.CMB.1.raw
  modified_base (237)..(237): a, c, t, g, unknown or other
  misc_feature (237)..(237): n is a, c, g, or t
  modified_base (314)..(314): a, c, t, g, unknown or other
  misc_feature (314)..(314): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtcggtccccggggggganagtcacactacacttgtggcttgagctctggctcagtctcaactggttaccaccccagctggtaccagcacgacccnggccaggcctccacgccacgctacatcgtacataacaaagtacgtcncttcttcgtcgggttcccngactccgtcttcctgtcgtcctcctacttccgtacgggaactaagtcgtcgtccctccaacctcgtaccggaccggggacccgacggacaagacgtagagtgtaatcgtagtaacttattattgttgtgtcttgtacttgtgggtggttcggttcgtttttcggtcggttcggacgggtacggtccgaaggtcgtaccggtaccgttaccgtacg

SEQ ID NO: 178539 - DNA, 972 bp, Homo sapiens
  misc_feature: GYAE6OF02HO466.49.24.C02.1.454.CMB.1.raw
  modified_base (243)..(243): a, c, t, g, unknown or other
  misc_feature (243)..(243): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtgacccgaggacgccattcgttgtcgaggtcgggtccccgggggganacgtcaccactctacgttggtcggtcttggagtcttcgtgggcctacgtagttcctaccgaacgttcgggtttaacccctacccccaaggtccgttacgggtaacccacggaccgacccggaacccccgacgggcccgaacggggtccctaccccgaaccggccgtacccggtcctaccgtaacgttacgggttaaaccgaaacgttaaaaccgtaaaaagtttaccgggttacccgttaccgtttaaccccggtttttcccggggtttacccgggggggtttccccccttagggtaaccgtttccccggtttacccgtttttcccgtcccggtttcccggggtaccctttacccccgttaacgttttaacccccggggttttaaacggggggaaaaaacccccttaaaacgggttcccccgttaccccgggtaccccccttaaacccgtaacccccgggttaaaccgggttaccccccggggggaaaccccggggggggtaccccctaaccgggggtaccgtaacgggtaacgtaacggtaaacggttaaggtaacgtttacggttacgtttaaacttttaacgtttaccgttgggtttcggtaagttccggtttagttacgttcggggttagggggtttcggtttcggttttccggtttttcggtcgggttccggggaacggttacggacccgtaggtcccgtacccggttaccgtacccgtaccgg

SEQ ID NO: 178540 - DNA, 927 bp, Homo sapiens
  misc_feature: GYAE6OF02IFDFV.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcacccgaggacgccattcgttgtccaggttcgggtacccccgggggggacacggtaccaccaccttcgtaccttggtggtcctttggacgtcttcgtggccttcgacgttctcaaacttcggttaaccctaccccgagtcgtacggtaccaggcccacggaccccgaggacccgacggcctcccgacgccgaccggacctcaacgttacggaaccgtaactaacgtaaacgtacgtacccgtccttaccgttccggttcggggttaaccccttggaccgtttccgtcctttttaccgtaccgtttcgggccctttaccgttaaccgtttccggtttaaaccgggaaacctaaacggttcccgttccgttaacccccgttaccgaaccccgtaccggttacccggggaacccgggggttacccccgaacggggacccgtaaggttaacgtacgggttaagtaacggttaaaccgttcgggttaaaccggtttactttaaaccggttttaccgggttggtttcggttaccgggttacgtttacgggttaaccggttttcccggggtttagggggttttccggggtttttacccggttttttaacgggttttttcggggtttacccggggttaacccggggttaacggggttaacccggggttaaacccgtaaacccgggttttacccggttaacccggggttaaccccccgtttaccgggtttaaacccccgg

SEQ ID NO: 178541 - DNA, 819 bp, Homo sapiens
  misc_feature: GYAE6OF02HJ01T.49.24.C02.1.454.CMB.1.raw
  modified_base (205)..(205): a, c, t, g, unknown or other
  misc_feature (205)..(205): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtcgaccaggancctatcgttgtcaggtcggtccccgggggggacagtcacactcacgttgtggcttgacgcttcgtggctcacgtctacctaacttcggttaaccctacccagtcctacggtaacccagccaaccgaccccgacggacccacgggcctaccgaccgccgaaccgcctactaacgttacggtaaccgaacttaaactaaaacgttacggttaccgtaccgttaccgttttacgggtccgggggtttaccccttaggttaaccgttcccgttccgttttaccgtccgttgggtaccccttaccgtttaccgtttacccggttttaacggggaaaaccgtaaacggtaccttacccggtaccccttaaccgtaacccgtaccggtaacccgggacccgggggacccgtaacggaccgaagtacgtaggtaacggttagtaaagttcggttacgtaagtttttaacgttacgtttggttacgggttgttaccgtttagtttacgttcgggtttgggggtttacgggttttcgggtttcggttttttcgggttacggttaccggggggaccggtacgggtaccggtaacgtaccggttccggtaccggttaccctacggg

SEQ ID NO: 178542 - DNA, 642 bp, Homo sapiens
  misc_feature: GYAE6OF02HWC24.49.24.C02.1.454.CMB.1.raw
  modified_base (170)..(170): a, c, t, g, unknown or other
  misc_feature (170)..(170): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggntcaggtgtggaatctcagactgtggtgacccaggacgccatcgttgtcaggtcggtccccgggggggacacggtcacactcacgttgtggtcttgagtctctggctcagtctcaactcggttacctacccagcgtacggtaccagccacgaccccgaggccacggcctaccgacgccacgctacactgtacgaataacaaagtcgtctcttcgttcgtcgggtcctagtactcgtcttcctcgtcgtcctcactccggtaggaaacctaacgtctacgtccctacaccgtacgtaccgggaccgggacccaggacagagtgagttagtaagtgtagtaactttacgtacgttgtagtgtcgttagttacgttgggttagggttcgggttcggttttccgtttttcgggtcgggtttaccgggacgggtacgggtaccgtaacggtccggtacggtaccgttccgtaacccgg

SEQ ID NO: 178543 - DNA, 747 bp, Homo sapiens
  misc_feature: GYAE6OF02HUC0I.49.24.C02.1.454.CMB.1.raw
  modified_base (217)..(217): a, c, t, g, unknown or other
  misc_feature (217)..(217): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtcgtccccaccatggcctggatgatgcttctcctcgactccttgcttatggatcgaggtgtggtaatctacagtacttggtggtacgaacccgaggacncctagttcgttggtacacgggtccggggtaccccggggggatacgtccgaccgtactctacgttggtggtactgacgtcttcgtggccgtacacgttctactaacgttaccggttactaaccccaggtccgtacggtaccaggacccaaccgtaccccgacggccgacggtcctacccgacgccacgtcctacgacttacgaagtaactaaccgaaatcgtcctaccttcgttccggtccgggttcctagtccgtccgttcttccgtgtccgtcttaacccgtcgtacggtacggaaacgtaacgtctcccgtccctacgtacccgacgtaccgggtacccgggccggacggacgtacgagtcgaacgtacgtacgtaacgttcgttaacgttagtttacgttagttcgtaacggttcgttacgttagttccggggtttaggtttcgggttcggttttaccggttttcggtacgggtccgggtacggtacggtaacgttcggacccgttcggtacccgttacgtacccgg

SEQ ID NO: 178544 - DNA, 968 bp, Homo sapiens
  misc_feature: GYAE6OF02I286H.49.24.C02.1.454.CMB.1.raw
  modified_base (145)..(145): a, c, t, g, unknown or other
  misc_feature (145)..(145): n is a, c, g, or t
tcagagtcgagagacacgaccggtgctcgatttagtacagatcgttagggaaaggggaaaggccctgaggaaacaacccagctggaagcctgagacacgtagccttcatgagtgtaccccaccatcggcctggatgactgcttcnccgtcggactccttgcttatggatcgaggtgtacggaatctccgagaccgtgttaggtcgaccccggtaggaacgcctaacgttcggttaggtactacgggttaccgggtaccccgggggggtacacgttaccgaaccgtaaccttaccgtcgtttgggttaccgggcgtttagaacggtccgttaccggtgggttacccttacgaacggtttccccttaaacggtaacccggttttacggtttaaacccccaccccggtaagttcccggttacggttaaacccgacgggaaacccgtaacccggtaaccccggaacggtaaccgaaaccggttcgtaaccccgaccgtaaccgtacgtaaccctccgtagttaaccggataacgtaaacgtaaacgtcgtaaccggttgttccccgtttacgggtaccggggttaccctaacgggttaacttccccggttaccctttacgtacccggttgggttaacccttaccccgtaacggttacccggtttaaggggaaaacccgttaaacccggtcgttaaccccggtacccttaaccggtaaacccgtacggtaccccgggttaaacccgggggaccttaccgggaacgttaccggtaagttcggtaacgttaagtccgttaaccgagggttaacctttaacggttaccgttggtacggttacgttacgttacgtaccgttcggggttacgttcgggtttagttccggtttttaggtaaccggttcgggtaaccgggtaacgggtaaccggttaaccgggttaccggaaccggttttccccgtacggttaaccccgg

SEQ ID NO: 178545 - DNA, 795 bp, Homo sapiens
  misc_feature: GYAE6OF02FHZSJ.49.24.C02.1.454.CMB.1.raw
tcagagtcgagagacacgaccggtgctcgatttagtacagatcgttagggaaaggggaaaaggccctgaggaaaacaaaaccccagctgggaagcctgagaacacgtagccttcatgagtgtccccaccatggcctggatgatgcttctcctcggactccttgcttaatggatcaggtgtggaatctcagactgtggtcgaccaggagccatcggttgtctacggtcggtcccccggggggggacacgtccaacgtacctcgacttgtcggtcttggagctcgtggcctcgtagttcctacaaacgttcgggttaccctacccccgaaggtccgttacggtacccgagtccgaaccgtaccccccgagggaccccgtaggtccctacccgaacggccaccggtcctacgacttacggtacgaactaacgaaacttaggtcctcttcgtttcgtcggggttccctggacttccgtccgtttactcgttcgtccgtacctacgtaccgttacgggtaaacaaacggtccttacggccctacgaccgtacgtacccggaaccgggggtccctaacgggcgtaacggtaacgtcggtaataggttaacgttcggttaacgtttaacttttacgtttacgttaacgggtttcgtcgttacgttcgtttaggttacggttcgggggttacggttttcggtttccgttttttaccgggtccgggtttaaccggggtaccgggtaacgggttaaccggttaaacggtccgttaaccgggtacccggttaccgttaaccccggg

SEQ ID NO: 178546 - DNA, 872 bp, Homo sapiens
  misc_feature: GYAE6OF02HDOEL.49.24.C02.1.454.CMB.1.raw
tcagagtcgagagacacgaccggtgctcgatttagtacagatcgttagggaagggaaaggccctgaggaaacaacccagctggagcctgagaacacgtagccttcatgagtcgtcccacatggcctggatgatgcttctcctcggacctccttgcttactggaactcgtaggtgtggtaactcgtcagtacgtgtggtcgaccgaggacgtccgattcggttcgtcgtaggtccgggtaccccgggggggacacggttaccaccgtaactcgtaacgttaggttcgggccttgtaacggcttcgtacggtccgtcgtaacggttcctaactaacggttcggttaacccctaaccccgtacgttcggttaccggtaaccgacggtaacccaccggtacccgaacggttccgacggtacccttaccgaccgtacgtaaccggccttactagtcgtaaccggtaattaaacgaaagttacgtccgtacttccgtttacggtacggcccttagtacgtccgttcgttcctcggtaccgtccgttcccggtacgtttcccggtaacgggtaaaaccgtaaacgtcccgttaccggtaccctaccggttaaccgtacgggttaaaccccggaccgggggtacccgttacgggaccctaaaggggactttcggaacgttaaacgggttaccgttagggttaacgttacgttttaacgttaacgtttcgggttacgtacggtaccggtttacgtttacgggacggtttccggggttaagggtttcgggtttaaccggttttcggttacggtttaccggggtacgggttaccggttaccggtacggttaccggtttaaccgtcgggtacccgtttaaccgg

SEQ ID NO: 178547 - DNA, 591 bp, Homo sapiens
  misc_feature: GYAE6OF02GA1CI.49.24.C02.1.454.CMB.1.raw
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtcccaccatggcctggatgatgcttctcctcggacttccttgcttatggatcaggtgtggaatctcagactgtggtgacccaggacgccatcgttgtcgaggtcggtccccggggggggactaggtcgacacgtcacgttgtggcttggagtctctggctcagtcctcaactggttactaccccagctcggtaccagcacgaccccaggccagctccacgcacgctcatgacgatacaatgtacgctcttcncggggtcctgatcgtcttctcnggctccatcctggaacaaagcttnccctcaccgatcgaccggggtcccaggcaggacgtgagtgtaacttggtacgatttacgttaacgtgttgtgtacttagtattcggtcggggttcggttcggtcgttttttacggtggtttacgggtcgggtacgggtaccgtaaggtccgtacgtaccggtccgttaacccgg

SEQ ID NO: 178548 - DNA, 621 bp, Homo sapiens
  misc_feature: GYAE6OF02JLSM7.49.24.C02.1.454.CMB.1.raw
  modified_base (195)..(195): a, c, t, g, unknown or other
  misc_feature (195)..(195): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
tcagagtcgagagacacgaccggtgctcgatttagtacagatcgttagggaaaggggaaaagggaccctgaggaaaacaaaccccagctgggaagcctgagaacacgtagccttcatgagtgtccccaccatggcctggatgatgcttctcctcggactccttgcttatggatcaggtgtggaatctcagactgnggtgaccaggagccatcgttgtcagttcggtccccgggggggacngtcacactaccaccttntcggcttgagtctctggctcagtctcactcgttacctcccagctagtacagcacgaccncggcacggctccacgcnccgtactcactgtacgactaacgaataacgtctacgtcttccgtacggggttccctgtactcgtaccttcgtcctcggtcctaccgtccgttaccgttacgggaacgtaacgtcctaccggtccctaccgtacctacgtccggacccgggcctacgggaccagtacgtcgtagacgtagtagtagtattacgtacttgtcgtgtgtcgttacttggttgggtggttcggttcgtttcgttcggttacgggtcggtacgggctacggtacgtcggccgtacgttaccgg

SEQ ID NO: 178549 - DNA, 724 bp, Homo sapiens
  misc_feature: GYAE6OF02G941I.49.24.C02.1.454.CMB.1.raw
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
tcagagtcgagagacacgaccggtgctcgatttagtacagatcgttagggaaaggggaaaaggccctgaggaaaacaaaccccagctggaagcctgagaacacgtagccttcatgagtgtccccaccatggcctggatgatgcttctcctcggactccttgcttatggatcaggtgtggaatctcagactgtggtgacccaggagcccatcgttgtcaggtcggtccccgggggggacagtcgacactcacttgtgcttgagctctggctcagtctcaacgtgttactaccccagcgtcgtacngtccaggtacccccaggaccaggcctccgaccgcacgctcatgacagactaaatgtccntccgttacgtcgggtccctgactcgtccttctcgtggtcccttcgacttccggttaggaaaccgaacgtccgtctacccgtacaccgtacgtacccggaaccggggtcccaaggtcgaaggtacgtacgtacgttacggtaattaccggtagttaatttaacgttaccgtaggtttcgtaccgttaagtttccggttaacgtttcgggtacgggggttttaaccgggttcggggtttttaacccggtttttttcggggtacccggggttttaaacccgggggaccggggttaaacgggggttaaccccttaaggggttacccctttaacgggttccccgggttaacccctttaacccgggg

SEQ ID NO: 178550 - DNA, 929 bp, Homo sapiens
  misc_feature: GYAE6OF02I66TO.49.24.C02.1.454.CMB.1.raw
  modified_base (237)..(237): a, c, t, g, unknown or other
  misc_feature (237)..(237): n is a, c, g, or t
tcagagtcgagagacacgaccggtgctcgatttagtacagatcgttagggaaaggggaaaaggccctgaggaaacaaacccagcctgggaagcctgagaacacgtagccttcatgagtgtccccaccatggcctggatgatgcttctcctcggactccttgcttatggatcaggtgtggatctcagactggtggtgacccgaggagccatcgttgcaggtcgggtccccgggggganagtcacactcacttgtgtcttgagtctcgtcggctcgtaagtcctacaaaccgttcggttaaccctaccccgtagtccgttacgggtaacccaacggacccgaaccggaaccccccgaggggaccccgaacgggtcccttaccccgaaccggccgaacccggtccttaccgtagtttaacggtaaaccgtaaacttaaaaccgaaaaacgtttacggtaccggtaccctttaccgttttcccgggttaccggggggttaccccttagggtaaccttcccggttacccttttccgttacgttaccgggttcccttacccgtactttacccgggtttaaacgggaaaactaaaccgggtcccttaccggtaaccccttacccgtaacccgtaacccggtaccccggggtaaccccggggggaaccccgtaacggggtacccgtaaaggtaacgttacgaacgggtttaggtaaaacgttccgggttaagtttaaaccgtttttaaacgttaaccggtttagggtttcggtacgttacggttaagtttccggttcggggtttacggggtttacggtttccgggtttttaccggtttttcgggggttaccgggtttaccgggggaccgggttaaccgggttaacccgaacgggttacccggttaccgggttacccccggttaccggtttaacccgg

SEQ ID NO: 178551 - DNA, 937 bp, Homo sapiens
  misc_feature: GYAE6OF02IPDHN.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgttgtacgaggtccgggtcccggggggacacggtcactactctacgttggtcgcgttaggacgtcctcgtggtccgtacgacgttcctactaacgttcggttaacccctacccccaggtaccgttacggtaacccacggtccaaccggacccccgacggtaccgacgggtccctaccgaccgtaccgaccgccttaccgtacgttaccgttaacgtaaacgtaaacgtaaaacgttacgggttaccgtccgttacccggtttacggttccggggttcccgtagtaccgttcccgttccgtttaccgttccgtccgggtcccttaccgtaccgttaccggtttaacgggaaacctaaacgtccgtaccgtaccccgtacctaaccgtccgtacccggggtaacccggggacccgtaacgggaaccgacggttaaacgtacggaacgttacgggttaaacgttcgggtttaagtaaccgttttttaacgttacgggtttacgggtttcggtttaccggtttacgtttaacgggtttaaccggtttccgggggttttagggggttttcggggggttttacccgggttttttttaggtttttccccgggggggtttacggggtttaaccccgggggttaacgggggttaacccggggttaaccccgggttaaagggttcccccggttaacccgggggtttaccccgtttaaccccggttaaaccccggg

SEQ ID NO: 178552 - DNA, 608 bp, Homo sapiens
  misc_feature: GYAE6OF02HNG4I.49.24.C02.1.454.CMB.1.raw
  modified_base (291)..(291): a, c, t, g, unknown or other
  misc_feature (291)..(291): n is a, c, g, or t
  modified_base (324)..(324): a, c, t, g, unknown or other
  misc_feature (324)..(324): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagttgtccccgggggggacagtcacactcacttgtgcttgagctctggctcagtctcaactggttacctacccngctggtaccagcacgaccccaggccaggctccncgcacgctcatgtacgaatacaaatgtcgacttcttcgtcggggttccctgtatccgtcttctcgtgcctcctatcccgttagggaactaaagctcgccctcaccagtccgaccggggcccaggccagactgaagtcgaagttcgtagtaatttattacgttagttcgtgtcttagttacgttcgttggggtttcgggttcgttccgtttttcgggttcgggtttaccggggtcgggtaacgggaccgtaaggtccggtccggtacccggttccgttaacccgg

SEQ ID NO: 178553 - DNA, 886 bp, Homo sapiens
  misc_feature: GYAE6OF02GT2SV.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatgcctggatgatgcttctcctcggactccttgcttatggatcaggtgtggaatctcagactgtggtgacccaggacgccatcgttgtcaggtcggtccccgggggggacacgtcacgacctctacgttgtggtcttagacgtccttcgtcgggtccttcacggttcctacgtaaaccgtttcgggtttaaccctaaccccccgtaggtacccgttacgggttaaccccaacggtcccgaaaccggaccccccggtaagggaccccgaacgggtcccttaccccgaaccggcccgaaccgtcctaccgtagttacggtaaccgtaagttaaacctaaaaagttcggtaccgtaccttcgttaccggtttccggggttacccctggtaccgttccggtcctttacgtccgttcgggtaccctaccgtacgtttccggttaacgggaaacctaaacggtcccgttccggtacccctacgtaacccgtaccggttacccgggaacccggggggtccccaacgggtccgtaacggtacgttacgggaaccgttaggtaacgtttacggtacgttaacgttttaacttacggttcggttaggtcggttacgtttacggttacgttccgggttgggggttttcgggtttaccgggtttttaccggtttttcgggttcccggggtttaccgggaccggggttaaccgggtaacccgttaacgggttaccccgttcccgggttaacccggtcccgtttaacccggg

SEQ ID NO: 178554 - DNA, 673 bp, Homo sapiens
  misc_feature: GYAE6OF02FYO4Y.49.24.C02.1.454.CMB.1.raw
  modified_base (206)..(206): a, c, t, g, unknown or other
  misc_feature (206)..(206): n is a, c, g, or t
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatgcctggatgatgcttctcctcggactccttgcttatggatcaggtgtggaatctcagactgtggtcgacccagganccatcgttgtcaggtcggtaccccggggggganagtcaccgactcacgttgtgtcttgagctntggctcagtcacaacgttggttacctaccccagtcgtacggtaccagtaccacgacccccgaggacctaggcctccgaccgaccgacgtcctcaactcgtaaccgataaaccgtaaattacggtcctacttccgtttcggtacggggtccctagacgttccgtcttcctacgttcggtctccgtacttccgtaaggaaccgaagtccgtacgccctaccaccgtacgtccgggacccggggaccaggaccgtacgcgtagagttacgtaagtacgttagtatttagttcgttcgtgtcgtcgttagttagttccgggttgggtttcggttcggtttcgttttcggtcggttaccgggtacggtaccggtaccggtagtcccgtaccggtaccgtccgtacccgg

SEQ ID NO: 178555 - DNA, 722 bp, Homo sapiens
  misc_feature: GYAE6OF02G46YS.49.24.C02.1.454.CMB.1.raw
  modified_base (238)..(238): a, c, t, g, unknown or other
  misc_feature (238)..(238): n is a, c, g, or t
  modified_base (680)..(680): a, c, t, g, unknown or other
  misc_feature (680)..(680): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtcgtccccaccatggcctggatgatgctttctcctacggactccttgacttatggatcagtgtgatctcagactgtgtgaccgaggacgccattcgtgtctaggtcggtccccgggggganacggtccactactacgacttggtggtactggacgcttcgtggctacagtcacgtaacgtacggttacctaaccccagtcgtacgtacccagaccaaccgtacccgacggccacggtcctccgacggctaacgtcctagttactacgtaccgaattaaccaaaatcgtagtacccttcgtttaccgggcgggttacccctaggttactcccgggtactttccctaggttccgtcttacccctagtttacccgggttaacggaaaaccaacgttcccggtacctaccctcgaaaccgttcctacccgggggaaccgggaccctacgggaacaccgtagttacgaacgtaggtaccttggtaaccgtagttaacttcgtgtcctagtacgtttcgtacgtggttgggttcggttacggtttacgttcggtaaccggttaccgggngtaacgggcctacggtacccgagtaccccccgttaataccgg

SEQ ID NO: 178556 - DNA, 629 bp, Homo sapiens
  misc_feature: GYAE6OF02GEBW1.49.24.C02.1.454.CMB.1.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactcctgcttatggatcaggtgtggaatctcagactgtggtgacccgaggacgccatcgttagtcagtcggtccccgggggganaggtcacactcacttggtgcttganctcgtggctcagtctcgaacctggttacctaccccngcgtacggtaccngtcaacgaccccagccacggctccacgcacgctcatcgacgaatacaaagtcgtcgacttctcgtcgggtcctggactcgtcttctcgtcgcctctattccgtagggaaactaaacgctaccgccctacaaccgtacgaccggtaccggggccaaggcaaggtatcgatacgaagtcgtagtaactttagttacgtgtgtcgtcttagtacttaggtcgggttacggttggtttccgtttttcgggtaccgggtttacgggacgggttaacgggaaccgtaacggtccgttaacggtaccccgttacggttaacccgg

SEQ ID NO: 178557 - DNA, 807 bp, Homo sapiens
  misc_feature: GYAE6OF02J2F8G.49.24.C02.1.454.CMB.1.raw
  modified_base (197)..(197): a, c, t, g, unknown or other
  misc_feature (197)..(197): n is a, c, g, or t
  modified_base (678)..(678): a, c, t, g, unknown or other
  misc_feature (678)..(678): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtnacccgaggacgcctatcggttgtccaggttcgggtccccgggggggaactacgtccaacgtaccgtcctacgttggtcggtcgttggagtcctcgtggacctcgacggtcctacgaacgttcggttaaccctaccccgagtcgtacggtaccacgccacggacccccaggtacccacggtccctacccgaccggccaccgtcctccgtagttacgtaacgtaataaaccgtaaaacgttcgtacccggtccttccgtttaccgggtttaccggggtccctaggtccttaccggtcccgtttacgtccgtccggtacttacccgtacgtttacccggtaggaaaccgtaacgtcccgtaaccgtccccgtaaccgaccggtaacgtccggggtaaccccggggtaccgaccggttaacgacgtacgtaacgtacgttacgaaagtttggttactttaaagttcgttaacggttgttacgggnttcggttgtaccgtttcgggttggggtttacggtttcgggtttaccttttccggggtaccggtttaccggggaccgggtacgggttacccaacgggttccctttacgggttaccccggtcccttacggg

SEQ ID NO: 178558 - DNA, 809 bp, Homo sapiens
  misc_feature: GYAE6OF02HVKOU.49.24.C02.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctccgtcggactccttgcttatggatctaggtgtaggatctcaagacttggnggtacgacccgaggacgcctattcgttagtcgaggttccgggtccccggggggganacggtacacgactcacttgggtgtacttggacgctacgtggtcctcgaagttactcgtaaacgttacggtttaacccctaccccgaagtcgtacggttaaaccgacgacccaaacggaaccccgagggacccacggtccctaccgaccgacccgacggtacctacgtaacgttacgtaaccgaataaaccgtaaaagtcgtacgttccttcgttaccggtcggggtcccttagaccttcggtactttccgtagcggtccttcccgtagtaacccgtaaggaaccgtaacgcccgttacgcccctacgtaacccaccggtacgggacccggggtaacccgacggatacaagttaggaacgttaacggtaagtttacgggtaacttaacgttttaaccggtagtttacggaggtttccgtacgtttacgtagttcggggttacggggtttccgggtttaaggtttttcccggttttaagggttccgggtttaaccgggacggggaacggtaccgaaacgggttcccgttaacggttaccccggtttacgtaacccgg

SEQ ID NO: 178559 - DNA, 825 bp, Homo sapiens
  misc_feature: GYAE6OF02GOYL7.49.24.C02.1.454.CMB.1.raw
  modified_base (244)..(244): a, c, t, g, unknown or other
  misc_feature (244)..(244): n is a, c, g, or t
tcagagtcgagagacacgaccggtgctcgatttagtacagatcgttagggaaaggggaaaggccctgaggaaaacaaaccccagctgggaagcctgagaacacgtagccttcatgagtgtcccacatggcctggatgatgcttctcctcggactccttgccttatggatcaggtgtggaatctcagactgtggtcgacccaggtacgccagtccgttgtctaggtccgggtaccccgggggganacgtcacgtactctacgttggtggcttggacgtcctacgtggcctcgtacgtctacgtaacgttcggttaacctacccccgaggtccgttacggtaaccctaggtaccgaccggacccccgaacgggcccgacggtcccgtaccgaccggtaccaccggtcctcgtaacgtcgtaaacgtactaacgtaaaattccggtccggtaccttccggtttaccgggttcccggggtacccttaggaccgtttccgtctttccgtcgttacggtcccttaccgtacgtttacccggttacgggaaaccgaaacgtccgtacccacccgtaccgtaaccgaccggttacccgggacccggggtacccgtaacggacgtaacgtaccggtagtaacggtacgtaaagtcgttaacgttacttttaacgttccgttagggttccgtagttaccgttaggttacttacggggttcgggtttcggttccgggtttttaccggttttcggggttccgggttaaccggggccgggtaaccgggttaaccgacggtttacccgtacccggttacccggttacccggtaacccgg

SEQ ID NO: 178560 - DNA, 733 bp, Homo sapiens
  misc_feature: GYAE6OF02FS1GJ.49.24.C02.1.454.CMB.1.raw
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgagggtgtggaatctcagactgtgggtacgacccagggacnccattcgttgtcgaggtcggtccccgggggggancgtcgacacctctacttgtcggtcttgngcttcgnggtctacgagtcctcaacgttacggttacctaccccgagccgttacggtaccaggaccacgaccccgacggaccgacggcctaccgaccgccaccgtcctacgatcggtaacgactaaccaaatacgtccgtctttccgttcgtcggggtaccctgtacgttccgtcgtttcctcgtacggtccttacgtaccgttacccggtttaacggggaacgtaaacgtccgtaccgtccccgtaaccacccgtaacgtcccgggacccgggggaccccgagggaccaacggtaacgtagtagtaagtacgtagttagttaatttaacgtttacgttggttgtgtacgttgtagttcgggttgggttgggtttccggtttcggtttttcggtcggtttaccgggtacgggacgggtaaccgtaggtaccggtaccgtacccggttaccgtacccggg

SEQ ID NO: 178561 - DNA, 770 bp, Homo sapiens
  misc_feature: GYAE6OF02HUGZG.49.24.C02.1.454.CMB.1.raw
  modified_base (169)..(169): a, c, t, g, unknown or other
  misc_feature (169)..(169): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatgntcaggtgtgaatctacagactgtgtnacccagganccattcgttntcgaggtccgggtacccggggggtacncggtccaccactctacgttgtcggtcttgcgtcttcgtcggtctctagtctactaacgttcggttacctaccccgagtccgttacggtaccaggaccgtaaaccgcccgtaacggaccgtacggccctccgacggacctaccggtacctacttacggacgttaacgtaactaaagtaaacgttcgtacgtccgttttccgtaccgggttcccgggtacccttggtacccgttcttcccgttacgtccgtcggttacccctacctgtttacccggtacggaaaacgtacgtaccgttccgtaacccgtccgaacccttaccgggtccggaacccgggggttccaacgggacagttaacgaagttacgagttacggttacgtacgttacttaacgttcggtttagtcgtcggtttactcgggttacttccggggtttgggtaccggtttcgtttcggtttcgggttaccgtccggggtacgtaaccggtaccggtacttacccgggacggttaccgttcccgttaacccgg

SEQ ID NO: 178562 - DNA, 823 bp, Homo sapiens
  misc_feature: GYAE6OF02H1TWW.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtaggaatctcagactgtgtcgacccgaggacgccagtcgttgtcgacggttccgggtaccccggggggatacggtccacgtacttacgaccgtttggtcggtacttaggacgtccttcggtcggtcctcgtaaggttcctaacgtaacgttaccggttaaccgtaccccaaggtccgttacggtaaccacgtacccaaccggaccccgtacggaccgaagggtcccctaccgaccggtccaaccgtcctacgacgttacggtaacgaaacttaacaaaacgtcgtcgtccgttacgtttccgggtaccggttacctacgtacgttacccgttccttacgttccgtcggtcccttcgtacgttaccgttacggaaacgtaaacgtccgtacgtaccctacgtacccgaacgttacccgggaacccggggtaccgacggtaaccgaacggtaacgtagaaggttaacgtaacgttggttacgtaagtttaccttacggttgttacggttagttccgttaggtttccgtagggtttacgggtttcgggttcggttttaccggtttttacggtccgggtttaccgggtaccggggtaaccggtaccggtaacggttcccggttaacggtaccccggttacgttaacccggg

SEQ ID NO: 178563 - DNA, 816 bp, Homo sapiens
  misc_feature: GYAE6OF02IZGWD.49.24.C02.1.454.CMB.1.raw
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (675)..(675): a, c, t, g, unknown or other
  misc_feature (675)..(675): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgtcttatggatcaggtgtggaatctcagactgtggtcgacccaggagccatcgttgtcgaggtcggtccccgggggganacgtccacgactctacttgtcggtcttgacgtccttcgtggcctctacggtctactaaccgtcggtttacctaccccnggtcgtcggtaccagccaccacccgngccgacgtcctccgacgccacgctacctagtacgacgtaataacgaaattacggtcccgttccttaccggttttcggtcccgggggtttaccctaacggttaccgtttccggtccccttttccggttcccgttacgggtccctttaccggtaaccgtttacccgggttaaagggtaaaacctaacccgggttccgtaccccgttaccccttaccgaaccccgtaacggtacccccgggggaacccgggggttaccccgaaggtcccgaaagtaacggttgaaccgttaggtaacgttacggtactttagttaaccgtttgtggttacgttntacgttagtttacgggttgggtttcggggtttaggttttccgggtttctttttccggggggtggtttaacccgggggagggttaaccggggtaacttaccgggtaccggtttacccggttaacccggttcccgtaaccggg

SEQ ID NO: 178564 - DNA, 858 bp, Homo sapiens
  misc_feature: GYAE6OF02H8WZN.49.24.C02.1.454.CMB.1.raw
  modified_base (211)..(211): a, c, t, g, unknown or other
  misc_feature (211)..(211): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
tcagagtcgagagacacgaccggtgctcgatttagtacagatcgttagggaaaggggtaaaggccctgaggaaaacaaaccccagctgggaagcctgagaacacgtagccttcatgagtgtccccaccatggcctggatgatgcttctcctcggacctccttgcttagtggatcgaggtgtggatctcagctgtaggtcgaccgtaggacncctagttcgttcgttcgacgggttccggggtccccgggggggaactggtacccgaccgtactaccttaccgttggtaggtccgttagcgtcctcgtgtccgtctacggtaccctcgtaacgttccggttaacctaccccggagttccgtccggtaaccgacgtacccaaccggtaccccggacggtcgaccggcctacccgacgtcgaccgtacnctaggtacgtaaccgtaanaactaagtcgtccgttctacgtttcggtcggttaccccgtagttaccgttcgtaccctttcggccgttcggtacctttacccgtaccgttcccggtttaaacggaaaccgtaaaccggtcgtttccccgaccgtaccgtaacccgaaccgggtacccggggacccggggtacccgaccgggtaaccgtaaggtacgtaacggtagttaaggtaagttaggtttaccggttacgtttaacggttttacggtcgtttagtacggttaccgtttacgggttacggtttgggtttacgggtttcgggttttcgggttttacggtttttccggttaccggggtttacgggaacccgggtttacgggaaacccggtttccggtaccgttaaccgggttaccccgttacccgttaccggg

SEQ ID NO: 178565 - DNA, 782 bp, Homo sapiens
  misc_feature: GYAE6OF02I2O7I.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagacgtgtcggtacgacccgaggacgcctaagttccgttgtcgaggtccgggtccccggggggaacacgtccgactaccgtctaccgttggtcggtcttaggacgtccgttcgtggtccttcgaacgttcctaccgtaaaccgttacggtttaacccctaccccgtaagtccgttacggtaaccgacgtaccgaaccggaccccgtacgggaccgacgggtaccctaccgaccgcccgtaacgcctacgacgtacgtaacgtaactaaaccaagttaaccgtcttccgttacgttccgggtccgggtccctagtacgtccgtacttccgtcgtcgtcctaccgtacttaccggtacggaacctaacgtcctccgacctacaacccgtacggacccggaccgggaccgtcggacgaacgtggtaactaaggtacgtaagttacgtttaacgtaactttaacgtttcgttcgttcggttagttcgtagttacggttcgtttaggggtcggttaacggtttttcgttccggggttacggttaccgggtcggtaacgggacctaacggttcccgtacggttcccgttaaccggtacccgg

SEQ ID NO: 178566 - DNA, 762 bp, Homo sapiens
  misc_feature: GYAE6OF02JLVTR.49.24.C02.1.454.CMB.1.raw
  modified_base (357)..(357): a, c, t, g, unknown or other
  misc_feature (357)..(357): n is a, c, g, or t
  modified_base (628)..(628): a, c, t, g, unknown or other
  misc_feature (628)..(628): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggacgccatcgtgtcaggtcggtcccggggggatcgtcacacgtcacgttgtcggcgttaggagtcctcgtgggcttacgacgtcctacgtaacgttcggttaacctaccccaggtccgttacggtaacccgtacgtaccgaaccgtaaccccgnggtacccgtacggtccctaccgtaaccgccgaccgtactccgtaagttcggtaacgtaactaactaacgttaccgtccgtacttccgttacggttcccgggtccgtcgaattcccgtctttccgtacgtccggtacttccgtaccgttaccggttagggaaacaaccggtctcccgtccgtcaccgtaccgtccggaaccggggccctacggtaccaacgtacgtagtacgtagtaacgttgttagtaacgttacgttaacgtcggttacnggttcttacggtagtttcgggtacgggttcgggtttacgttttcccggtttagggttccggtaccggggttaacggtaccgggttaacctaccgggttccgttaccgggtaccctttacccggttaaccccggg

SEQ ID NO: 178567 - DNA, 937 bp, Homo sapiens
  misc_feature: GYAE6OF02IO77H.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcgagacgtgtggtgacccaggacgcccaagttccggttgtccgtagggttccgggtcccccggggggggtactacggtaccaaccaccgttccgtaccgtttggtcggttcttggacgtccttcgtcgggtcctcgtacgttccgtactaaaccgttcggttaaccctacccccgagtccgttaccggtaacctacggtacccgaaccgaaccccccggtaggggaccccgtaacggggtacccctaccccggaaccggacccgtaaccgtcccttaccgtaaacggttacggtaaaccgtaacttaaaccgtaaaacgttaccggtaccgtaccgtttaccgtttccgggttaccggggtttccctacggtaacgtttcccgtccttttaccgttccggtccgtaccttacccgtaccgttccggtaaaccgggaaactaaccggtccgtaacccgtccctaccgaaccgtaccggtacccgggtacccggggtacccgaacggaccgtaaggtaaccgttaggaacgttaacggtaattacgggtttaaccgtttaagttttaacggtttaacgtttcggttaacgttcggttaaccgttggtttaaccgttggggttacggggttttacgggtttccggttttttaccgggttttaccgggttccgggttaccggggggtaacggttaccgggtaaaccggttaccggttacccggttaccgggttaccccgtttacccggtaaccggg

SEQ ID NO: 178568 - DNA, 1005 bp, Homo sapiens
  misc_feature: GYAE6OF02G9CV0.49.24.C02.1.454.CMB.1.raw
  modified_base (247)..(247): a, c, t, g, unknown or other
  misc_feature (247)..(247): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtgacccgaggagcctagtcggttgtcgtaggtcgggtaccccggggggganacggtcacactcacgttggtcggtcttgagtcctcgtggcctagacgttcctacctaacgtttacggttaacctacccccgtaggtacccgttacggtaaccccgtaggacccgaaaccgggaacccccggtaacggggacccccgaaacgggttacccgttaccccgaaacccgggaccaacccgggtccttaaccgttaacgtttaccgggttaaaacccggtaaaagttaaaaccttaaaaaaccgttcgggtacccgttaccgtttaccccgtttttcccggggtttaaccggggggtttccccctttaagggtaaacccgttttcccggtttacccgttttttaaccgttcccgggttaaccgggttacccctttaccccggtaccgttttaacccggggtttaaacccggggtaaaacccggtaaacggttcccgttaacccggttcccctaaaccggtaaccccttaacccgggtaacccggggtaaccccggggggaaccccgtaaacgggaccccgtaaagtaacgttacgggtactttaacgggtaaggtttaccgttagtaaccgtttttaagtacccgtttgttaacggtttcgtaaccggttgttacggtttcggggtttacggggtttcgggttaaccgggtttttcggtttttacgggttcgggttaccgggggttccggggaaaccggttaccggtaacggttcccggttaaccggggtaccccctttacgggtaaacccgg

SEQ ID NO: 178569 - DNA, 909 bp, Homo sapiens
  misc_feature: GYAE6OF02F720V.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttccttgcttagtggatcgaggtgtggaatctcagtactggtcggtcgacccgaggacgcctagttcggttgtacgacggttccggggtcccccgggggggacacggtccaacctactccgtacgtttggtacggtcttggacgtcttcgtcggtcctcgtacgttcctacgtaacgtttacggttacccctacccgagtaccgtacggtaaccacgaccgtacccggacccgacggtaccgacggccctaccgaccggacccgaccgtacctacgtaacgtacggtaaccgtaactaaaccgtaaacttacggtaccgttcctttaccgggtttccggttccggggttacccttagggtaccgttaccgttccgtttccgtaccgttccggtacccttacccgtaaccggtttaccggttaacgggaaaccgtaaccgggtccttacccggaacccctacccgtaaacccggtacgggtaccccggtaaccgggggacccgacggtacggaattaacggtacgtaaggttagtaacgttaggttaacgttaaccttttaaggttacgtagtttacggttcgttacgtttacgggttacggtttcgggtttacgggggtttggttttttaccggggttttccccggttttttagggggtcccgggggttttacgggaaccgggggttaacccggttacgtaacccgggtttcccgggtacccggtttaacccggttcccgggttaaacccggg

SEQ ID NO: 178570 - DNA, 1068 bp, Homo sapiens
  misc_feature: GYAE6OF02FQ1HF.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactccttgcttatggatcaggtgtggatctcagactgtggtcgaccgaggacgcctagtcggttagtcgtaggtcgggtcccccggggggggactacgtccgaactaccgtcctacgttggtcggtcttacggacgtccttcgtcgggtcctacgtacggtccttaccgtaacgtttcggtttaaccccctaacccccgtagtaccgttacgggtaaccccgaacggtacccgaaacccgggaaccccccgtacgggaccccggtaacgggtaccccgtaccccggtaaccggtaccctaaccggtacccgttaccgtaaccggtttaaccgggttaaccggtaaacctaaaaccggtaaaacgtttacgggttacccggttacccgtttaacccggtttccggggtttacccgggggttaccccttagggtaccgtttcccggttacccttttccggtccggttccgggtaccctttacccggtaaccggttttaacccgggttaacggggtaaaaaccctaaccgggttacccgttaccccggtaccccgttaaccggtaccccgtaaccggttacccgggggaacccggggggtacccctaaggggtaccccgtaagggttaccgtaacgggttaaaccgtcggttaaaacgggttcgtttaaacggtttaacgttttaacggtttacccgttggggtttaacccgttcggttacggtttaacgttttaccgggtttacgggggttacggggtttcccggggttttttaccggttttaccggggttttttaccgggttaccgggggggtttaacccggggtaccgggggggtaaaccccggtttacggttaacccggggttcccggttttaaccccgggttaaccccggtttacccggtttaacccccgggg

SEQ ID NO: 178571 - DNA, 912 bp, Homo sapiens
  misc_feature: GYAE6OF02H798E.49.24.C02.1.454.CMB.1.raw
  modified_base (242)..(242): a, c, t, g, unknown or other
  misc_feature (242)..(242): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccacatggcctggatgatgcttcgtcctcggactccttgcttatggatcaggtgtggatctcagactgtggtgacccgaggagccattcggttgtcaggttcgggtccccgggggggtanacggtccaccacttccacgttggtggtcgtttggagtccgttccgtgggtccttcgacgttacctaccgtaacgtttcgggtttaaccccttaacccccgagtaccgttgggttaaccccaggacctaaccggtaaccccccaaggggtaccccaagggtccctcccgaaccggtccaccggtctacgtacgtaggttaaccgaacttaaacgaaaagttacgtacggtcttccttcgggtttccgggtacccgttacgtacgttccgtccttttcggtccgttacggtcccgttaccgtaccgtttccggtttaacgggtaaacccgtaaacggtccgttaccccgtacccgtaccctaaccggttaaccggcccgggtaaacccgggggtaccccggaacggtaccggtaaaccggtaacgttaccggaaaggtttaccgggttaaacggttaggttaacggtttaacgttttaaccgtttaaccggtttcgggttcggttaaccggttcgttaacgggtttccggttacgggttttcgggttacggggttttccggtttttaaccggtttttcgggtttacccgggttaccgggtaccgggtaaacggggtaccccggtaaacgttccccggttacccgggttaccccggttccccggtaacccggg

SEQ ID NO: 178572 - DNA, 860 bp, Homo sapiens
  misc_feature: GYAE6OF02J0GUU.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggagccatcgttgtcgaggtcgggtccccggggggggtacaggtccacactcgaccgttgtcggtctcggacgtcctcgtcggctcgagtctactacgttcggtaccctaccccgagtccgtacgggtaccaacggtccgaacggaccccccgtaacggccccgaacgggtcccttaccgaccgtacccgaccggtaccctaccgtacggttacggtaacccggtaactaaacgtaaacgttaccgttacccggtacgtttccgttaccggggtttcccggggttacccccgttagggtaaacctttccggttcccgttttacccgtccgttaccgggtaccctttccccggtacgtttaccccggtttaaggggaaccgtaaacgtcccgttaccgccccgttacgaacccgtcgtacccgggaccggggtacccgacgggtacgacgtaacgttcgggattaacggtaacgttgtaaccggtttaagtttaaccgttaccggttagttggtaccgttcggttagttaccggttacgggttggggttttccgggttacggttttcgggtttccggttacgggttacccggggtgggtaaccgggttaaccggtacggttaccgggtttaccggtacccgttacccggttacccggg

SEQ ID NO: 178573 - DNA, 1028 bp, Homo sapiens
  misc_feature: GYAE6OF02FRSUU.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccgaggacgccatcgttgtcgaggtccgggtccccggggggacacgtcacgactctacgttggtcggtacttggacgtcctcgtcggtctcgagttcctactaacgttacggttaccctaaccccgagtccgttacggtaacccacggtaccgaaccggtaacccccgacgggacccgaacggtcccgttacccgaaccggtacccgacccgtaccttaccgtaaccgttacggttaaaccgtaaacgtaaaaccgtaaaacgtttaaccggtaccgtacccgttttacccgttttaccgggtttacccgggggtttccccttaacggtaacgtttccccgggttaccctttttccggttacccggttaccgggttacccccgtttaacccgtttaacccggttttaccccgggtttaaaacgggggtaaaaaacccccttaaaacgggtccccgttacccgttaaccccccgttaacccgtaaaccccggttacggtaacccccggggtaaccggggggtaccccctaaggggacccgtaaggtaacggttacggtaaccggttaacggtaacgtttacgggtttaacggttaactttttaaccgtttacggttacgggtttacgttacccgggtttaccgttttagggttaaccgtttccgggggtttcgggggtttacggggtttttccgggtttttacccggttttttttcggggtaacccggggttttaaccggggggaacggggtttaaaccggggttaccctaaaccggggttcccggtttaaccccggggtttacccggttaccccggtttaaacccgggg

SEQ ID NO: 178574 - DNA, 870 bp, Homo sapiens
  misc_feature: GYAE6OF02HL45M.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccacatggcctgatgatgcttctcctcggactccttgcttatggatcgaggtgtggaatctcagtactgtggtcacccgaggagaccgtagtcgttcgtcgtaggtcggtccccggggggactacgtaccgaccacgtacctacgttacgtcggtactcggagtcgtcgttacggcctactacggtcctacctaaccgttacggtttaaccccaccccgtacgtcccgttacgggtaacccaggaacccgacccggtaacccccgaacgggacccgtaaccggaccgttacccgaccggacccgtaaccggaaccttccggtaaagtaccgtaaccggtaacttaaaaccgtaaacgttacggttaccgtacgttaccgtttccgggtttaccggggtaacccttagggtacgttacccgttaccgtttaccgtccggtccggttaccctaccgttaaccgttacccgtttaacggaaacgtaacggtacccgtaccgtaccctaacccgtaccgaccggtacccgggtaacccgggtaccgtaacgggtaccgttacgaaacgttacggtaacgtagttaacgttagtacgttagttaacttacgttcgtacgttacggttacgttaggttacgtacgggttacgggtttacgggtttccggtttacggttttccggtccggttaccgggtaccgggtaacgggtacccgacggttacggtacccggttaccggtacccttaacgg

SEQ ID NO: 178575 - DNA, 742 bp, Homo sapiens
  misc_feature: GYAE6OF02JSUWI.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgacccgaggcgccatcgttgtcgacggtcggtccccgggggggacacggtcacacgtctaccgttggtcggtcttgacgtctcgtggctcacggtccttacaacgttggttaaccctacccagtccttggtaaccctgaccacgaccccgaggcctacggcctaccacgccacgtctcatcgaactactaacaagtcgtacgtcttcgttcggtcgggtccctgacttcgtccttctcgtcgtcctcgactttaccgtacggtaactaacgtccgtaccgtcctacgaccgtaaccgtccggaacccggggtcccgtaagggaccctaggtaaccgttacggacgttacgaaggttacgttaacggttaccgttttaagttcccggttagggttggtaccgttaacggttcgttaacgtttcgggtttcggggttttaacgggttttcgggttttttaccggggtcgggttaccggggtacgggttaaccgggtccgttaaacgggtccggttacccgtaccgggttacccggttccgtaacccggg

SEQ ID NO: 178576 - DNA, 802 bp, Homo sapiens
  misc_feature: GYAE6OF02JITK4.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagacgtgtggtgacccgaggacgccagtcgttgcacggtcggtccccgggggggactacggtccgaaccactctacgttggtggtcttgagcctcgtggctcgagtctacaccgttggttacccaccccgagtccgtaggtaccacgccaaccggaccccaggacccacggccctacccgacgaccgaccgtcctacgactacgtaacgtaactactaaagtaccgtcgtccttccgttacggttcgggttaacccctgtacgttccgtccttccgttcgtaccgtccgttaccgtaccgttaccgtttacgggaaaaccttaacggtacccttaccgtccccgtaaccgaaccgtaccgttaacccggggacccgggggtccccaacgggaacccgtaacgacgttacggaacttaagggtacgttcggttacgtaaaggttttaactttacgttggttaaccgggttcgttacggtttacggttacgttgggttacgggggtttaccgggtttcgggtttttaccggtttttacggtcggggttaccgggggtacgggaccgggtaaccggtacccggttaccggttaccggtacccgtaacccggtttacccgg

SEQ ID NO: 178577 - DNA, 736 bp, Homo sapiens
  misc_feature: GYAE6OF02JZSS9.49.24.C02.1.454.CMB.1.raw
  modified_base (331)..(331): a, c, t, g, unknown or other
  misc_feature (331)..(331): n is a, c, g, or t
tcagagtcgagagacacgaccggtgctcgatttagtacagatcgttagggaaaggggaaaagccctgaggaaaacaaaccccagctgggaagcctgagaacacgtagccttcatgagtgtccccaccatggcctggatgatgcttctcctcggactccttgcttatggatcgaggtgtaggaatctcagactggtggtcgacccgaggagcctatcgttgtcgtaggtccgggtccccgggggggactacggtccacgtacttccgtacgttggtcggtacttgacgtcttcgtggtctcgtacgtctacgacgttcggttaccaccccgngtacctcggtaccagtaccaaccggaccccgacggccgacggacctccacgccaccgtctacgtacttaggtaaccaataacgtaacgtacgtccgtacttccggttacggtccgggtacctacggtacgtccgtctttcgtcgtcgtcctacgtacttaccggtacggaactaacggtctccggacccttaccgaaccgtcgtaacccggggtccgggtacccgtaggaccgtaacgtacgtaccgtagtaacggtaccgttcggttaaacgtttatttaacggtttacgttcggttcgtacgtacgtttacgtagggttccggttaggttcgggttacgtttcggtttggtaccggtcggtacggtacgtacggagtcccggtacgttaccgtacggtacccg

SEQ ID NO: 178578 - DNA, 876 bp, Homo sapiens
  misc_feature: GYAE6OF02GIPHQ.49.24.C02.1.454.CMB.1.raw
  modified_base (188)..(188): a, c, t, g, unknown or other
  misc_feature (188)..(188): n is a, c, g, or t
  modified_base (244)..(244): a, c, t, g, unknown or other
  misc_feature (244)..(244): n is a, c, g, or t
  modified_base (277)..(277): a, c, t, g, unknown or other
  misc_feature (277)..(277): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtcccaccatggcctggatgatgcttctcctcggactccttgcttagtggtatcgaggtgtggaatctnagtactgtggtcgaccgaggcgccagttcgtgtcgtaggtcgggtcccggggggangtcacactctacttcggtggcttgatcgttcgnggctcgagtcctacgtaacgtttcgttaccctaccccgagtccgttacggtaaccgacgaccgtaaccggtacccccggacgggtacccgaacgggccctacccgaccgggcctacggccctacgtacgttcgaaccgtaataaccgtaaagtacgtaccgtcctacggtttccggtaccgggggttccctacgggtacgttccttacctttcccgtacgttccggtccttaacgttacgttaccggtttaacgggaaaactaaccggtctaccccggttcccgaaccgttaccgtaaccggtaccccggggacccgggggtaccctaaccgggggacctacgggtaccttaagggtaacgttacggtaaacgttacggttaaccgttttaaggttttacgtttaccggggttttggttagtttacccgggtatttacccggtttacggtttacgggggttagggtttccgggggtttttccgttttttacgggtttaaccggggttttccgggggtacccgggtaaccggggtaacccgggtaacccgtttaaacggcccgggtttaaccgttaccccggggtttcgttaaccccggg

SEQ ID NO: 178579 - DNA, 924 bp, Homo sapiens
  misc_feature: GYAE6OF02HKZK2.49.24.C02.1.454.CMB.1.raw
  modified_base (264)..(264): a, c, t, g, unknown or other
  misc_feature (264)..(264): n is a, c, g, or t
  modified_base (678)..(678): a, c, t, g, unknown or other
  misc_feature (678)..(678): n is a, c, g, or t
tcagagtcgagagacacgaccggtgctcgatttagtacagatcgttagggaaaggggaaaaggccctgaggaaaacaaaccccagcctgggaagcctgagaacacgttacgccttcatgagtgtccccaccatggcctggatgatgcttctcctcggacttccgttgcttagtggatcgaggtgtggaatctcagtactggtggtacgacccgaggacgccagttccggtttgtacacgggtccgggtacccccgggggggtanacggttacaaccactccgtacgttggtcggtcttagacgtcgttccgttggtctcgtaattccgtaaccgtaaccgttacggtttaacccctaacccccgtagtacgttaccggtaacccgaacgaccgtacccgtacccccgaacggggtaccccacgggtaccctaccccgaccggaccctacccggtacttacgaacgtacgtaacggtaaattaacctaaaagttcgtaccgtcctttagtttacccggtcggggtacccttacgtacgttccgtacctttcgtaccggttcgttcctccgttaacgtttacccgttaaaggaaaccctaaacggtcctaccgacccgttaccgaacccgttacgacccgggaacccggtaccggaccgggtacgtaagtaaccggttanaagggttcgtaaacggttacgttacgttaagtttaactttaacggttcgggttgttaccgtacggttttaccgttaacggtttcgggtttagggttaccggggtttttaccggttttacccggggttttttacgggtaacgggttttttacccgggggaacggggttaacccccggtaacggttaaaccccgggtttccgggtttaaaccccggtttaccccgggttaccccggtttaaacccggg

SEQ ID NO: 178580 - DNA, 776 bp, Homo sapiens
  misc_feature: GYAE6OF02GX243.49.24.C02.1.454.CMB.1.raw
  modified_base (660)..(660): a, c, t, g, unknown or other
  misc_feature (660)..(660): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttcttgcttatggatcgaggtgtaggatctcagactgtggtcgaccgaggacgcctagtcgttgtcgaggtccggggtccccggggggataggtccacgtactccgtacgttaggtcggtcctacggacgtccgtcgttggtacctgttaacgtccttaccgtaacttccggttaaaccctacccccgtaaggtccgttaccgggtaacccgtaaccggacccggaaacccgggtaaccccccggacggggtacccccgaacggggtaccccttaccccggaccggaccgtaccggtccctacggtacttacggtaaccgtaactaaacgttaaacgttccgtaccgtcgttaccggttccggttacgggttcctacgttacggtacccttcctttcgtccggtgttaccctcgtaccgtttacggtaacggtaaccggaaccgtccgttcctcccgtaccgacctacccgggccgggtaccgggacgtacggacgagtacgtntaggtacctaggtgtagttacttagttcgtgttcgtgtacgttcgtagttcggtgggtcgtttcggttgtttcggtcggtcggtacggcggtatcgtcggacgtccgtacgtaccg

SEQ ID NO: 178581 - DNA, 771 bp, Homo sapiens
  misc_feature: GYAE6OF02HP3N4.49.24.C02.1.454.CMB.1.raw
  modified_base (616)..(616): a, c, t, g, unknown or other
  misc_feature (616)..(616): n is a, c, g, or t
tcagagtcgagagacacgaccggtgctcgatttagtacagatcgttagggaaaggggaaaggccctgaggaaaacaaccccagctgggaagcctgagaacacgtagccttcatgagtgtcccacatggcctggatgatgcttctcctcggactccttgcttagtggatcgaggtgtacggaatcgtcgagtcgtgtggacgaccgagacgacgtagtcgtcgtcgtacgggtccggggacccggggatacgacctactacgtaccgtaggttggtcgtcgttacggcgtccgttcgtcggtcctcgtaccgttacctaccgttaaccggttaccgttacccctaccccgtacgtaccgttaccggtacccgtacgaccgtacccggaaccccggtacgggcccgaccggtcccacccgaaccgcgtaccgtaccgtagtaacgtaccggtaacgtaaacctaacggtaaacctcggtccgtacctttaccggttccgggtttaccggtcgtacgtcgttaccgttccgttcgttcgtacggtcctacgtccgttacgaacgtaaacgtcgacgtccacctacgacgtacggcccgggtacggccgtagtcgtaagngtgtaacgtagtaacgtcggtttaatacgttcttacgggtcttacggtgttacggttgttaggttacggggttggttaccggtttggttttccggtttacgggtcgggtaccggacggtaccggacgtacgtccgtaacctccggtacgtacccg

SEQ ID NO: 178582 - DNA, 851 bp, Homo sapiens
  misc_feature: GYAE6OF02HUZLB.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccacatggcctggatgatgcttctcctcggacctccttgcttagtggtatcgtaggtgtggaatcgtcagactggtggtcgacccgtaaggacgtcctagtcgttgacgtacggtccgggtaccccggggggatacgtaccgaccgtaccgttacgtaccgttggtacgtccgttagtacgtcgttcgttacggtccgtacgtacgttaccgtacgttaacgttaccgttacccgtaacccgtacgtaccgtacggtaaccgtaccgaccgtaaccgaccccgacggaccgacgtaccgaccgaccgtaccgaccgtacgtacgtacgtacgtaacgtaacgtaaacgtaacgtacgtccgtacgttccggttacggtccggtacgtacgtacgtcgttacgttccgtccgtaccgtaccttacgtaccgttaccggtaacggtaaaccgtacgtccgtacccgtacccgtaccgtaaccggtaaccggtacccgggacccgggaaccggtacggtaacgtaacggtaacgtacggtaaggttacggtaacggttacgttagtttaaccgttaacgttacggttacggttcgtacgttacgttacggttcggttacgggtttacgggtttcggttaccggttttccggtttcgggtcgggttacccgggaacggttaccggtaaccggtccggttacccggtacccggtttaccggtacccggtaccgg

SEQ ID NO: 178583 - DNA, 850 bp, Homo sapiens
  misc_feature: GYAE6OF02HRXQQ.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtaggaatctcagtactgtggtcgacccgaggacgcctagtcgttgacgaggtccgggtccccggggggatacggtcacctacgtctacgttgtcggacgttgacgtctacgtcggtcctcgtacgtcttacgtaaccgttccggttaacctaccccgtagtccgtacggtaaccacgaccgaccgacccgacgggccgtacggcccgtaccgaccggacctaccggtacctacgtacgtaacggtaaccgtaactaaactaaacggttcggttaccgtcctttaccggttcgggttacccggggtccctacggtacgttaccgtactttccgcggttcgtaccccttaccgtaccgtttacccggttaaacggaaaccgtaacgtcccgtacccgtacccttacccgaactaccggacccggaccgggtaaccgggtacccgaggaccgtaacggtcgttaacgtagttaaggtacgttcggtaacgtttaattttaccggttaacgttggtcgttagtaccgggtttacgttacggttacgggggtttacggggtttcgggtttaccggtttttccggggttttcggtaccggggtttccgggggtaccggggaaaccgggttacccgggtaaccggtttccggttacccggttaccccggttaacccggg

SEQ ID NO: 178584 - DNA, 677 bp, Homo sapiens
  misc_feature: GYAE6OF02H2ZDQ.49.24.C02.1.454.CMB.1.raw
  modified_base (319)..(319): a, c, t, g, unknown or other
  misc_feature (319)..(319): n is a, c, g, or t
  modified_base (495)..(495): a, c, t, g, unknown or other
  misc_feature (495)..(495): n is a, c, g, or t
tcagagtcgagagacacgaccggtgctcgatttagtacagatcgttagggaaaggggaaaggccctgaggaaaacaaacccagctgggaagcctgagaacacgtagccttcatgagtgtcccaccatgcctggatgatgcttctcctcggactccttgcttatcggatcaggtgtcggaatctcagacgtgtggtgacccgaggacgccatcgttcgtctacggtcggtcccggggggacaggtcacactcacttagtggtcttgatctcgtcgctcgagtcgtctaacgtgttacctacccgagtccgtggtaacccngaacccgtaccggaaccccgacggtaccgacggtcccgtaccgaccgtaccgaccgtctacgtactagtaacgaacttaacgaagtacgtcgacgttcgttacgtcgggtccctgtacgtcgtcttactcgtcggtacctcgcttacgtcgaaacgaacgctcgtccctactaccncgtcggaccgggcctacggctagacgtgaacgtagtacgtcggtatacgttaccgtcgtttagtcgttacggtccttagttacgtttcggtgggtttacggtcggtttccgtttacggttaccggttacgggcgggtaaccgggtcctaaccggttcggtccgtaccggttcccgtaaccgg

SEQ ID NO: 178585 - DNA, 807 bp, Homo sapiens
  misc_feature: GYAE6OF02GXVF2.49.24.C02.1.454.CMB.1.raw
  modified_base (380)..(380): a, c, t, g, unknown or other
  misc_feature (380)..(380): n is a, c, g, or t
  modified_base (666)..(666): a, c, t, g, unknown or other
  misc_feature (666)..(666): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggacttccttgcttagtggatcgtaggtggtggtaactctcagacttggtggtgacccgagggacgcctagttccgttagtcgtaggttccgggtccccggggggtatacggtcacgtactcgtacgttcggtcgtacgttgacgcgttcgtcggctcgagttctacgtacgttacgttaaccctacccgagtccgtacggtacacgactaccgacccgaggtaccgnggcctacaccgcacgctacgtagttacgacgtaactaaaccgtaagtacgtccgtacttccgttaccgggtcgggttacccctagggtactacccgttctttccgtacccgtcgggtccctaccgttaccgttaccggttacgggaaactaaacgtcccgtaccgtccctaaccgaccgtaaccggtcccgggtacccgggtaccgacgggtaccgtaagggaaacgttacggtaagtaaaccgttgttaccgttaaggtttaccgtttttaaacgtaccggtttntcgggtttactcggtttagttaccgtagggttttgggtacggttttcggttttcggtttttaccggttccgggttacggggtacccggtaacggtaaccggtttacggaccggtaccggttacccggttacgtaccccggg

SEQ ID NO: 178586 - DNA, 675 bp, Homo sapiens
  misc_feature: GYAE6OF02FYBU8.49.24.C02.1.454.CMB.1.raw
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (417)..(417): a, c, t, g, unknown or other
  misc_feature (417)..(417): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactcctgcttatggatcaggtgtggtaatttcagactgtggtgacccaggagccatcgttgtcagtcggtccccggggggacagtcacactctactgtgcttgngctcgtgctcnctctcacgttacgttaccacccagtctacggtaccagcaccgaccccgacggcccgacggtcctccgaacgcaccgctcatgtaacgaataacgaaaagttcgtacgctttcgttcggtacgggtccctgtctcgtcctttcgtccgnggtcctaccgtacgttaccgttaggtaaaccgtaacgtccgtccgtccctacctaccgtacgtacccgggacccggggaccgtacggacgacgtacgtacgagtagtagtaggttagttactttacgttacgttagttgttcgtcgttcgtagttcggttagggttcggttcggtttcgtttttcgggttcggttaccgggtcgggtaacggtaccggtacggtacccgtaccgttacccggtaccgtccgtacccgg

SEQ ID NO: 178587 - DNA, 740 bp, Homo sapiens
  misc_feature: GYAE6OF02H1RNK.49.24.C02.1.454.CMB.1.raw
  modified_base (286)..(286): a, c, t, g, unknown or other
  misc_feature (286)..(286): n is a, c, g, or t
  modified_base (378)..(378): a, c, t, g, unknown or other
  misc_feature (378)..(378): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccattcgttgtcaggtcgggtccccgggggggactacggtccacactcacttggtggcttgagctcgtggcctcagttcnctaaccgttggttaaccctacccccgagtcgttacggtaaccacgccgaacgaacccccgagggcccgagggcctcccacggcaccgcctanagtgtaacgactaacaaagttcgtcgtctcgttcgtacgggtccctgactcgtcctttcgtcgtcggtcccttaccgtacgttcccggtttaaggggaaaacctaaggtcccgtaccggtcccctacgaaccccgtcggtacccgggaacccgggggtaccccaaggggtccaacggttaacgtggaacgttaggaaacgttagttacgttaacgttttacgttacgttggttcgtacgtcgttaaggttacgttcgggttcgggggttgtttcgggttttccgtttttcgggtacgggttccgggacgggttaaccgggacctaacgggtccgttaaccggtcccgttccgttaacccggg

SEQ ID NO: 178588 - DNA, 878 bp, Homo sapiens
  misc_feature: GYAE6OF02I43RO.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactgtggtcgaccgaggacgccatcggttgtcgacggtcgggtaccccggggggactacggtaccgacctaccttccgtacgtttggtcgggttcttggaacgttcgtccgtacgccttacgtacgttccgtactaaccgtttcggttaaccctaccccgagtccgtaggtacccacgtaccgaaccgtacccccgaacggcccgaacggtaccctacccgaccgtacccgtccggtacctacgttactaaccggtaaccgtaacgttaacgtaaacgtacggttccggttacctttaaccggtttccgggtacccggggttccttaacgtcgttccgttaccctttaccgttccggtccggttacccttcccgtaccggtttaaccgttaaccgggtaaacgtaaacgtcccgttacccgtacccctaacctacccggaaccggtcccgggaaccccggggatacccggacgtaaggtacgtacggaacgttacgtacgtttacgtaagtttaactttacggtacgtttaggttacgtcggttcttaccggtttaggttcgggtttacggggtttcggtttacgggtttttccgttttgggggttacccgggttacggggaacccgggttaacggtaaccgggttaccgtcccgggtttaacccgtacccgggttacccgtaacccggg

SEQ ID NO: 178589 - DNA, 626 bp, Homo sapiens
  misc_feature: GYAE6OF02I375Q.49.24.C02.1.454.CMB.1.raw
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgcttctcctcggactccttgcttatggatcaggtgtggaatctcagactgtggtgaccaggagccatcgttgtcagtcggtccccgggggggacacgtcacactcacttgtggcttgagctctggctcagtctactaactcggttacctaccccagctcggtaccagaccacggaccccgagggccacggcctccaccgcacgctcatgtacgatacaaagtcgtaccgcttcgttcgtcggggtccctggacgtcgtccttcgttcgtcggtcctacctactccgttacgggaacaaacgtctcgtccctacaccacgtaccgaccgggggccacgggaccagactagataggaattggtagtagtttattacgttagttgtgttcgttagttagttcggttagggttgggtttggtttcgttttcggttcggtttacgggtacgggtacgggtacgtacggcggttacgtaccgtcccgtacg

SEQ ID NO: 178590 - DNA, 886 bp, Homo sapiens
  misc_feature: GYAE6OF02HEFTJ.49.24.C02.1.454.CMB.1.raw
tcagagtcgagagacacgaccggtgctcgatttagtacagatcgttagggaaaggggaaaaggccctgaggaaacaaacccagctgggaagcctgagaacacgtagccttcatgagtgtccccaccatggcctggatgatgcttctcctcggactccttagcttagtggatcaggtgtaggtaatctgagactggtcggtacgacccgtagggacgacctagttcggttcgtacgtacgggttccgggggtacccccgggggggggactacgggttaccaaccgtacctaccgtaaccgtttggtacgggtcctttaggaacgtcctccgttacgggctcaaggttcctaccgaaaccgttggttacccctaccccgaggtccttacgggtacccgaacgacccgtaaccggacccccgtacgggacccacgggtccgtaccccgaccggaccgaaccgtcctacacggtttacggtaaacgaaactaaccgtaaaagttaccggttccgtaccgtttcgtttacccgggttaccggggtacccttaacggtcttacccggtcctttccggtacgtccgggtccctttaccgtacgttacccgggtaaggaaaccaaacggttcccgtaccgtaccctaccctaaccggaccgtaccccggggaacccgggggtacccgacggacggtaacgttacgtacggtaattacgggttacgtagggtaaccgttaagttttacgttaccggttaggttccgtgttaaccgtttgtacggttcgggttacggggtttacggttttcggttttacccggttttggtacgggttaccggggaccgtacgggtaaccgtgtaacccggttacggttaccccgtataaccccggg

SEQ ID NO: 178591 - DNA, 763 bp, Homo sapiens
  misc_feature: GYAE6OF02G7MH8.49.24.C02.1.454.CMB.1.raw
  modified_base (190)..(190): a, c, t, g, unknown or other
  misc_feature (190)..(190): n is a, c, g, or t
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagagtcgagagacacgaccggtgctcgatttagtacagatcgttagggaaaggggaaaggccctgaggaaaacaaacccagctgggaagcctgagaacacgtagccttcatgagtcgtcccaccatggcctggatgatgcttctcctcggacttcctgtcttagtggatcgaggtgtcggtaatcctnaagtcgttggtggtcgaacccgagggaccgcctaagttccgttgtcgtacgggtcgggtaccccggggggatacggtccactacgtctacgttggtggtcttgatcgtcgtgctagtacgtctactacgttcggtaaccctcccgagtcgtgtaaccgngaaccgccggaaccccaggtccccaaggcctacccgacncgcncctanacgtgtaacgataaacgtaactacgtcgtaccttcgttcggtacgggtcccttgacgtccgttacttcgtacgtctacctaccttacgttacgttaaggaaaccgtaacgttcccgtccgtacccgtcctaaaccggtcggtacccgggacccggggacccgaacggttcgaaccgtgtaccgtaagtagtaacgtaggttactagttttacgtacgttaggtcttccgtagtttaacggttcgttcggggttacgggtttcgggtttcggtttttcgggttttccgggtaacggggttccggggttaaccgggaccggttaacgtaccgggttcccgtaaccggttcccgttaccggtaacccgg

SEQ ID NO: 178592 - DNA, 904 bp, Homo sapiens
  misc_feature: GYAE6OF02H6KVP.49.24.C02.1.454.CMB.1.raw
  modified_base (253)..(253): a, c, t, g, unknown or other
  misc_feature (253)..(253): n is a, c, g, or t
tcagagtcgagagacacgaccggtgctcgatttagtacagatcgttagggaaaggggaaaaggccctgaggaaaacaaaccccagctgggaagcctgacgaacacgtagccttcatgagtcgtccccaccatcggcctggatgatgcttctcctcggactccttgcttatggatcaggtgtggaatctcagactgtggcgacccgaggacgcctatcgttgtcgaggttcgggacccggggggacaggtcacnctctactggtgtcttagacgtctcgtggtacctacacggttctacgtaaccgttcggttaacccttaccccgaaggtccgttacggtaaacccaggcccaaccggaccccgtaacggccgaacggtccaccacggacctacgccgtactacgtacggtaccgaactaaacgtaaactcggttaccgtacgttccgttacccggtacggggttaccctggaccgttccgttacgttccgtacgtccgggtaaccctccgtaacgttaccggttaacgggaaaccgtaacgtccgtaccggtccttaacccgtaaccggtcgtacccgggaaccccggggttacccgaacggtaccgtaacgtaacggttacgtaaaccggtttaggtaaaccgttagggttaaccgttaaacgttttaaaccgttaccggtttaagggtttacgggtacggtaaccgttttaacgggtaaccgtttcgggggtttaccggggttttaacgggtttccgggttttttaccgggttttttaaccgggggaccgggtttttaacccggggacccggggggtttaacggttaaaccccgggttaaccgggtttacccgggtttaccccgggtttaaacccccggttacccccggtttaaacccggg

SEQ ID NO: 178593 - DNA, 1058 bp, Homo sapiens
  misc_feature: GYAE6OF02G1W70.49.24.C02.1.454.CMB.1.raw
  modified_base (210)..(210): a, c, t, g, unknown or other
  misc_feature (210)..(210): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcgaggtgtggaatctcagactgtggtcgacccgaggacncctagttcggttcgtacgacgggttccgggtacccccggggggggaactacggtaccgaaccgtaccgttacgtaccgtttcgggtcggttaccgttggtaacgtcccgttccggttcgggtccttacgtaacggttcccttaccgttaaaccggtttaccggtttaaacccccgtaaccccgtaacggtcccgttacgggttaaccccgacgtacccggaaccccggtaacccccggtacgggaccccgacgggtaccctaccccgaccgacccgtaccgtaccgtactaggttaccgtaaacgtaacttaaacgtaaaacgttcggtaccgtaccgtttccgttccgggtttacccggggttaccccttaggtaccgttacccgtttcccgtttcccgttaaccggtccgggtttaaccccttcccgtaaccgggttttacccggttaaacgggtaaaacccggtaacggttaccccgttacccgtacccccttaacccgtaaccccggtaacccggttaccccgggggaaccccgggggtaaccccgtaaccggggtaaccggttaaacggtaaccgttacggaaacgttacgggtttaaacggttacggtttaagtttaaccgttttaaaccggttcggtttacggtttaaccggtcgtttaaccggtttggtttaacccgggttttggggtttaacgggggttttccgggttttaccgggggtttttccgtttttaccggggtttaccggggttaccgggggttaaccgggttaaccgggttacccggttaacgggttaccccggttaaccgggtttaccccgggttacccgttaaccccggg

SEQ ID NO: 178594 - DNA, 706 bp, Homo sapiens
  misc_feature: GYAE6OF02HHFFZ.49.24.C02.1.454.CMB.1.raw
  modified_base (148)..(148): a, c, t, g, unknown or other
  misc_feature (148)..(148): n is a, c, g, or t
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttcncctcggactccttgcttatggatcgaggtgtggaatctcagactgtggtgaccgaggngccagttcgttgtcaggtcgggtccccggggggacngtacgacactactacgttggtggcttggacgtcgttctggccttcgtaatcctacgtaaccgttacgtaaccctaccccgagtccgtacggtaccagtccaacggaccccgaggccgaggcctccgacgcaacgctcagtcgtaacgaactaacgaaataggtcctcttccttacggttccgggtcctagtacgtcgttactcgtcgtgtccctccgtacttaccggtacggaactacggtactaccggccctacgacctacggtaccggaacccggggacgacggaccgaagacgtactaacggtacgtaagttcgttaacgttagtttacgttacgtggtttacgtcgtagttacggttagtcgggtttgggttaggttcgtttacggtttttcgggtacgggttacgggcgggttaacggtaccggtacgtaccggttaccgttacccgtaccgttaccgg

SEQ ID NO: 178595 - DNA, 862 bp, Homo sapiens
  misc_feature: GYAE6OF02HWN6W.49.24.C02.1.454.CMB.1.raw
tcagagtcgagagacacgaccggtgctcgatttagtacagatcgttagggaaaggggaaaaggccctgaggaaaacaaaccccagctgggaagcctgagaacacgtagccttcatgagtgtccccacatggcctggatgatgcttctcctcggactccttgcttatcggatcaggtgtaggaatctcaagtcttggtcggtacgacccgtaggacgccctagttcggttgtacgagggttccggggtaccccgggggggatacggtccacctactcgtaccgttggtcgtacgttaggacgtcctacgttcggtacctacgtacgttacctaccggtaaaccgttccggtttaaccccctaaccccgtagtacccggttaccggttaaccccgaagtacccgtaaacccggaacccccggaagtcccgggtaacggcccttaccccggaccgaccgtaccggtaccttaccgtaaggtaccgtaaccgtaaaccttaaaacggtaaaaccgttcggtacccgtttaccgtttacccggtttaccggttcccggggttaccctaggttacccgttcgttacccttcgtaccgtcgtaccttaccgttacgtaccggtaacggtaacgaacgtcgtaccgtaccctacgtacccgtaccgtacccggaccgggtaccgtacggacggtagacgtacggtaacgtagtacgttagtagtactttagttacgttgtcgtagtacgtttacgttcggttcgggttacggttcgggttcggttttccggttttcgggtaacgggttccgggtaacgggtacggtaccgtaacggttccggtaaccggttaccgtacccgttacccggg

SEQ ID NO: 178596 - DNA, 809 bp, Homo sapiens
  misc_feature: GYAE6OF02IHWSO.49.24.C02.1.454.CMB.1.raw
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (333)..(333): a, c, t, g, unknown or other
  misc_feature (333)..(333): n is a, c, g, or t
tcagagtcgagagacacgaccggtgctcgatttagtacagatcgttagggaaaggggaaaaggccctgaggaaaacaaaccccagctgggaagcctgagaacacgtagccttcatgagtgtccccaccatggcctggatgatgcttctcctcggactccttgcttatggatcaggtgtggaatctcagactggtggtcgacccaggacncctatcgttgtcaggttcgggtcccgggggganacggtcacactcacttggtcgtcttgacgtctctggcctcgtagttcctcgtaacgttcggtaccctaccccgagtccgtaggtaacccgngtacgaaccgaccccgaggtcccgaacggtccctacccgacgtacccgcgtacctcgtaaacgttcgtaacgtaaactaaactaaacgtttacggtccgttaccgttaccgtttccgggttcccgggggttacccttacgggttaccgttcccggtttaccttttccccgttaccggttacgggtaccccttttcccgtaaccggttttacccggttaaaccgggtaaaaccgtaaaccggtcccgttaccgtacccccgttaccaacccgtaccgttacccgggaccccgggggaccaacgggacctacggtagtacgagtacggtaacgttaggttacgtaaggtttaccttacgtgttgtacggtctttaccggtagttcgggttaggggttcggtttcggttttcgtttcggggtaccggttcgggtaccgggtacgtacggacgtaccgtcggtacccggtacgttaccgg

SEQ ID NO: 178597 - DNA, 990 bp, Homo sapiens
  misc_feature: GYAE6OF02G0PER.49.24.C02.1.454.CMB.1.raw
  modified_base (105)..(105): a, c, t, g, unknown or other
  misc_feature (105)..(105): n is a, c, g, or t
tcagagtcgagagacacgaccggtgctcgatttagtacagatcgttagggaaaggggaaaggccctgaggaaacaaacccagctgggaagcctgagaacacgtanccttcatgagtcgtcccacatcggcctggatgatgtcttctccgtacggacttccgttgtcttagtggatccgaggttggtaggtaactctcgagtacgttggtcggtaccgaaccggtaggacgtaccctaagttccggttacgtaccgtaacgggtccgggggtaccccgggggggtaactacggtaaccgtaaccgtaccgttaaccgtaccggttttaggtcggtaacgtttcggaacgttccgtaccggttcgtaccgtaccgttacggtactaaaccgttaacgttccggttaacccgaaccccgtggtaccgtacggtacctacgaccgaccggtaaccccgacggaccgtaacggtcccgtaccgaccgtacgtaccggtactaccgtacgtaacgttaaccggtaactaaacggtttaaacgtacgttaccgttcgttaccgtttccggttaccccggggttccaggtttaaccgtcccgttttaccgtttcgtaccgttacgggtacccttaccggttaaccggttacccgggtttaaacggaaaccggtaaacccgttaccgtacccggtaacccgttaccgtaaaccggtaacccggttaccccggggaacgggttaaccccgtacggaacgtaaccgggttaacgtaacggttacgttaaacgttaaccggttaaggttaaccgttttaaagttacccggttttaagtccgggtttaccgggttacttaacgggttacggtttacggtttcggggtttaacggtttccgggttttaacgtttcgggtttttaccgggtacggttaaccggggtcggtaacccggtacgttaacccggttcccgtacgggtttaacccctcgggttaaaccgg

SEQ ID NO: 178598 - DNA, 737 bp, Homo sapiens
  misc_feature: GYAE6OF02F4J7Z.49.24.C02.1.454.CMB.1.raw
  modified_base (209)..(209): a, c, t, g, unknown or other
  misc_feature (209)..(209): n is a, c, g, or t
  modified_base (558)..(558): a, c, t, g, unknown or other
  misc_feature (558)..(558): n is a, c, g, or t
tcagagtcgagagacacgaccggtgctcgatttagtacagatcgttagggaaaggggaaaggcctgaggaaaacaaaccccagctgggaagcctgagaacacgtagccttcatgagtgtccccaccatggcctggatgatgcttctcctcggacttcctgcttatggatcgaggtgtggaatctacagtacttggtcggtcgaacccgnggtacgccgtaagttcggttgtcagggttccgggtaccccgggggggatacgtcaacactctacgttggtcggtcgttagacgtcgtcgtaggtcctacgacgttcctaacgtaacgtttcggttaacccaccccgtagtccggtcgtaacccgagtaccgaaccggtacccacggccgtaacgcctaccgaccgccaccgtcctacacgttagtaaccaactaacgtaactcggtccgttacctacgtttaccgggtccgggttcctaggtaccgtcgttccttaccggttacgtcgttacccgtcttacggttaccgtacggtaaaccgaacggtactccgtacccnccttaaaccggacgtacccggggacgggtacccagggacgttaacgagtacgtagtacgttaagtcgttacgtagtttacgttgtagttgtcgtagtgtcggttggtggttggttcggtttacgttcggttagggtccggtaggtacgaccggttgtacgttaccggacctcggtaccg

SEQ ID NO: 178599 - DNA, 734 bp, Homo sapiens
  misc_feature: GYAE6OF02GQ0AC.49.24.C02.1.454.CMB.1.raw
  modified_base (262)..(262): a, c, t, g, unknown or other
  misc_feature (262)..(262): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
tcagagtcgagagacacgaccggtgctcgatttagtacagatcgttagggaaaggggaaaaggccctgaggaaaacaaacccagctgggaagcctgagaacacgtagccttcatgagtgtccccaccatggcctggatgatgtcttctccgtcggacttccttgcttatggtatcgtaggtgtggtaatctacgagtacgtggtggtcgacccgaggcgccagtcgttgtcgaggtcgggtaccccggggggatacgtcacncctctacgttggtgtcgttgactctcgtacgctcgactcacacgttcgttacctcccgcgtcgtacgccacgacgaccgacccgcggcgacggtcctaccgaccgacaccgctanagtcgtanaactaactaaagtcgtactacgtcgttcggtcggtacctgtacgttcgtacttcgtccgtacgtccttacgtcgttaccggttaggaacgtaacgtcctaccgtccctacgacccgtacgtaccggacccgggaccgacggtacgcggtaagtacgtacgagttaacgttacggtatttaacgtttaaccgtttaggtttcgttacgttcgttacgtttacgggtttacgggtcgggtttagggggttcgttttacgggggtttccgtttttcggggtcgggttaacccgggggtacgggtcgttaaccggtaccggttacccgttacgggtcccgttaccgtacccgg

SEQ ID NO: 178600 - DNA, 483 bp, Homo sapiens
  misc_feature: GYAE6OF01DSYNX.44.10.A10.1.454.CMB.1.raw
tcagacagtatatacacgaccggtgctcgatttagcgtcgatctcaggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtatcccagccaggttcagtggcagtggtctgggacagagttcactctcaccatcagcagcctgcagtctgaagtattttgctagtttattactgtcagcagtataatgactggcctcctcgccaagggacacgactggagagttaaagaactgtgctgcacatctgtcttc

SEQ ID NO: 178601 - DNA, 513 bp, Homo sapiens
  misc_feature: GYAE6OF01A65V0.44.10.A10.1.454.CMB.1.raw
  modified_base (266)..(266): a, c, t, g, unknown or other
  misc_feature (266)..(266): n is a, c, g, or t
  modified_base (439)..(439): a, c, t, g, unknown or other
  misc_feature (439)..(439): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaancccctgaactcctgatctctgctgcctccactctgcaaggtggagtctcttcaaggttcagtggcagtggatcgtgggacagtatttcacttctcaccatctcagtctgacaacctgaagtattttgactaacttactactgtacaacagtagttatacgtcgtccccgtttntaccgttttcgggtaccggggtacctaaggctaggagtactacgaaacgtactgtaggctgacaccatcgtgtc

SEQ ID NO: 178602 - DNA, 414 bp, Homo sapiens
  misc_feature: GYAE6OF01ELDGG.44.10.A10.1.454.CMB.1.raw
  modified_base (404)..(414): a, c, t, g, unknown or other
  misc_feature (404)..(414): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctagagcctgaagattttgctagtttatgactgtcagcagcgttcctccaggccgctcacgtttcggcgggggaccaagggtggagatcagacgaactgtggctgcacatctgtctcatcttcccgcatctgatatatactgtctgagcgggctggcaaggcgcatagnnnnnnnnnnn

SEQ ID NO: 178603 - DNA, 488 bp, Homo sapiens
  misc_feature: GYAE6OF01C53UH.44.10.A10.1.454.CMB.1.raw
  modified_base (294)..(294): a, c, t, g, unknown or other
  misc_feature (294)..(294): n is a, c, g, or t
  modified_base (389)..(389): a, c, t, g, unknown or other
  misc_feature (389)..(389): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccagggggaaagagccaccctctcctgcagggccagtcagagtgttagcagcaacttagcctcgtaccagcagaatctggccaggctcccaggctcctcatctatggtncatccaccagggccatggtatcccagccaggttcagtggcaggtggtctgggacagagttcactctcaccatcagcagcctgcagtctagaagtnttttgctagtttatactgtcagcagtataatgactggcctccgttcggccaagggacacgacgtggagtattaaacgactgtgctgcacatctgtcttc

SEQ ID NO: 178604 - DNA, 317 bp, Homo sapiens
  misc_feature: GYAE6OF01A8K95.44.10.A10.1.454.CMB.1.raw
  modified_base (312)..(317): a, c, t, g, unknown or other
  misc_feature (312)..(317): n is a, c, g, or t
tcagacagtatatacacgaccggtgctcgatttagcgtcgatctcaggctgtacattctacatggagttgtacagcctgagatctgacgacacgggcgtctattattgtgcgagagcccaacggaacctgcttctttctgactactggggccatggaaccctggtcaccgtctcctcagcctccaccaagggcccatcggtcttcccctggcgccctgctccaggagcacctccgagagcacagcggccctgggctgcctggtcaaggctacttcctcgatcgcgtctgagcgggctggcaaggcgcatagnnnnnn

SEQ ID NO: 178605 - DNA, 533 bp, Homo sapiens
  misc_feature: GYAE6OF01A1GE8.44.10.A10.1.454.CMB.1.raw
  modified_base (196)..(196): a, c, t, g, unknown or other
  misc_feature (196)..(196): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaacctggccaggcctccaggctcctcatctatggtgcatccaacagggccacgtggcactcccagccaggttcagtggcaggtggtctgggacagtacttcactctcaccatcagcagcctagacgcctagaagtatttgactagtttatgtactgtcagcagcgtagcaacgtggccgtatccgaccgttcggaccgaagggaccacggacgtacgggaagtaacgttaaaccggacgtaggtacggtccttacggacctacctagtcgttacg

SEQ ID NO: 178606 - DNA, 528 bp, Homo sapiens
  misc_feature: GYAE6OF01DDB8J.44.10.A10.1.454.CMB.1.raw
  modified_base (258)..(258): a, c, t, g, unknown or other
  misc_feature (258)..(258): n is a, c, g, or t
  modified_base (499)..(499): a, c, t, g, unknown or other
  misc_feature (499)..(499): n is a, c, g, or t
  modified_base (501)..(528): a, c, t, g, unknown or other
  misc_feature (501)..(528): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggacgcctgaagtatttttgngtattgttattactgtctattcctattcggttccccttaccgttacgttaacgttttcggaccgtacggggaacctaaactaggaaaactacgaaaacgtaacgttggtcggacctacgccaacctattccttgttaccttctaacttccctttaccccgctattctagtaattacgtaattcgtcgttcgtggaacgggtccgggtacgtcgggaacgaacgggtccgacgtaatacggngnnnnnnnnnnnnnnnnnnnnnnnnnnnn

SEQ ID NO: 178607 - DNA, 315 bp, Homo sapiens
  misc_feature: GYAE6OF01AB6Q2.44.10.A10.1.454.CMB.1.raw
  modified_base (313)..(315): a, c, t, g, unknown or other
  misc_feature (313)..(315): n is a, c, g, or t
tcagacagtatatacacgaccggtgctcgatttagcgtcgatctcaggctgtacattctacatggagttgtacagcctgagatctgacgacacgggcgtctattattgtgcgagagcccaacggaacctgcttcttctgactactggggccatggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatagnnn

SEQ ID NO: 178608 - DNA, 547 bp, Homo sapiens
  misc_feature: GYAE6OF01C09S3.44.10.A10.1.454.CMB.1.raw
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
tcagacagtatatacacgaccggtgctcgatttagcgtcgatctcagggggtcagtctcagtcaggacacagcatggacatgagggtccccgctcagctcctggggcctcctgctactctggctccgaggtgccagatgtgacatccagatgacccagtctccttcctccctgtctgcttctataggagacagagtcgccatcacttgccggcaagtcagaccattaacngctaatttaaattgtatcagcagagaccagggaaacncccctgaactcctgactctctgcctgcctcactctgcaaggtggatctcttacgtaaggttcagtggcaggtggatcgtgggacagtatttcacttctcacctatcctccagtctcgactaacctgaatattttcgactaactttactactcgtacaactaagtagtttactactcgtccccgtttcttacgttttcgggacggggtaaccaaggtcgtagggagtaacgtaaccgaaacgtacgttcggtagcgttcggaccacctattcgttgttacc

SEQ ID NO: 178609 - DNA, 320 bp, Homo sapiens
  misc_feature: GYAE6OF01BOJRF.44.10.A10.1.454.CMB.1.raw
  modified_base (312)..(320): a, c, t, g, unknown or other
  misc_feature (312)..(320): n is a, c, g, or t
tcagacagtatatacacgaccggtgctcgatttagcgtcgatctcaggctgtacattctacatggagttgtacagcctgagatctgacgacacgggcgtctattattgtgcgagagcccaacggaacctgcttctttctgactactggggccatggaaccctggtcaccgtctcctcagcctccaccaagggcccatcggtcttcccctggcgccctgctccaggagcacctccgagagcacagcggccctgggctgcctggtcaaggactacttcctcgatcgcgtctgagcggctggcaaggcgcatagnnnnnnnnn

SEQ ID NO: 178610 - DNA, 322 bp, Homo sapiens
  misc_feature: GYAE6OF01AQ99I.44.10.A10.1.454.CMB.1.raw
  modified_base (317)..(322): a, c, t, g, unknown or other
  misc_feature (317)..(322): n is a, c, g, or t
tcagacagtatatacacgaccggtgctcgatttagcgtcgatctcaggcgtgtacattctacatggagttgtacagcctgagatctgacgacacgggcgtctattattgtgcgagagcccaacggaacctgcttctttctgactactggggccatggaaccctggtcaccgtctcctcagcctccaccaagggcccatcggtccttccccctggccgccctgctccaggagcacctccgagagcacagcggccctgggctgcctggtcaaggactacttcctatatactgtctgagcgggctggcaaggcgcatagnnnnnn

SEQ ID NO: 178611 - DNA, 543 bp, Homo sapiens
  misc_feature: GYAE6OF01ADVBI.44.10.A10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccaggctcccaggctcctnatctatggtncatccaccagggccatggtatcccagccaggttcagtgcagtgggtctgggacagtagtcactctcacatcagcagcctgcagtctgaagtattttgctagtttacttactgtacagactagtaataatggtaacttcggcccttcccgttacggaccgaaagggaccacgtaaccgtaggaacgtaagttaaaaccgaacgttggtacggacttacggaccctaccgtaatccttaggttctttaccg

SEQ ID NO: 178612 - DNA, 638 bp, Homo sapiens
  misc_feature: GYAE6OF01DOL3A.44.10.A10.1.454.CMB.1.raw
  modified_base (281)..(281): a, c, t, g, unknown or other
  misc_feature (281)..(281): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgtcttctataggagacagagtcgccatcacttggccgggcaagtcaacgacctaattaaacagtacttaattttaaattggtatcagcagagaccgaagggaaacncccctagaactcctagactctctgctcgccctccactctgacgtaagggtggacgttcttcgttacgaaggttcaggtggctaggtggtactcgtgggaacaggtactttcacttctaccacctatcctcctacgttctacgacctaacgtagtaacgttattttacgaccttaactttactacttacgtactaacgtaagttaacgttaacttacgttaccgtaccccgtttacgttacggttttcggggtaccggggtacccgtaaggtccgtaggtaacgtaacgttaacgtaaaacggtacgttacggtacggtaccgtacgacctaacccgtacgttccgttcggtttaccc

SEQ ID NO: 178613 - DNA, 405 bp, Homo sapiens
  misc_feature: GYAE6OF01DIUH5.44.10.A10.1.454.CMB.1.raw
  modified_base (285)..(285): a, c, t, g, unknown or other
  misc_feature (285)..(285): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (398)..(405): a, c, t, g, unknown or other
  misc_feature (398)..(405): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctggagatttcgcgacttattactgccaacaatatctttttanccgtacagttttggccaggggaccaagctgagatcaaaggactgtgctgcacatctgtcttcatcttcccgcatctgatatatactgtctgagcggntggcaaggcncatagnnnnnnnn

SEQ ID NO: 178614 - DNA, 504 bp, Homo sapiens
  misc_feature: GYAE6OF01BI68K.44.10.A10.1.454.CMB.1.raw
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggttcagtggcagtggtcngggacagngttcactctcaccatcagcagcctgcagtctagaagtattttgactagtttattactgtcagctagtataatgactcggccttccgttcggaccaagggacacgactagggataacgttaaacgacgtgtcggctgcacattctgttcttac

SEQ ID NO: 178615 - DNA, 583 bp, Homo sapiens
  misc_feature: GYAE6OF01C9FZE.44.10.A10.1.454.CMB.1.raw
  modified_base (366)..(366): a, c, t, g, unknown or other
  misc_feature (366)..(366): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtcttgtctccggggaacagccaccctctcttgcagggccggccagactgttgacgacgacttagcctggtaccaacagaagcctggccaggcctcccagacctcctcatctatgatgcatccaacaggtcactggcacccagacaggttcagtgcagtggtctgggacagtacttcactctaccaccgtnagcaagtgtacagcctagaagtatttgactagtttattactgttacagtcgacgtcgtttccctccgacggcccgtcttaccgtaccggtttccggggaccggggggtaccgtaagggtggaagtacgtcgaacggaccgtaacgtggtcggccgttggaccctaccgtacgttcgttcggttcctttacgtacctttcccgtccccgtccttaccg

SEQ ID NO: 178616 - DNA, 527 bp, Homo sapiens
  misc_feature: GYAE6OF01AYG9N.44.10.A10.1.454.CMB.1.raw
  modified_base (196)..(196): a, c, t, g, unknown or other
  misc_feature (196)..(196): n is a, c, g, or t
tcagacagtatatacacgaccggtgctcgatttagcgtcgatctcagggggaggaactgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaggaactacttagcctggtatcaacagacacctggccaggctcccaggctcctcatctatgatgcatccaagtacgggccgcgggcactcccagccaggttcagtgcagtggtctgagacagactcactctcacatcagcgctagacgcggaagtatttgactagtttattactgtacaactaccgtagcgtactcggcctaggtactaggtttcggaccgtaggggtaccaaggcgtaggagctacgaaacgactggtcggctgcaccatctcgtcttctactccttcccgcctac

SEQ ID NO: 178617 - DNA, 526 bp, Homo sapiens
  misc_feature: GYAE6OF01BGWJA.44.10.A10.1.454.CMB.1.raw
  modified_base (266)..(266): a, c, t, g, unknown or other
  misc_feature (266)..(266): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaatggtatcagcagagaccagggaaacncccctagaactcctgatctctgctgccctcactctgcaaggtgagtctcttcaaggttcagtggcagtgatcgtggacagtatttcactctcaccatctacatctgacaacctgaagtacttttcgactaaacttactacgtgtacaactagtaagtttactacgtcgtaccccgtttagtaccggttttgggaccggggtactaaggcgtagggagtactacgaaaccggtatcggtgctgcctactactcgtgttacc

SEQ ID NO: 178618 - DNA, 662 bp, Homo sapiens
  misc_feature: GYAE6OF01CICRY.44.10.A10.1.454.CMB.1.raw
  modified_base (306)..(306): a, c, t, g, unknown or other
  misc_feature (306)..(306): n is a, c, g, or t
tcagacagtatatacacgaccggtgctcgatttagcgtcgatctcagggggtcagtctcagtcaggacacagcatggacatgagggtccccgctcagctccgtggggctcctgctactctggctccgaggtgccagatgtgacatccagatcgacccagtcctccttcctccctgtctgcttctagtaggagacagagtccgccatccactttcggccgggacaaacggtcaacgaacctaatttaaaccagtacttaattttaaaagttggtaatcgaagacaaggacgaaccgaaggggaaacncccctagaacctcctagactctctgctcgcctaccactctgcgtaaggtggtactcttactacgaaggttcgaaggtcggactaggtcggatcgtagggactaggtacttcacttctacactactcctccagtctacgactaaccgtagaattacgttttacgaaccttaacttactacgttacgtaacaaacgtagtaacgttacgtaaccgttccggttaccccgtttacgttaccgggttttacggggaacccggggtaacctaacggtacggttaggaaaccgttacgttaaacccgaaacggtacttagggtacggtacctacggaccctaactacgttcgttcgttaccc

SEQ ID NO: 178619 - DNA, 531 bp, Homo sapiens
  misc_feature: GYAE6OF01A8JOD.44.10.A10.1.454.CMB.1.raw
  modified_base (195)..(195): a, c, t, g, unknown or other
  misc_feature (195)..(195): n is a, c, g, or t
  modified_base (398)..(398): a, c, t, g, unknown or other
  misc_feature (398)..(398): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaanagccaccctctcctgcagggccagtcagagtgttagcagcaacttagcctcgtaccagcagaaatctggccaggctcccaggcctcctcatctatggtgcatccaccgagggccacgtggtactcccagccaggttcagtggcaggtgggtctgggacaggacgttcacttctcacctatcagcacgcctgcagtctgaagtntttgcttagtttattactgtcagtctagtaatatgactcggcccttccgtcggaccgaagggacctacgacgtagggagtaacttaaacggacgttggtaggccttcggacctacctattccttgttcttacg

SEQ ID NO: 178620 - DNA, 584 bp, Homo sapiens
  misc_feature: GYAE6OF01DJX8N.44.10.A10.1.454.CMB.1.raw
  modified_base (406)..(406): a, c, t, g, unknown or other
  misc_feature (406)..(406): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagacgcccaccctctcctacgagggccagtcagagtgtagcagcaacttagcctgtaccagcaagaaatctggccaggcctcccgaggctcctcatctagtggtcgcactccaccgagggcccacgtggtactccccaggccaggttcagtggcaggtgggtctgggacaggtagttcactctcacatcagcagcctgcagtctagaagtnttttgacttagtttattcgtagtcagtactaagtagttaatgtacgttcggtcccttccgttaccggaccgtaagggaacctacggtaccgtagggaaataacggtttaaaaccgtaagttcgggtcggtacctaggaccctaacctagttaccgtttcggttacctttcgtaacccg

SEQ ID NO: 178621 - DNA, 540 bp, Homo sapiens
  misc_feature: GYAE6OF01EL2KL.44.10.A10.1.454.CMB.1.raw
  modified_base (439)..(439): a, c, t, g, unknown or other
  misc_feature (439)..(439): n is a, c, g, or t
tcagacagtatatacacgaccggtgctcgatttagcgtcgatctcagggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccgggccgagcccccaaagtcctcttttacgacgtcctttcgcgggcttcggcagtctctggccgttttcggcctccagttctgaccacgcggcctccctgaccatcaccaaactccggcctgaggatgaggctgactacttttgttgtgcatatttcgattcactcaaatntgtcttcggaagtgggacccgcgtcagcgtcctgcgtcagcccaaggccaaccccactcgtcactctcgttcccgccctcctctatactactgtctgacgg

SEQ ID NO: 178622 - DNA, 407 bp, Homo sapiens
  misc_feature: GYAE6OF01EC4EG.44.10.A10.1.454.CMB.1.raw
  modified_base (255)..(255): a, c, t, g, unknown or other
  misc_feature (255)..(255): n is a, c, g, or t
  modified_base (402)..(407): a, c, t, g, unknown or other
  misc_feature (402)..(407): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctgaagattttgngatgtattactgtcatttccatggtcccttactctaacttttggccaggggaccaaactggaaatcaaacgaactgtggctgcacatctgtcttcatcttcccgcatctgatatatactgtctgagcgggctggcaaggcgcatagnnnnnn

SEQ ID NO: 178623 - DNA, 748 bp, Homo sapiens
  misc_feature: GYAE6OF01ADQXO.44.10.A10.1.454.CMB.1.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagacagtatatacacgaccggtgctcgatttagcgtcgatctcagggggaggaactgctcagttaggacccagacggaaccatggaagccccagctcagcttctcttcctcctgctactctggctcccagataccgaccggggaaattgtgttgacacaatctccagccacctgtctttgctccgaggggaancgccacctctcctgcgagggccagtcagagtgttaccagcaacttgcctggtaccacagaaccgtgggcaggcctccgaggcctcctcatctagcggaacnctcccgaccgacgggcccacgtcggtacctccccgaacccgtaggttccaggtcggacgtagggtccggggtaccggactaggtacgttccaccttctaccaaccgtatcgacggtcccggtccttggaccgtaggttccgtagggtaaggttacttttcggaccgtttaagttttaacgttaccgttggttaccgtaagtaccgtaaagttaacttaaacgttaccggtcggttacccttacgttaccggttaccggggtttaccgggggaccggggggttaaacctaaggggtacgggtaaacgtaacgttaaccggtaaaacggtacggttacgggtacggtcgtacgtaccgtaaccgtacgttccgttacgttacccgttccgttacccgttccccgtttaccccggtacttacgttacccgttaacgttaacgttacgtttaaccg

SEQ ID NO: 178624 - DNA, 532 bp, Homo sapiens
  misc_feature: GYAE6OF01EIZ3T.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggctcccagacaccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggcctcctcatctatggtgcatccaccagggccacgtggtactcccagccaggttcagtggcaggtggtctgggacaggtagttcactctcaccatcagcacgcctgctagtctgtaagtattttgctagtttattactgtactagctagtataatgactcggtcccttcccgtcggaccgtaagggaccacggtactaggtacgtaacgttaaacggacttggtggtactcgtacaccgtattcttgttcttacc

SEQ ID NO: 178625 - DNA, 548 bp, Homo sapiens
  misc_feature: GYAE6OF01AU71G.44.10.A10.1.454.CMB.1.raw
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctaatttaaatgtatcagcagagaccagggaacncccctgaactcctgactctcngctcgcctccactctgcgtaaggtggatctcttcaaggttcagtggcaggtgatcgtagggactagtatttcactctcacctatcctctagtctcgacaacctgaacgttatttgacctaacttactactgtactaacgtagtaacttactaccgtccgtacccgtttacgtaccggttttcggggaccggggtaactacggcgttaggaacgtacttacgaaacggtactggtggtctacgacctaactcgttctcgttcc

SEQ ID NO: 178626 - DNA, 587 bp, Homo sapiens
  misc_feature: GYAE6OF01EXK89.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaccagcaacttagcctggtaccacagaaacctgggcaggctccaggctcctcatctataccacatccaccagggcccacgtggtactccccagccagattcagtgcacgtgggctgggacagagttcactctcaccatcagcagcctgcagtctagtaagtatttgcttagtttattacgtgtcagactagtataagtcgtacttcggtcccttccccgttacgggacccgaaaggggtacccaaccgtaacgtacgggtaacgtaaacgtttaaaaccggaacgttgggtacgggtccttacggaccctaacccgtacgttacccgttagtttaccctttcgtaccgtttcccccg

SEQ ID NO: 178627 - DNA, 573 bp, Homo sapiens
  misc_feature: GYAE6OF01BXS9D.44.10.A10.1.454.CMB.1.raw
  modified_base (198)..(198): a, c, t, g, unknown or other
  misc_feature (198)..(198): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcagtctccagcccaccctgtctctgtctccgaggggaaancgccaccctctcctgcagggccagtcagagtgtggcagcagcgtagcctggtccagcagaacctggccagacctccaggcctcctcatctactaccacactcccacgacgggccaacgtggtactcccagcccagtacttcgaggtcggactacgtggggtctggggacaggtacgttcacgtctcaccatcagcacgtcctgcagtctagtaagtattttcgacttagtttatactgtcagtctaagttatagtagtaccgtcggtaccttccggttcctaccgttttccggacccgttcgggaaccctacgtacgttccgtaactttacccgaaacggtacgttcggtacggtctacggcctaccgtgttccg

SEQ ID NO: 178628 - DNA, 411 bp, Homo sapiens
  misc_feature: GYAE6OF01AZEVR.44.10.A10.1.454.CMB.1.raw
  modified_base (396)..(396): a, c, t, g, unknown or other
  misc_feature (396)..(396): n is a, c, g, or t
  modified_base (401)..(402): a, c, t, g, unknown or other
  misc_feature (401)..(402): n is a, c, g, or t
  modified_base (404)..(411): a, c, t, g, unknown or other
  misc_feature (404)..(411): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctgaagattttgtgatgtattactgtcatttccatggtccttacctcgaacttttggccaggggaccaaactggaaatcaaacgaactgtggctgcaccatctgtcttcatcttccgcatctgatatatactgtctgagcggctggcaaggcgnatagnngnnnnnnnn

SEQ ID NO: 178629 - DNA, 564 bp, Homo sapiens
  misc_feature: GYAE6OF01BN07K.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgtcagatgtgacatccagatgacccagtctccttcctccctgtctgcatctgtgggagacagagtcgccatcacttgccggcaagtcagaccattagctaattatttagcctggtatcagcaagaaaccaagggaacctacctaacctcctgatctttgctgcatccactttgcaatcagggtccatctcggttcagcggcagtggttcgtgggacacgtatttcactctcaccactcagcacgcctgcacgccgtaggagtactttccgtcgtactttaactttactacgtaccctaaactaacttaactttaccttttttaactaccgtttaacttaggttttcggtaccgtaacggggacctaagtcgtagggaagtacgtacgaaaacggtacgttggtcggtacgtcgacaacctacgttcgtgttccc

SEQ ID NO: 178630 - DNA, 725 bp, Homo sapiens
  misc_feature: GYAE6OF01BKAMH.44.10.A10.1.454.CMB.1.raw
  modified_base (196)..(196): a, c, t, g, unknown or other
  misc_feature (196)..(196): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatgtgatgacgcagtctccagccaccctgtctgtgtctccgaggggaaancgccacctctcctgcagggccagtcagatgtaccagcaacttcgcctggaccacagaacctggcaggctccaggctcncatctatggaacnctccaccaggccacgtggtactcccaccgtagttcaggtggcgtaggtcgggtccggaacaggacgttcaacctcgtacaacctactcgaacggtccggcctgaccgacgttccgtgggtaacgggttagtttttcggaccgtttaagttttaacgtttacgttggttactaacggtacgttaaagttaattaaacttaaaccggttcgttaccccgttacgtttccggtaaaccggttttccgggggacccgggggggtaaacccgttaaggggttacgggtaaacggtacttaaaccgggtaaaaacgtacggttacggttacgggacccggttacgtacccggtaacccttaacggttcccgtttaggtttaccccttttaccgtaaccgttttaccccccgtttaccccggtacccgttaaccgttttacccgg

SEQ ID NO: 178631 - DNA, 414 bp, Homo sapiens
  misc_feature: GYAE6OF01BIQUC.44.10.A10.1.454.CMB.1.raw
  modified_base (404)..(404): a, c, t, g, unknown or other
  misc_feature (404)..(404): n is a, c, g, or t
  modified_base (410)..(414): a, c, t, g, unknown or other
  misc_feature (410)..(414): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctgaagattttgtgatgtattactgtctatttccattggtcccttacctcgtaacttttggccaggggaccaaactggaaatcaaacgaactgtgctgcacatctgtcttcatcttcccgcctatctgtatatatactgtactgacgcgggctggcaaggcncatagnnnnn

SEQ ID NO: 178632 - DNA, 548 bp, Homo sapiens
  misc_feature: GYAE6OF01A6AOA.44.10.A10.1.454.CMB.1.raw
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcgagtcaggtcgttttcggngctgttgcctggtttcaacgaaaaagggggngaggcccctaaggtcctcgtctctcgtgaaaccagactggaaggtagagtcccgtcaggttcagtgccagtccaggtggtgggccggagtccactctcacattagcgacctgcggcctgaagattctgctaactttatttctgtcagcagtatcatagtcgtccccgttctacgttttcgggcccgtaaggggacccaaggtccgtagggaaactaccgaaacgtaacgtggtacggctggaccacctatctgtcttcacttccttacccgacctactctgtaac

SEQ ID NO: 178633 - DNA, 545 bp, Homo sapiens
  misc_feature: GYAE6OF01A1EHC.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctctacaaggttcagtggcagtggatcgtgggactagtacttcactctcacctatctccagtctgcaactagaagtattttgacctaacttactactgtaccaacagtagtttaactactcgtccccgtttctacggttttcgggaccggggtacctaaggtccgtagggaacgtacgtaacgaaacggtaaccgttggtacggccttagacccaccttcgtcgttcgttccg

SEQ ID NO: 178634 - DNA, 577 bp, Homo sapiens
  misc_feature: GYAE6OF01ED32P.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagacgaggaacgccctgaactcctagactctctgctcgcctccactctgcgaaggtggacgtctcttacgaagttcaggtggctaggtggatcgtgggactagtactttcactctacacctactcctctagtctacgacctaacgtagtaagttattttcgaacttaactttactacgtcgtaaccaacgtagtacttactaccgttccgtaccccgtttagtacggttttacggggaccggggtaacaaggtcgtaggtaacgtacgttaacgaaacggtagtcggtacggacttacggaccctacgtacttccgtgttaccc

SEQ ID NO: 178635 - DNA, 567 bp, Homo sapiens
  misc_feature: GYAE6OF01AMPS2.44.10.A10.1.454.CMB.1.raw
  modified_base (528)..(528): a, c, t, g, unknown or other
  misc_feature (528)..(528): n is a, c, g, or t
tcagacagtatatacacgaccggtgctcgatttagcgtcgatctcaggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccgggccgagcccccaaagtcctcttttacgacgtcctttcgcgggcttcggcagtccctggccgtttttcggcctccagttctgccacgcggcctccctgaccatcaccaaactccggcctgaggatgaggctgactacttttgtgtgctatatttcgattcacttcaaatattgttcttcggaagtcgggacccgcgtcagtcgtcctgcgtcagcccaaggccccaacccgcttcgtccaccttcctcggttccccnccccttccctcttactacttactgttctggacgtccggg

SEQ ID NO: 178636 - DNA, 364 bp, Homo sapiens
  misc_feature: GYAE6OF01DBE0Z.44.10.A10.1.454.CMB.1.raw
  modified_base (352)..(364): a, c, t, g, unknown or other
  misc_feature (352)..(364): n is a, c, g, or t
tcagacagtatatacacgaccggtgctcgatttagcgtcgatctcaggctgtacattctacatggagttgtacagcctgagatctgacgacacgggcgtctattattgtgcgagagcccaacggaacctgcttctttctgactactggggccatggaaccctggtcaccgtctcctcacgcctccaccgaagggcccatccggtccttccccctggccgccctgcctccgaggacgccacctccgagagccacgacggccggccctggggctcgccgtgggtaccaaaggtaccttaccgttcctaatatactggttctaggaggccgggtctggacgaaggcgacaatagnnnnnnnnnnnnn

SEQ ID NO: 178637 - DNA, 670 bp, Homo sapiens
  misc_feature: GYAE6OF01BCUHO.44.10.A10.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaancgcccacctctcctgcagggccagtcagagtgtagcagcaacttgcctgtaccagcagaaatctggccaggcctccaggcctcctnatctatggtncactccaccgagggcctacgtcggtactcccgaagtccgtaggttcaaggtggactagggtcgggtactaggggacctaaggtacgtttcccacgttacctaccaccgtattccgacggccaccggtcctacggacctagttaccgtaagtaaacgttgtttttacgacgtttaagttttaactttacgtcggttactaacgggtaccttaaggttaacttaacgttcggtaaccgttccgggtacccctttacccggttaccgggaccgtaaacggggtacctaaccggtacggtaacgggtaacgtaacgttaaaacggtaacgttggttacggtaccttacggaccttaccgtattccgttcgttccttaaccg

SEQ ID NO: 178638 - DNA, 675 bp, Homo sapiens
  misc_feature: GYAE6OF01CM47G.44.10.A10.1.454.CMB.1.raw
  modified_base (194)..(194): a, c, t, g, unknown or other
  misc_feature (194)..(194): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagagatcaccggagatattgtgttgacacagtctccaggcaccctgtctttgtctccagggganagagccaccctctcctgtagggccagtcggagtgttgctaagtacctagcctaggtaccaacaagaaacctggaccacggcctcccgagtcctcctcattctatagatcgacactaccgaaggtacgggtccaacgtcggacccaaccccaaggtacctagggttacagggttcggacgtaggttcggggtacgtacggggactacggtaccttcacttaccgtccacgtcaagtacaattcgtaacaggtcctaaggtaattagtttcgacttaagttttactacgtgtacagtacgtacgttcccgtttacccgcggtaaccggtccccgtactttaccggttaccgggtttaccgggggggaccggggggtaaacttacgggggttacgggaatacggtaaccgaacgggtaccggtaacgtgggtacgcgtacgaccaccgttatccgttgttacctgtacccttccgtccccggac

SEQ ID NO: 178639 - DNA, 554 bp, Homo sapiens
  misc_feature: GYAE6OF01A3BY7.44.10.A10.1.454.CMB.1.raw
  modified_base (196)..(196): a, c, t, g, unknown or other
  misc_feature (196)..(196): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctgtaccagcagaaatctggccaggctcccaggctcctcatctatggtgcatcccaccagggccactggtactcccgagccaggttcagtggcaggtgggtctgggacagtacgttcactctcacctatcagcagcctgcagtctgaagtattttgcttagttttattacgtgtcagtctaagttaactaattcgacttcggtcccttcccgttcggacccgaagggtaccacggaccgtagggaagtaacgtttaaacggacgttggtacgggtcttacggacctaccgtattccttcggttcttacccg

SEQ ID NO: 178640 - DNA, 782 bp, Homo sapiens
  misc_feature: GYAE6OF01EQ51D.44.10.A10.1.454.CMB.1.raw
  modified_base (197)..(197): a, c, t, g, unknown or other
  misc_feature (197)..(197): n is a, c, g, or t
  modified_base (332)..(332): a, c, t, g, unknown or other
  misc_feature (332)..(332): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgttagcagctaacttagcctacgtaccagacaagaaatcgtggccaggctcccgaggcctcctcatctagtggtgccactccaccgagggccacgttcggtacncccgagccgtaggttcaaggtggacgtagggttcgggttcgtaggggaactaggtacgtttacccgaacccttccgtaccctaacctacgttaccgaacggtccgtaccggtcccgttacggaccgttacggttaccgttaagggttaaacgttttacgtttttcggaacgtttttaagtttttaaccgttacgttccggtaacgtaacgtaacgttaaggttaaactttaacggtacggttacccggttcccggttaccccctttacccggggttacccgggtaaaccggttaaccgggaaacccgtaaccccgggttaggttaaacggggtaaaccggtttaaaaacgtttaaaacccgggtacggttacggggttaccgtaaccgttaaccccgtacccgtaaccggtttaaccgtttccggtttaacccgttccgtttaaaccccg

SEQ ID NO: 178641 - DNA, 587 bp, Homo sapiens
  misc_feature: GYAE6OF01C0XZH.44.10.A10.1.454.CMB.1.raw
  modified_base (430)..(430): a, c, t, g, unknown or other
  misc_feature (430)..(430): n is a, c, g, or t
tcagacagtatatacacgaccggtgctcgatttagcgtcgatctcaggggagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagcctccctctcctgcagggccagtcagaatagttggcgccgtactacttagcctggtaccagcagagacctggccagccctcccaggcctcctcactcccgacggtgccatcccaaacgacggggcccacgtcgggccgtcccctgactagggttcaggtcggcaggttggggtctggggacagacttcacttcacaccatcagcacgccgtggacgcctagaagttattttggngtattagttattacgtgttcttatttcctattcggttaccctttaccttacggttaacttttcgggccgtaacgggtaacctaacgtaggaaactacgaaaacgtacgtggtcggctagaccactattcgttcgttacttctactccgttcccgacc

SEQ ID NO: 178642 - DNA, 740 bp, Homo sapiens
  misc_feature: GYAE6OF01BP68T.44.10.A10.1.454.CMB.1.raw
  modified_base (196)..(196): a, c, t, g, unknown or other
  misc_feature (196)..(196): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgcccaccctctcctgcagggccagtcagagtgttaccagctaacttagcctggtaacccaccgaagaaacccgtgggaccacggcctacccgaggtcctcctacatcctaagtacggaaaccactacccgaaccgacggggccctaacgtcgggtaacctcccccgaaccgtagggtttccaggtcggccgtagggtcgggtaccggacaggtattccacgtctacgacctagtccgacggtcccggtcctggtaccgtacggttccgttagggtacggtttagtttttcggactttaacggttttacttaccggttgttaccaacggttacgtaaagtttaacttaaaccgttaacgttccggtacccttacgttccggttaaccgggttttacgggggacccggggggttaacctaaggggttacggaacgtaacgtaacgaaaaccggtacgttgggtacgggtactacggtacccaaccgttagttccttacgttacccgttacctaccgtttcccgttaccccggtctacgtttaccg

SEQ ID NO: 178643 - DNA, 685 bp, Homo sapiens
  misc_feature: GYAE6OF01DSF01.44.10.A10.1.454.CMB.1.raw
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
tcagacagtatatacacgaccggtgctcgatttagcgtcgatctcagggggtcagtctcagtcaggacacagcatggacatgagggtccccgctcagctcctggggctcctgctgctctggctcccaggttcgagatgtgacatcgagatgacccagtcctccttccttcctgtctttcttctggttggagcagcgtcaccatcacgttgccgggcgagtcgaggttcgttttcggngtcttgttcgtccgttaggtttacgaaaacggaaaaagggggngaccggtaccccgtaagggtccctcgttcctcgtacggtaacgtaaaccgaggtaccgtagggtaaaggtacgaccggttccccgtaccgtaagggtttcaaggtcgacccgtaacggtcccggtaggggttcgggtacggggcccggtaacgttcccgacgtcctacgacccttaagtaccgcgtacctggccgacgtagaacgtcttcgtcgacttaactttactttctagtcagtctaagtatcgtacgtcgtccgtcccgtttcttacgtttcggaccgtaacggggaccaaggtacgtaaggaaactaacgaaacggtacgtggtcggtacctcggacctaccgtattccgtcgttccttactaccctttcccgttcccgactacgttctagtattaacg

SEQ ID NO: 178644 - DNA, 689 bp, Homo sapiens
  misc_feature: GYAE6OF01CHTZV.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtcctccgaggggaaagacgcccaccctctcctgcagggccaggtcaggagtgttagcagacaacttacggcctacggtaaccagaccaagtaaactcgtggcccaagggcctacccgaggcctccctctactccgtatggtcgccaactcccgaccgacggaccctacgtacggtactcccgagccgtaggttcgagtggcgtaggtcgggtcgtagggacctaggtacgtttccacgttacctaccaacccgtattaccgacggtactaaccggcccgttacgaccgtacggttaccgttaaggtaaacgtttgttttacgaccggttttaagtttactttacgttcgtacgttagtacgtaagtttactaaacgttcgtaacgtcccggtacccttccgttaccggaccgtaacgggaccaacggtacgtaacggtaagttaaaccgtaacggtaaacgtggtacggtacgtacggtaccaacgttcgtccttcgttcttacccg

SEQ ID NO: 178645 - DNA, 564 bp, Homo sapiens
  misc_feature: GYAE6OF01B0ULV.44.10.A10.1.454.CMB.1.raw
  modified_base (263)..(263): a, c, t, g, unknown or other
  misc_feature (263)..(263): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttccttcctgtcttcttctgttggaggcagcgtcaccatcacttgccgggcgagtcaggtcgttttcggtgctgttgccttggttcaaacgaaaagggggnacggcccctaaggtcctcgtctctcgtgaaaccagactggaaggtagacgtcccgtcaggttcagtgccagtccagggtggtcggggccgagtcccatctcaccgattacggcgtacctggccggacctgaagtcttcgtgtacctaactttntttctgtacagctagtntcatgtcgtccccgttntacgtttcggacgagggaccaggtcgtaggaaactacgaaacgtactggtcggctcgactaccgtatcgtagttccttctacgttccgttcccgacctattcgtagtattaacg

SEQ ID NO: 178646 - DNA, 616 bp, Homo sapiens
  misc_feature: GYAE6OF01DO6G4.44.10.A10.1.454.CMB.1.raw
  modified_base (200)..(200): a, c, t, g, unknown or other
  misc_feature (200)..(200): n is a, c, g, or t
  modified_base (300)..(300): a, c, t, g, unknown or other
  misc_feature (300)..(300): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagactaccactggagaaatagtgatgacgcggtctccagccaccctgtctgtgtctccgaagggggaaancgcccaccctctccgtgcagggcccagtcagagtgtagcagctaacttagcctcgtaccagcaagaatctagccaggctcccaggctctcatctatggtncactccgaccgagggtccacgttggtactcccgagcctaggttcaggtggcaggtgggtctgggactaggtccttcgacctcgtaccacctatccgagtacacgtacgtacggacgtacgtagtaagtttagtttacgtagtttaagtttacgttcgtagtcgtaagtactagttaatagtacgtacggtccgtcccttcccggtacgtaaccggacggtacaacgtacggtacggtaacgtaacgtaaaccggtagttaccgggtagtaccgtacgacccgtaactacgttaccgttcgttctttccgttacccg

SEQ ID NO: 178647 - DNA, 756 bp, Homo sapiens
  misc_feature: GYAE6OF01A691X.44.10.A10.1.454.CMB.1.raw
tcagacagtatatacacgaccggtgctcgatttagcgtcgatctcagggggttcgagtctcagtcaggacacagcatggacatggacgggtccccgctcagctccgtggggcctcctgctactctggctccggaggtcgccagatgtgacatccagatcgacccagtcctccttcctccctgtctgcttctagtaggacgacagacgtccgaccatcacgttcggccgggactaacgtccagacctaattaaccagttacttaattttaaagttggtaactacgaaggcgaaggacgaaccgaacggggtaaacctccccctaaggaaccttccgtagacttccgttcgtcgccttcggtccctccctaacgttccgcggtacgtaagggtcggtacgttccgttacgttacggtaacggtttcgagggtcggtacgtagggtcggtaacgttaccggtacggggaactaaggttaccttttaccgactttacccgtacctaacccttacgttccccgttacccgtagtttacccgtaacgttaacccgtaaaccgtttaaggttaacgtttacttttaacgaacctttaacgtttaacttacgttacgtaaccgtaacgtaacgttacgttactaaccggttaccgttacccgtttacgttacggtttaccggggaccgggtactaggtcgtaacggactacgtaaccgtaacggtacttacggcgtactaccggactaacctcttcgttactcc

SEQ ID NO: 178648 - DNA, 462 bp, Homo sapiens
  misc_feature: GYAE6OF01CXC17.44.10.A10.1.454.CMB.1.raw
  modified_base (433)..(462): a, c, t, g, unknown or other
  misc_feature (433)..(462): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctccccaggctcctcatccacggtgcatccaacagggccactggcgtccctgacaggttcagtggcagtgggctgggacagacttcactctcaccatcagcagcctggagcctgaagtatttttgacaactttattactgaccaacagtattaagagtttattctcagtagttttggcctaggggaccaagcgtggagatacaaacgaactggtgctgcaccatctgttcttcactctcccgctactctgatatatactgtctgacgcgggtcctgggacgaacggcgtaccgaagttacgnnnnnnnnnnnnnnnnnnnnnnnnnnnnnn

SEQ ID NO: 178649 - DNA, 620 bp, Homo sapiens
  misc_feature: GYAE6OF01CQ477.44.10.A10.1.454.CMB.1.raw
  modified_base (202)..(202): a, c, t, g, unknown or other
  misc_feature (202)..(202): n is a, c, g, or t
  modified_base (362)..(362): a, c, t, g, unknown or other
  misc_feature (362)..(362): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (473)..(473): a, c, t, g, unknown or other
  misc_feature (473)..(473): n is a, c, g, or t
  modified_base (606)..(606): a, c, t, g, unknown or other
  misc_feature (606)..(606): n is a, c, g, or t
  modified_base (613)..(613): a, c, t, g, unknown or other
  misc_feature (613)..(613): n is a, c, g, or t
tcagacagtatatacacgaccggtgctcgatttagcgtcgatctcgagggggaggaactgctcagttaggacccagacggaaccatggaagccccagcgcagcttctccttcctcctgctactctggcctcccagataccacgtggagaaatagtgatgacgcggtctccagccaccctgtctgtgtctaccgaggggaaancgcccaccctctcctgcgaggccagtcagtagtgtagcagctaacttagcctcgtaacagcaacgaatcgtcggaccacggcctccccgaggtcccttcctactacttccgtagttcggtcgactaaccgtcccgaaccgacgggcctacgtcggtaccncccgaggtcccgtaggttccaggtcggcgtagggtcgggtcgtagggactagtacgttcacgtctacgacctanaccganccaggcctgtactacggttctaagtaagttntttcgtacttagttttattaccgtgtactaggtactagtttaacgattcggtaacctcggtaccccttcggttaccggacaacggggactcgaagtggaaagtaacttaaggacgttggcgcttcgactactntaccgtnttactcg

SEQ ID NO: 178650 - DNA, 660 bp, Homo sapiens
  misc_feature: GYAE6OF01CFRKV.44.10.A10.1.454.CMB.1.raw
  modified_base (210)..(210): a, c, t, g, unknown or other
  misc_feature (210)..(210): n is a, c, g, or t
  modified_base (405)..(405): a, c, t, g, unknown or other
  misc_feature (405)..(405): n is a, c, g, or t
tcagacagtatatacacgaccggtgctcgatttagcgtcgatctcagggggggggtctcaggaggcagcactctcgggacgtctccaccatggcctgggctctactcctcctcagcctcctcactcagggcacagggtcctggggactgtctaccctgactcagcccgccctcagtgtccgggactcctggtcagtcggtcaccatcttntgttctccagcgaacaattccactcggtaccctttaaagtctctatcagtggtacgcagtcggtccgggccgacgccccaaagtcctctttacgacgttccttcgcggtcttcggcacgtcctggtccgtttttcggcctccagttctcgaccacgcggccctcctcgaccactcaaccaaacctccgcctgagntcggagctgacttacttttgttgtgtactattatttcgtactttcaacttactaaattagttgtttccgttacgggtaacgggttcgggaaccccgtcggttaccgaggtccggttcccgttcggtccgttaccgaccgaccccgaacggccccaaaccccctaccgttccgtaccgtacgtttcccttccggttaccccctacccttcccttacttaacttaccttacgttagttcccgttggcggtcccgggg

SEQ ID NO: 178651 - DNA, 698 bp, Homo sapiens
  misc_feature: GYAE6OF01CPH7H.44.10.A10.1.454.CMB.1.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (377)..(377): a, c, t, g, unknown or other
  misc_feature (377)..(377): n is a, c, g, or t
tcagacagtatatacacgaccggtgctcgatttagcgtcgatctcagggggtcagtctcagtcaggacacagcatggacatgagggtccccgctcagctcctggggctcctgctgctctggctccgaggtgccagatgtgacatccagatgacccagtctccatcctccctgtctgcatctgtcgagacagagtcaccatccacgttggccgganaaggtcagggttcgttttcggntcttgttgtccttggtttaacaaacggtaaaaagggggcacggaccccttaaaggtcctcgtctccgtacggtacgaaaacccgaggtacgtacgggaaaggttacgacggttccccgtccgtaagggtttcaagggtcnccgtaacggtcccgaaggggttcggggttcggggacccggtagttccccacgttaccctacgaaccctaagtttacggcccgtaaccttcgggcccggtaccgtacggtaacgtaaccgtttcgtacgtaccttaaacgttttacgtttactacgttacaacgtactaggtaacttcgtaataacggttccgtaccccgtttacttacggttttaccggaccggtaacggggaccctaaaggtctaacggtaaactacgaaacgtacgtggtacggctcgactacaactcgttacgttcttacgtacttcctcccgctacg

SEQ ID NO: 178652 - DNA, 828 bp, Homo sapiens
  misc_feature: GYAE6OF01C22V6.44.10.A10.1.454.CMB.1.raw
  modified_base (199)..(199): a, c, t, g, unknown or other
  misc_feature (199)..(199): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctccagataccactggagaaatagtgatgacgcggtctccagccaccctgtctgtcgtctccgaaggggaaacncgcccaccctctcctgcgaggccagtcagtagtgtagcagactaacttcgcctcgtacagcaagtaaactcgtacggccacggcctcccgaggtccctaccctctaacttcgtagtcggttacgacctactcccgaaccggacgggccctacgtacggtacctacccggaggtaccgtaacggtttcgaaggtcggccggtagggttcggggtacgtacgggtaactaggttacggttaccaccgtactacccaaccgtactaccgacgacgtaaccggtccgtagtacccgtaaggttccgttaaaggttaaacggttttacgttttaccgttaacgttttaacggtttttaaaccgtttacgttacggttaccgtaaacggttaacgtttaaacgtttaaacgtttaacggttccgggttaaacccgtttccccgggtaaccccgttttacccgggttaacccggggaaaccgggttaaacccgggaaccgtttaacccggggtaaacggtttaaccgggtaaaacggtttaaaccggttaaaacggtaccgggtaccgggtttaccgttacccgtacggtaaccctaacccgttacgtttcccgttaacgtttcccgtttaacccg

SEQ ID NO: 178653 - DNA, 519 bp, Homo sapiens
  misc_feature: GYAE6OF01DR1YI.44.10.A10.1.454.CMB.1.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (403)..(403): a, c, t, g, unknown or other
  misc_feature (403)..(403): n is a, c, g, or t
  modified_base (509)..(509): a, c, t, g, unknown or other
  misc_feature (509)..(509): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccacctctcctgcagggccagtcagagtgtagcagcaacttagcctgtaccagcagaaatctggccaggctcccgaggctcctnactctagtggtgctatcccacgagggccacgttggaactccccagcccaggttcagtggctaggtggtctggggacagtagttcactcgtcaccgatcgagcagcctgactagtctagagtnttttgcttagtttatactgtacagtcaagttataatgacgtgccttccgttcggacgacgggtacagtcgtaggaagaacttaacgacgtgtcggctacgctactntctgtcgtac

SEQ ID NO: 178654 - DNA, 695 bp, Homo sapiens
  misc_feature: GYAE6OF01CMH0B.44.10.A10.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagcccaccctgtctgtgtcctccgaggggaancgcccaccctcncctgcagggcagtcagtagtgtagcagactaacttagcctacgtacagcaagtaatcgtacggccaggcctacccgaggtcctccctacgacttctagtcgggttcacctactacccgaaccgtagggaccctaccgttcggtaaccttaccccgacggtacccgtaacggttccgtaaggtggaccgtagggtcggggttacgtacggggtaccaggttacgttaccaaccgttccgtaaccaacctacgtaccacggaccgtacgtcccgtagtacgtaacggttccgtaaggttaaacgtttgttttacgtactttaagttttacgttacttggtaactaaggtaccgttaagttacgttaagtaccgtacgtacccggttcccttaccgttaccggacggtaaacggaccgtaacgacgttaggaacgttaaagtaacggtagtgtacggactacgtaccacgttatcgtttgtcttaccg

SEQ ID NO: 178655 - DNA, 622 bp, Homo sapiens
  misc_feature: GYAE6OF01CYE7Y.44.10.A10.1.454.CMB.1.raw
  modified_base (278)..(278): a, c, t, g, unknown or other
  misc_feature (278)..(278): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatcgacccagtcctccttcctccctgtctgtcttctaatagggagacagagtcgcctatcacgttggccgggcaagtcagaccattaacagtcttaatttaaattggtatcagcagagaccgagggaaancccctagaacctcctgatctctgctcgcctccactctgcgtaagggtcgacgtctcttacgaaggttcagtcggactaggtggatcgtagggactagtacttcacgttcctcaactcgtcctccgagttcctagacctaaccgttaggaacttagttttaaccgaccttaaacgtttacctaacgttgttaaccaaacttgttaacgtttactacccgttccgtacccccgttagtttacggtttaccgggggacggggaacctaagtccggtaggaacgtaacgtaaccgtaaacggtacgttggtacgggccttacggaccacccgtatcgttcgtttaccc

SEQ ID NO: 178656 - DNA, 639 bp, Homo sapiens
  misc_feature: GYAE6OF01A3LR0.44.10.A10.1.454.CMB.1.raw
  modified_base (270)..(270): a, c, t, g, unknown or other
  misc_feature (270)..(270): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaaacagcttaatttaaattggtatcagcagagaccagggaaacncccctagaacctccgtagacttctctcgctcgccctccactcgtgaccgaagggtggtagttccttcttacgtaaggttccaggtcggacgtaggttggaattcgtgggactaggtactttcgacttctaccacctacttcctccctagttcctacgtacctaaccgttaggaacgttattttacgaccttaaacttacctactacgtaacctaacgtaacgtaacgtttactaccgttaccgttacccccgtttacgtaccggttttcggggacccggggtactaacggtccgtagggacgtaacgtaccgaaaacggtacgttacgggtacggtcctacggaccaacgtacgttcgttcgttacccg

SEQ ID NO: 178657 - DNA, 635 bp, Homo sapiens
  misc_feature: GYAE6OF01AEY87.44.10.A10.1.454.CMB.1.raw
  modified_base (287)..(287): a, c, t, g, unknown or other
  misc_feature (287)..(287): n is a, c, g, or t
tcagacagtatatacacgaccggtgctcgatttagcgtcgatctcagggggtcagtctcagtcaggacacagcatggacatgagggtccccgctcagctccgtggggctcctgctactctggctccgaggtgccagatgtgacatccagatcgacccagtcctcccttccctccctgtctgtcttctataggagacagacgtcgccatcacgttcggcccgggcaagtcaagacctaattaacagtacttaatttaaagttgtatcgagcagacgaccgaaggaacnccctagacctcctgactctctgtcctcgtccctcctactcgtcgacgtaaggtcgtacttcttacgttacgaggttccgaggtcggactaggtcgatcggtaggactagtacttccacttctacctacctactccttaccgtagttcctacgaccctaaccgttagtaacgtttcgtttacgaacctttaacctttaacctacgtacgttaaccaaacgtagttaacgttctacccgttccggttaccccgtttacgttaccgggtttcggggaccgggtaacctaggtaccggtaggaactaacgtaacgtaacgtcgtcggtcgacgtacaccatctcgttctacc

SEQ ID NO: 178658 - DNA, 787 bp, Homo sapiens
  misc_feature: GYAE6OF01B4FDM.44.10.A10.1.454.CMB.1.raw
  modified_base (201)..(201): a, c, t, g, unknown or other
  misc_feature (201)..(201): n is a, c, g, or t
tcagacagtatatacacgaccggtgctcgatttagcgtcgatctcagggggaggaactgctcagttaggacccagacggaaccatggaagccccagcgcagcttctcttcctcctgctactctggcctcccagactaccactggagaaatagtgatgacgcagtctccagcccaccctgtctgtgtctccgaaggggaaanacgcccaccctctccgtgcgacgggccagtcaaggtacgttcgttacccgagacctaacgttacgccttacggtacccaaccgaacggaaaccgtgggaccacggccctacccgaggtcctaccctcgtacttaccgtaagtacggaaacctaccgtacccgaaccggaccgggtaccctaaccggttacgggtaacccctacccccgtaacccggtaggtttacccgacggtccggacggtacggggtccggggtaccgggaagtacggtacgttccgaccttctaccgaacccgtactaccggacggtcccggtacgtacggacgtacgtccggttaaggtacggtttaagttttcggtacttaagtttttactacgttggtaccgtaagtacgttaagttaacttaaacgtacccgttcgtacctttcgtaccggtttaaccggggttacccggggggaaccgggggttaaccgtaaggggtaccggtaagtacgttaaaccgaaacggtacgtcgggtacggaccgttcgacctacgtcttccgttacgttccttaactcttcccgttacccgcttgttacg

SEQ ID NO: 178659 - DNA, 546 bp, Homo sapiens
  misc_feature: GYAE6OF01BW2DD.44.10.A10.1.454.CMB.1.raw
  modified_base (201)..(201): a, c, t, g, unknown or other
  misc_feature (201)..(201): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (419)..(419): a, c, t, g, unknown or other
  misc_feature (419)..(419): n is a, c, g, or t
  modified_base (455)..(455): a, c, t, g, unknown or other
  misc_feature (455)..(455): n is a, c, g, or t
  modified_base (539)..(539): a, c, t, g, unknown or other
  misc_feature (539)..(539): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaagacncccacctctcctgcaggccagtcagagttgtagcagctaacttagcctagtaccagcagaaatctggcacggctcccaggctcctcatctagtggtcgcactcccaaccgagggcctacgtggtactcccgagcccgtaggttcgagtggcaggtcgggntgggaacngtacgttcactcaccacnctcagccacgcctgactagtcgtagaacgttntttgtacttagtttattactgctagctaagcgtaanactaacgtgaccatccgaccgtcggaccgaaggtaccagacgtcgaaagtacgtaaaccgtagtacggtagcgtgacccaactntcgttcg

SEQ ID NO: 178660 - DNA, 553 bp, Homo sapiens
  misc_feature: GYAE6OF01DCEB8.44.10.A10.1.454.CMB.1.raw
  modified_base (270)..(270): a, c, t, g, unknown or other
  misc_feature (270)..(270): n is a, c, g, or t
  modified_base (524)..(524): a, c, t, g, unknown or other
  misc_feature (524)..(524): n is a, c, g, or t
  modified_base (526)..(553): a, c, t, g, unknown or other
  misc_feature (526)..(553): n is a, c, g, or t
tcagacagtatatacacgaccggtgctcgatttagcgtcgatctcagggggatagagcctccctctcctgcagggccagtcagaatattggcgccgactacttagcctggtaccagcagagacctggccagcctcccaggcctcctcatcccacggtgcactccaacgacggggcccacgtgggccgtcccctggacctagggttcagtgggcaggtgggtcgtggggacagtaccttcactctacaccatccagcacggtcctgggacnccgtagaagtagttttggagtattagttattactgtactattttccagttccggttacccctttaccgtaccggttaaccgtttttcgggaccgtaacggggtaaccctaaaacgtagggtaaaactacgaaaaccgtaagtcggtacggtctacggacaacctatcttcgtccttccacttccgtcccgtctatctagtatacttatactgtacgtggacgtcgggtactacgggacgtaggacgcagtacgngnnnnnnnnnnnnnnnnnnnnnnnnnnnn

SEQ ID NO: 178661 - DNA, 665 bp, Homo sapiens
  misc_feature: GYAE6OF01DH7GX.44.10.A10.1.454.CMB.1.raw
  modified_base (645)..(645): a, c, t, g, unknown or other
  misc_feature (645)..(645): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggaagaaatagtgatgacgcggtctccagccaccctgtctgtcgtctaccgaggggaagacgcccaccctctcctgcagggccagtcagtagtgttagcagtactaacgttacgcctacgtaaccagacaagaaacttcgacggaccaggccctacccgacggtcctcctactacttcgtaagtgggtactactacgtacccgaacgaccgggacctacgttacggtacctcccgaacgtccgtaggttcgaggtcggacgtacgggtgggtacgtaggacgtacgtacgttaccaccgttcactaccactcgaacgtccgtacgccgtagaccgttagtcgtaagtaatttcgtttacgacgtttaagttacttacgtgtacagtctaagtaatacgtgtaccgtccgtcccgttacgtacggaccgtaagggtaccacggtaggttaagaaacggtttaaataaaccggtacgttggaaccggtgtaccggtaccaaacgttnttacggttctacccttacgg

SEQ ID NO: 178662 - DNA, 665 bp, Homo sapiens
  misc_feature: GYAE6OF01ET033.44.10.A10.1.454.CMB.1.raw
  modified_base (354)..(354): a, c, t, g, unknown or other
  misc_feature (354)..(354): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatcgacccagtcctccttcctccctgtctgcttctagtaggacgacagacgtccgccatccacgttcggccgggacaagtccacgacctaattaaacgagtacttaaattttaaagttggttactacgagaccgaagacgaaccgaagggaaaccgccccctagaaccttccgtagactctaactcgcctcgccctccgtactcgngacgtaaggtgacgttctcgttacgtaaggttcgagtggacgtaggtcggaacttcggtacgggactagttactttaccacttcctactacctactcctacgtacgtccgtacgaacctaacgtagtaacgtttatttacgaaccctttaactttacctacgtacgtaccaaactaggttaactttacctaccgtttcccgtaccccgtttagttacccgggtttcggggtaacccgggaactacggtcgtaacgggaataccgttaaacgaaacggtacgtggtacgcctacgcgtatcgtcttcgttcc

SEQ ID NO: 178663 - DNA, 693 bp, Homo sapiens
  misc_feature: GYAE6OF01D8GM5.44.10.A10.1.454.CMB.1.raw
tcagacagtatatacacgaccggtgctcgatttagcgtcgatctcaggggagagctgctcagttaggacccagagggaaccatggaaaccccagcgcagcttctcttcctcctgctactctggctcccagataacaccggacaacctgtgttgacgcagtctccaggcaccctgtctttgtctgcaggggatagacgcctccctctcctgcagggccagtcagaatagttggccgccgactacgttagcctaggtaccagcaagacgaccgtggccagccctccgaggcctcctcactccgacggtcgaccacgtcccaacgacgggcccacgtcggccgtcccgtagaaccgtacggttccaggttcggaccgtagggtcgggtcgtaggggaacctacggtaccttcgaccttccgttaccaacctagtccgaacgccgacgtcccgtacgggacgtcccgttaaggtaaacgttagttttggtacgttagttagtttaacttacgttcgttacttaacttttccgtacgtttccggtttcccctttaaccgttaccgttaacgttttccgggaccgtaacgggtaaccctaacgtacggtaaactaccgtaaaaccgtacgttacggtacggtactacggtacctaccgtacttacgttcgttaccttactaccttcccgtcccgtaccg

SEQ ID NO: 178664 - DNA, 782 bp, Homo sapiens
  misc_feature: GYAE6OF01AX16V.44.10.A10.1.454.CMB.1.raw
tcagacagtatatacacgaccggtgctcgatttagcgtcgatctcagggggaggaacgtgctcagttaggacccagacggaaccatcggaagccccagcgtcagcttctcttcctcctgctactcgtggctcccgagataccactggagaaactagtgatgacgcggtctccagccaccctgtcgtgtgtctccgaggggatagacgtcctccctctcctgccgagggcctagttcgaagtaacgttacttacggaccgaccgtaacttactttacgccttaggtacccagccaagacgaccgtcggccacgccctaccgaggcctcctactactccggtaacggtcgaccaaccgtcccgaacggaccgggtccaaccggtcggcccgttaccgcggaccgtacggttccgagttacggcgagggttcgggttacgtcgggaactacggtaccttacgtaccctccgtaccaaccagttaccgacgtacctaccggtccgtagggtacgtaccggttaacgtaacggtttagtttttacggttacggtagtttacggtttaacgtttacgttcgtttaaccttacgttttacccgtaagtttcccggtttaccctttaccggtttaccgtttaaccggtttttccgggtacccgggtaaccggtaacccgttaaacggtacggtaaacttaaccggaaaacgtacggttaggtaccggtacgtaccgaccgtaaccctacgttcgtacgtttaccttacttccgttcccgtttacccccgg

SEQ ID NO: 178665 - DNA, 742 bp, Homo sapiens
  misc_feature: GYAE6OF01D7WND.44.10.A10.1.454.CMB.1.raw
  modified_base (198)..(198): a, c, t, g, unknown or other
  misc_feature (198)..(198): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagcccacctgtctgtcgtctccgaaggggaancgcccaccctctccgtgcgacggccagtcaggtagtgttagacagactaacgttacgccctacgtaccagacctaagaaacttcgcggaccacggccctacccgaggtcctcctactacgtcgttagtggtacgcctacctccgaccgacgggtacctacggtacggtacctacccgacgtaccgtacggttcgaggtcggacgtaggggttcgggtcgtacggaacgtagtacgttccgaccttaccgtaccgtactacgtaccgaacggtccgtaaccggtccgttacggaccttacgggttaccgtaaagggtttaacgtttacgttttttaccgaacgttttaacgggtttttaactacggtttaccggtacgtaaggttaaccttaaggttaaccttaacggtccggttaccgttcccggttacccgttcccggttacggaccggtaaaccgggactaccggtaaggtacggtaaactaacggttaacgcgttgggaccgtacgtactacctacgtaccgtttcgtacgttcttacccg

SEQ ID NO: 178666 - DNA, 607 bp, Homo sapiens
  misc_feature: GYAE6OF01BJGIF.44.10.A10.1.454.CMB.1.raw
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
tcagacagtatatacacgaccggtgctcgatttagcgtcgatctcagggggtcagtctcagtcaggacacagcatggacatgagggtccccgctcagctcctggggctgctaatgctctggatccctggacccagtgcagatgttgtgctgacccagactcccctctctctgtccgtcacccctggacacgccggcctccatgtcctgcaagtctagtcagacgccctcctgccatagtgataggaaanacatagtttgtactggtacctgcagaggtcaggccagtctccgcacgctccncatctatgtacttcttacaacgcctacctcgtcgtggacgtcgccagtacgttaggttcaggtcggcgagggccggggtacgggactagtacttcgaacgtaacgtaagaaaatcgaacgggtccgggtaggacggtcgtaggaggtagttaggtttaggtaaattttacgtacgtgtacgtagttacgacgtaggtacttacgttaccgttaccggtttacccccggtacgttaccgggacggtaaccccggggtacgacggggttaagaaacgtacgaaagaccggtaacgtggtacggtaccg

SEQ ID NO: 178667 - DNA, 758 bp, Homo sapiens
  misc_feature: GYAE6OF01EXLB9.44.10.A10.1.454.CMB.1.raw
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (344)..(344): a, c, t, g, unknown or other
  misc_feature (344)..(344): n is a, c, g, or t
tcagacagtatatacacgaccggtgctcgatttagcgtcgatctcagggggtcagtctcagtcaggacacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgtttcggnctgttgcctggttcaacgaaaaggggnaggccctaaggtcctcgtctctcgtagaaaccagacgtggaaggtagacgtcccgtacaggttcagtcgccagttccgagggtcggngggccggagtccgacttctacgacctagttacgcgtaacccgtggccggtaccttaggaaacgtacgtttcgtacggtaccttaaacgttttacttttccgttaggttaccgaacggtaccgtaaacggtttaacttacccgttaagtttaaccggttacccggttaccccccggttttacgtttaacccggttttttcgggggacccggttaaaccgggggggtaaccctaaaccgggttaccgttaaacggggtaaaaacctttacccggaaaaacccggttaaaccggttcgggttaacggggtacccgttaggaccctaaaccgtacgtttcccgttacggtttccctttaccgtaacctttccccgtttaccccggacccttaagtttcccgtaacgtaagtttaaacc

SEQ ID NO: 178668 - DNA, 541 bp, Homo sapiens
  misc_feature: GYAE6OF01EV3LA.44.10.A10.1.454.CMB.1.raw
  modified_base (188)..(188): a, c, t, g, unknown or other
  misc_feature (188)..(188): n is a, c, g, or t
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (457)..(457): a, c, t, g, unknown or other
  misc_feature (457)..(457): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctatagganacagagtcgccatcacttggccgggcaagtcagaccattaacagtacttaatttaaatggtatcagcagagaccagggaaacnccctagaactcctgactctctgctcgccctccactctaggtaaggtgagtcttctacgtaaggttcaggtggcaggtggtatcgtaggacngtattcacttcacactatctctatctcactaactgaacgttntttacgacttaacttactactntacaagtagtattacacgtcgtccccgtttntacggtttcgggaccgggactagtcgtaggaagtactacgtaaacgtgtcggtacgctaacgcctaacgtatcttgttctaccg

SEQ ID NO: 178669 - DNA, 607 bp, Homo sapiens
  misc_feature: GYAE6OF01AD86L.44.10.A10.1.454.CMB.1.raw
  modified_base (229)..(229): a, c, t, g, unknown or other
  misc_feature (229)..(229): n is a, c, g, or t
  modified_base (418)..(418): a, c, t, g, unknown or other
  misc_feature (418)..(418): n is a, c, g, or t
tcagacagtatatacacgaccggtgctcgatttagcgtcgatctcaggggagagctgctcagttaggacccagagggaaccatggaaaccccagcgcagcttctcttcctcctgctactctggctcccagataacaccggacaacctgtgttgacgcagtctccaggcaccctgtctttgtctgcaggggatagagccctcctctcctgcaggccagtcagatatggcnccgactacgtgcctggtaccagcagacgacctggaccagcctcccgaggtcctccgtcactccgacggtcgcacgtacccaacgacgggcccagtccggcgtacccagacgtaggttcagtcggcaggtcggactgggacacgtctcactctcgacctatcgagcacgactagacgtacgtagtacgtntttgacttaggttagtggtaccgtgtacagtaccgtaggtcgtaacggactacggtcggtaccttaccgttacgtacccgtacggtaacccgtaagggaccgtaaccggtacgtaacgggtaaacgtaacggttaaacggccgttagtaccggtacctaggaccctaagtccgttacgtcgtttacccg

SEQ ID NO: 178670 - DNA, 709 bp, Homo sapiens
  misc_feature: GYAE6OF01AQDF3.44.10.A10.1.454.CMB.1.raw
  modified_base (464)..(464): a, c, t, g, unknown or other
  misc_feature (464)..(464): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccgtcctcactgtctgctctagttgggacagagtcacatcacttgccggcgagtcgccgactagttaggtcttttttggccgttggtttccagtcgtaggacgccgttacgggacaaaaccgcccccgttaaacgtcccccgtaggtaactttcctttttaccgtagggtaaccttcccgtaacgtttacggaaagtacgggtagggtaccgtaccccgaacggtcccgaggtttaccacggtcggtaccgtaggttcggttcgtacgggacctacgtactttccgaaccttcctacaaccgtntacgacggtacacgtccgtacgacacgtccgtaggtatcgttcgacgttacttacttacgtaccgtacctaaacgtaactttcttttacctttttacgtaccgtttacgttaccggtttggtaacccggtagggttaacccgaagtccgtaggtagtactaaccggaaaggttaccgtggttcggacgttacgacccgtaactacgttcgggttacttaccgttacttccgttcccttaccccgg

SEQ ID NO: 178671 - DNA, 635 bp, Homo sapiens
  misc_feature: GYAE6OF01EDWU3.44.10.A10.1.454.CMB.1.raw
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtcctccttcctccctgtctgtcttctataggagacagagtcgccatccacgttggccggnaagtcacgaccattaacagtacttaatttaaattggtatcagcagacgaccgaagggaacgcccctagaacctccgtgactctctcgctcnccctccactctgacgaggtggagtctcttacgtaaggttcgaggtggctaggtggtactcggtagggacctaaggttacgttttaccaccgttacctacccgtaacctacttccgtacctacgttactacgacctaaacgttagtaacgtttacttttacgacctttaacttactacttacgtacaacgtagtaacgttactaccgttccgttacccgtttacgttacggtttacgggccgggtaacacggtcggtacggtaagtacgtaaccgtaaacggttcgacgggtacgacgtacgaccctaccgtattccgttgttacccg

SEQ ID NO: 178672 - DNA, 625 bp, Homo sapiens
  misc_feature: GYAE6OF01CO539.44.10.A10.1.454.CMB.1.raw
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (596)..(597): a, c, t, g, unknown or other
  misc_feature (596)..(597): n is a, c, g, or t
  modified_base (599)..(599): a, c, t, g, unknown or other
  misc_feature (599)..(599): n is a, c, g, or t
  modified_base (601)..(625): a, c, t, g, unknown or other
  misc_feature (601)..(625): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggcctcctcatcccacggtgcatcccaacgagggccacgtggccgtccctgacaggttcagtggcaggtgggtctgggacagacttcactctcaccatcagcagccgtggacgccgttagaaagttatttttgtcgtaattggttatttactggttactattttccatttccgggttccccttttaccgttccgttaaccgtttttcggacccggtaacgggggaaccctaaaacggtacgggtaaaaacttaccgaaaaccgaacttcgggtacggtccgtaggaccctaacctacgttaccttcgtttaccctttactacctttcccgtttccccccgtactacttaccctttagaactttaattactttaaccgtttcgttaccgttagggtaacggggtcccgggtacgttcggggaaccggtaacgggtcccggaagtaacgttacggnngngnngngnnnnnnnnnnnnnnnnnnnnnnnnn

SEQ ID NO: 178673 - DNA, 702 bp, Homo sapiens
  misc_feature: GYAE6OF01AY9VG.44.10.A10.1.454.CMB.1.raw
  modified_base (262)..(262): a, c, t, g, unknown or other
  misc_feature (262)..(262): n is a, c, g, or t
tcagacagtatatacacgaccggtgctcgatttagcgtcgatctcagggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggaccctttaaagtctctatcatggtacncagtcggtcccgggccgacgccccaaagtccttctttacgaccgttcctttcgcgggtctcggcacgtcctggtccgttttcggcctccagttctcgaccacgtccgccctcctgaccactcacccaaaccgtcccggcctgacggactagacggtctgtaccttacgttttggttcgtgtctattacgtttcgtatttcacttaactaattacgttaggttccgtttacgggaacggtccgggtacccggtacggttcaacggtccgttaccgtcggtaccgttccgaaccgtaccccgaaacggcccccgtaaaccccgtacgttacccgtaccctaccgtttcccgttcccggttacccccggtcccctttaccccgttacctttaaccttaacgtttacccgtacgtttcccggtaggtaccggggtaccccgggg

SEQ ID NO: 178674 - DNA, 804 bp, Homo sapiens
  misc_feature: GYAE6OF01EF0OA.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttccttctgtcttctctgttggagcagcgtacaccatcacttggccgggcgagtcaggttcgttttcggtgtcttggttcgccgttggtttacaaaacggaaaaagggggtcgaccggtacccccgttaagggtcctaccgtctccgtacggtacgaaaacccgaggtacgtagggtaaacgggtacggaccggttacccccggtaccgtacgggttccaaggttcgacccgtaacggttcccggaagggttcggggtcggggacccggtacgttcccgaacgttccgtaccgaacctaagttaccggacccgtacccgtcggacccggtaccctaggtaacgtacgtttcgacgtaaccttaaccgttttagtttcctaggtacctaaggtacctaaggttacttaccgtaacgtttaccgggtcccgttacccccggtttactttaacgggttttccgggaacccggtaaggggtaaccccctaaagggtccgtaaaggtaaacccttacggaaaaccggttaagtcgggttacggaccttacggacctaaacccgttcgttccgtacggtttaccctaccttaacccgttcccccgtttaaccccgaccgttaaccttcccggtattaacctttaaacg

SEQ ID NO: 178675 - DNA, 627 bp, Homo sapiens
  misc_feature: GYAE6OF01AGJ5B.44.10.A10.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagacagtatatacacgaccggtgctcgatttagcgtcgatctcagggggaggaactgctcagttaggacccagacggaaccatggaagccccagcgcagcttcctcttcctcctgctactctggctcccagataccactggagaaatagtgatgacgcggtctccagcccaccctgtctgtgtcctcgaaggggaaancgcccaccctcncctgccgagggccagtcagagttgtagcagctaacttgcctacgaccagacaagaatctggaccacggcctcccgagcctcctacatctagtggtcgccacgtcccgaacgaccgggccctacgtacggtacctaccccgtaggacccgtaggttcgaggtcggcggtagggtcgggtcgtagggacgtagtacgttacctctaccgtaccacctataccgagaccacggtcctaggtcctacggtactagtaagtttatttcggtattaaggtttactttactagtacgactactaagttactaattcggacctcggtaccccttccggttaccgaccggaaggaccacggtacgtagaacgtaagttaaccggagtcgtggtacctacggaccttacagttctgtccgttacc

SEQ ID NO: 178676 - DNA, 755 bp, Homo sapiens
  misc_feature: GYAE6OF01CEDKF.44.10.A10.1.454.CMB.1.raw
  modified_base (199)..(199): a, c, t, g, unknown or other
  misc_feature (199)..(199): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggaagaaatagtgatgacgcagtctccagccaccctgtctttgtctccgaggggaaacncgccaccctctccgtgccgacgggccagtcaggtacgttgttagcacgtactaacgttacgcctacgtacagacaagtaaactcgtacggccacggcctacccgaggtccttaccgtcacttcgtagtcggttcgccacgtacccgaccggtacggtaccgtacgttcggtaacctcccgacggtacccgtaggttccgaggttcgggatacgggtgggtacgtcggaacgacggttacgtacctacgtccgtaccaccgtcgtaccgacgaccgtacggtccgtacgccggtacggttaacttaacgggttaaacggttttacttttcgggaacgtttttaacgttttaacgtttacggttacggttataacggtaccgttaaagttacgttaagtccgttaccggtaccggtttaccccttaccgggttaccggaaccggtaacgggtacccgtaacgggtacggttaacgggtaaacgtaacggttaaaccggtaggttcgggtaccggtcttaaccggaccttacccgtattccggttacgttccttaaccg

SEQ ID NO: 178677 - DNA, 713 bp, Homo sapiens
  misc_feature: GYAE6OF01DVLDD.44.10.A10.1.454.CMB.1.raw
  modified_base (308)..(308): a, c, t, g, unknown or other
  misc_feature (308)..(308): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggaagaaatagtgatgacgcggtctccagccacctgtctgtgtctccgaggggaagagccaccctctcctgcgagggccagtcagtagtgtagcagcaacttgcctacgtaccagacaagaaactcgtacggccaggcctcccggagtcctccgctactctagtcggnactacgtaccaccggccggtacctacgggttctacctacccgaacgtccgtacggtacgtacggtaggtcgtagggtcggtacggtacgggaacgtaggtacgtacccgacgttcccaactaccgtacgtacgaacgtacgacgtacccgtagtacggttacttacgaaggttacgtttacgtttcgtaacggtttttaacgtttaacgtttacgtttaccggtacgtaacgttacgtaagtttaaagtaacggttacgtaccgggttcccgttaccccgtttcccggtaaccggtaccggtaaacgggtacccgaaggttacgtaacggtaacgtaaacgttaaaagggtcggtacgtacggtaccgtacgtacccgttacctacgttcgtccgttcttacccg

SEQ ID NO: 178678 - DNA, 694 bp, Homo sapiens
  misc_feature: GYAE6OF01COIJL.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttcggccggcaagtcagaccattaacagcttaatttaattggtatcagcagagacaggaacgccctagaactcctgatctctcgctcgcctccactctgacgtaaggtggtacgtcttcttacgtaaggttcgtaggtggactaggtggattcggtagggactagttactttacacgttacctaccaaccctacttcccgtacctaacgttcccttaacgtacctaaacccgttaggtaaacgttacgtttttacgaaccttaaaccttttacgtaaccgtttacgtaaccctaaacgttaacgttaacgtttaacttaacccgttccggttacccccgttttacgtttaccggttttaccggggtacccggggtaacctaacgggtccgttaagggtaacggtaaacgttaaccggtaaaaccggttcggttacggtaccgggtacgttacccggaacctaccctacgtttcccgttacggtttacccg

SEQ ID NO: 178679 - DNA, 760 bp, Homo sapiens
  misc_feature: GYAE6OF01EM0R6.44.10.A10.1.454.CMB.1.raw
  modified_base (308)..(308): a, c, t, g, unknown or other
  misc_feature (308)..(308): n is a, c, g, or t
tcagacagtatatacacgaccggtgctcgatttagcgtcgatctcaggggggtcagtctcagtcaggacacagcatggacatgagggtcccccgctcagcctccgtggggctcctgctactctggctccgaggtgccagatgtgacatccagatcgaccagtcctcccttccctccctgtctgtcttctagtaggagacagacgtccgaccatccacgttcggcccgggacaacgtaccgacgaacctaattaacagtacttaaattttaaagttggtatcgagcgaaggaacgaacgaagggaaccncccgtagaacctctacggtacttcgtcgtcgtcctccgtccctccacttcgtacggacggtaagggtcggtacgttccgttaccgttaacggttaaggttcgagggttcgggtacgtagggttacgggtacgtacgggtacgggtaacgttaagtttaccgtttacgtacccttaccgtacccgtaaccttccgttacccgtaccgttacgtttacccgtacgtaacccgtaaaccgttaggtttaactttacgttttaccgaaccttttaacttacgttaccgttacgtaacctaagttacggtttaactttaaccgtaccgtttccccgtttcccgtttaacggttccggggtttaccggggaccgggtactacggtggtaacggtaacgtaacgtaccgtaaacgggtcttgggtcgtactacggactaaccgtctttcgtgttacccc

SEQ ID NO: 178680 - DNA, 626 bp, Homo sapiens
  misc_feature: GYAE6OF01EPUZ6.44.10.A10.1.454.CMB.1.raw
  modified_base (608)..(608): a, c, t, g, unknown or other
  misc_feature (608)..(608): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtcctccttcctccctgtctgcttctataggagacagagtcgccatcgcttggccgggcaagtcagaccattaacagtacttaatttaaattggtatcagcagagaccgagggaaacgcccctagaacctcctgactctctcgctcgccctccacttctcgacgtaaggtgacgttctacttacgtaaggttcaggtcggactaggtaggatacgtagggactaaggtctttacgacttccgtaccaacccttacttcctaccgtagtttccacgtacctaaaccgttagtaacgttcttttacgacttaactttactacttacgtacaactagtaacgtttactacgtccgttaccccgtttacgtacggttttacggggtaccggggtaactacggtacgtagggaacgtacgtaaccgaaacgtacgtcgtcggtacgtcgaccctaancgttccgtcggtttaccc

SEQ ID NO: 178681 - DNA, 841 bp, Homo sapiens
  misc_feature: GYAE6OF01DV2E6.44.10.A10.1.454.CMB.1.raw
tcagacagtatatacacgaccggtgctcgatttagcgtcgatctcgagggggggggtctcaggaggcagcgctctcgggacgtctccaccatggactgggctctgctgctcctcactctcctcacccaggacacagggtcctgggcccagtctcgccctgactcagcctgcccttcgtgtcgtgggtcgccgtggactacgtcggtcacctatcctcctgactacgtcgggacgcccgaggtaccggttaattacttttaccgttaacggtttaccttttaaaccgttttgttaccttccgttaggttactactaaacctatactaactaccgtaaacggtaaaacccgacccctaaaacctacaacttacctaacttacgttaacgtacggtacggtaacctaaagtaacggaccggtacccgtacggttaacgggttttacctaacgtccgtcttacctacgtcgtacccttaccgaacggtcccggaacctaaaccggacccggtccctacccgtaacgtaaacctaacgttccgtacggtccgggtaccgtacccggaacgggttccggtacgggtaacgggaaccgggtacggtacgtagtttaacgtttagtttacgtttggttccgtacttaacgtaggttacgtttacggttccgtaccgtacttacgttaccttaacgtttacgttacggtttacggtacggggttaacggtaaccgggtaacgtaaccgggttacccgtaaacccggttccggtaaggtacccgtaccggaacccgggtaaacccgcccctaaacccgtcgtaccgtacccgttaccgtcccgttaccccg

SEQ ID NO: 178682 - DNA, 691 bp, Homo sapiens
  misc_feature: GYAE6OF01D2N7B.44.10.A10.1.454.CMB.1.raw
  modified_base (296)..(296): a, c, t, g, unknown or other
  misc_feature (296)..(296): n is a, c, g, or t
tcagacagtatatacacgaccggtgctcgatttagcgtcgatctcaggggagagctgctcagttaggacccagagggaaccatggaaaccccagcgcagcttctcttcctcctgctactctggctcccagataacaccggacaacctgtgttgacgcagtctccaggcaccctgttctttgtctgcgaggggatagagccctccctctcctgcagggccagtcaagtaatagttggccgccgtactacttagcctggtaccagcagacgacctggccacgcctcccgaggcctccncactcccgacggtcgctacgtacccaacgacgggcccacggtcggcccgttccctagaccgtagggttcaggttggcgtagggttcggggtcgtaggggaacctaggtacctttcgaccgttcctaccaaccctataccgagcccacggtcccgtagggacgtaccgttaggtaagttagttttggtagttagttagtttattacgttcgttacttactttacctacgtttcgttaccctttaccgttacgtttaaccgtttcgggacccgtaacggggtaacctaacggtacggtaaaacttaccgtaaaaccggtacgtagggtcggtacgtacgtaccaaccgttcttccgttacgttaccctttacgtacccgttcccgttccccgtaccg

SEQ ID NO: 178683 - DNA, 746 bp, Homo sapiens
  misc_feature: GYAE6OF01EKIRK.44.10.A10.1.454.CMB.1.raw
  modified_base (191)..(191): a, c, t, g, unknown or other
  misc_feature (191)..(191): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtcgccagatgtgacatccagatcgacccagtcctccttcctcctgtctgtcttctatagganacagacgtcgcctatcctacgttggcccgggacaaacggtccaacgaacctaattaaaccgagtacttaaattttaaagttggtatcgagacgaagtaacggaaccgaagggaaacctccccgtagaaaccttccgtagacttccgtcgtcggtcctacgccctcctacttcgtacggtacggaagggttgtacgttccttacgttacgtaacggttccagggtacggtacgtagggtacgtacgtacggtacgggactacggttactttccgaccttccgtaccctacccttaccgtaccctacgttacgtaccgtaaccgtaaccgtaagttaacggttaacttttaccggttaacctaaccgtttaaaccgttaccgttacgtactaaccgtaaggttaaccgttaacgttacccggtccgtttaccccggtttaccgtttacggtttacggggttacgggaacccggtagtaccgggttgtaacggtaacgtaaccgtaaacgtacggttacgcggtcggactaccacttacgtcgttcgttcgttacccg

SEQ ID NO: 178684 - DNA, 756 bp, Homo sapiens
  misc_feature: GYAE6OF01DK9YR.44.10.A10.1.454.CMB.1.raw
  modified_base (207)..(207): a, c, t, g, unknown or other
  misc_feature (207)..(207): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
tcagacagtatatacacgaccggtgctcgatttagcgtcgatctcagggggaggaactgctcagttaggacccagacggaaccatggaagccccagcgcagcttctcttcctcctgctactctggcctcccagataccacgtggaagaaatgtgatgacgcggtctccagccctaccctgtctgtcgtccgtaccggaaggggaacncgccccacccttctccgtggacgagggcccagtcaggtagtgtacgcagctaacgttcgcctacgtacagcaagaactcgaggccacggtcctccgagtcctctactatctagtggtcactactccgacgnggcctagtcgtaccnccgagtccgtaggtcaggttcggacgtacggtggtacgacggacgtacgtaccttcccgacttccgtaccgaccggtacacgtacttaacgtacgtaaccgacggtaccttaaggttaaacgttttcgtttacggacgtttttaacgtttacgttacgtacggtacgtacgtccgtacggtttcccgttacccgaaccgggtccggtacccgtttaccgtttcccgggttaaccggggtttaccgggggaacccgggggtaacgttaacggggtaacggtacggtaaacccggtaacggtaaacgggtaacccgtttaggggttaccggacgggttaccccacggttaaaccccgtaaccgttcctttaccgggtttaccttaccgttcccctttaccccggg

SEQ ID NO: 178685 - DNA, 601 bp, Homo sapiens
  misc_feature: GYAE6OF01DB3PU.44.10.A10.1.454.CMB.1.raw
  modified_base (303)..(303): a, c, t, g, unknown or other
  misc_feature (303)..(303): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctccagataccactggagaaatagtgatgacgcggtctccagccaccctgtctgtgtctccgaggggaaagcgccaccctctcctgcgagggccagtcagagtgttagcagcaacttagcctcgtaccagcaagaaactcgtggcccaggcctcccaggtcctcctcatctagtggtncactcccacgacgggccacgtggtactcccagccgtaggttcaggttcggcgtaggtcggggtctagggactaggtacgttcacttccgtacaccgatcagcacgcctgcgtagtctagtaagttgttttagactttaagtttactacgttgtacagtacgtaagttaataagtggtacgtcggtacccttaccggttaccggaccggtaacgggacctacggtacgtaggaacgtaaacgttaaacggacgttcggtacgtacgtacgtacctaaccgtattcctgttccttacccg

SEQ ID NO: 178686 - DNA, 795 bp, Homo sapiens
  misc_feature: GYAE6OF01BE049.44.10.A10.1.454.CMB.1.raw
  modified_base (194)..(194): a, c, t, g, unknown or other
  misc_feature (194)..(194): n is a, c, g, or t
tcagacagtatatacacgaccggtgctcgatttagcgtcgatctcagggggaggaactgctcagttaggacccagacggaaccatggaagccccagcgcagcttctcttcctcctgctactctgctcccagacttccaccggcgtaaattgtgttgacgcagtctcgaggccacctgtcttgtctcgagggaancgcctacctctctgcgaggccagtcagtagtgtacgaccaccaccacagtccttctacgccgtagtaccagacgaaggaccgcgtacggacctacggccctacccgacggtcctacctactagttaactacggatccgactacctacggacgacgaaccggtccacgtcgacctaccgtacccgaaggtacgtcggtaccgtagggtacgcgtacgggtcgggttacggacggtaaactccgggttacttacccgtaccgtaccgttacgacgtaaccgtacgttaccgggacggtaccgggtacggttacgggaaccgtccggttaagggttaacggttcgttttaaccgtacgttttaagttttaaccgttacggttaccgtaacgttacggtacgttaaaggtttaaccgtaaccgtttaccgtccggttacctttacccgggtaccggtttaaccggggttaccggggtaaccgggggttaaccgttaacgggggtaacggtaacccggtaaggttaaacccggttaaaacggtccgggttaacgttacccgggttaccgtaccgggtaaccgttaacgtccgtttcgtaacccggg

SEQ ID NO: 178687 - DNA, 559 bp, Homo sapiens
  misc_feature: GYAE6OF01C8Q46.44.10.A10.1.454.CMB.1.raw
  modified_base (155)..(155): a, c, t, g, unknown or other
  misc_feature (155)..(155): n is a, c, g, or t
  modified_base (164)..(164): a, c, t, g, unknown or other
  misc_feature (164)..(164): n is a, c, g, or t
  modified_base (183)..(183): a, c, t, g, unknown or other
  misc_feature (183)..(183): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (541)..(541): a, c, t, g, unknown or other
  misc_feature (541)..(541): n is a, c, g, or t
  modified_base (543)..(559): a, c, t, g, unknown or other
  misc_feature (543)..(559): n is a, c, g, or t
tcagacagtatatacacgaccggtgctcgatttagcgtcgatctcaggggatagagccctccctctcctgcagggccagtcagaatattggcgccgactacttagcctggtaccagcagagacctggccagcctcccaggctcctcatccaggtncatccaagngggccacgtggccgtcccngactaggttcaggtggctaggtgggtctggggaacaggaccttcactcctccacctatccagccagccgtgggacgcctagtaagttattttggagtagtttagttaactttacgtagttacttactttcccgtagttccggtttaccccctttacgttaccggttaacggtttttccggacccggtaacggggtaaaccctaaacggttaacggtaaaactaaccgaaaacgtaacgtggtacggacctgacctaccgtacttcgttactttcgttactaccgttcccctcccgtactacttcgtagtattactacttactcgttcgtagcggcgtcgngaacgnggctacagtcgngnnnnnnnnnnnnnnnnn

SEQ ID NO: 178688 - DNA, 774 bp, Homo sapiens
  misc_feature: GYAE6OF01ECJDD.44.10.A10.1.454.CMB.1.raw
  modified_base (147)..(147): a, c, t, g, unknown or other
  misc_feature (147)..(147): n is a, c, g, or t
  modified_base (165)..(165): a, c, t, g, unknown or other
  misc_feature (165)..(165): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (325)..(325): a, c, t, g, unknown or other
  misc_feature (325)..(325): n is a, c, g, or t
tcagacagtatatacacgaccggtgctcgatttagcgtcgatctcgagggggaggaactgctcagttaggacccagacggaaccatggaagccccagcgcagcttctcttcctcctgcctactctggctcccagataccactggaanaatgtcgatgacgcgtcnccagccacctgtctgtcgtctccggaaggggaacngccctacccctntccgtagcgaggccagtcaggtagtgtagcagactaacttgcctgaacagacaagtaatcgtcggaccaggtactcccgaggtccttacctctatacgtagtggtcgactacncccgaacgtacggacctacgtacgtacctcccacgaccgtacggttccgaggtacgtacgtaggggttcggtacggtaggacctaggtaccgtttcaaaccgttcctaaccgactaacggtcgacgtaccgaacgtccgtacggtaacgtacggttacgtaagttaacggtttacgttttacgaaccgttttaagtttaacccgtttagttacggtacgtaaccggtaacttaagggttaacgttaacggttaccggttaacccgttcccgggttaccccgtttaccgggtaacccgggtaaacggtaaaccggggtaccgtaaaccggttaagggttaaaccggaaacggtttaaaccggttaaaaacggtcggttcgggtaaaccggttaccgaacccgtacccgttaaccgttaccgttaccggtttccgtaaccgttttaccccg

SEQ ID NO: 178689 - DNA, 665 bp, Homo sapiens
  misc_feature: GYAE6OF01CWZQ1.44.10.A10.1.454.CMB.1.raw
  modified_base (144)..(144): a, c, t, g, unknown or other
  misc_feature (144)..(144): n is a, c, g, or t
  modified_base (165)..(165): a, c, t, g, unknown or other
  misc_feature (165)..(165): n is a, c, g, or t
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (402)..(402): a, c, t, g, unknown or other
  misc_feature (402)..(402): n is a, c, g, or t
  modified_base (460)..(460): a, c, t, g, unknown or other
  misc_feature (460)..(460): n is a, c, g, or t
  modified_base (482)..(482): a, c, t, g, unknown or other
  misc_feature (482)..(482): n is a, c, g, or t
  modified_base (624)..(624): a, c, t, g, unknown or other
  misc_feature (624)..(624): n is a, c, g, or t
  modified_base (640)..(640): a, c, t, g, unknown or other
  misc_feature (640)..(640): n is a, c, g, or t
tcagacagtatatacacgaccggtgctcgatttagcgtcgatctcgagggggtcagtctcagtcaggacacagcatggacagtgagggtccccgctcagctccgtggggctcctgctactctggctccgaggtcgccagagtgngactactccaagatcgacccngttcctccttcctcccgtgtcctgtccttnacgtaggagacaggacgtcncatctacgttggaccggcaagtcagacctagtaacngtactaattttaacggtgtaancagcgtaagacgacggaacgggaactccctagtaacctcgngtacttcnctacgtcnccgtaccttcacgttcgtagaggacggtggtctccttacgttaggtacgttacgtggacggtgtaaggtcgnttaacggcggaatatttccctaccgccctacgtactactcccgttactcggtaccgtntaaaccgcttaaaggtactttntacgtaaccttacactttacgattacccgaaatcgttaactttaccgacccttcggtttaccccgttatttccggggttaacgggtcgggaaacccttaggcggaaagtacgtaaccgtaaacggtacccgtaagttccggngaaccttcggaaaccngggtttctacggtccttacttaacc

SEQ ID NO: 178690 - DNA, 644 bp, Homo sapiens
  misc_feature: GYAE6OF01AJBI8.44.10.A10.1.454.CMB.1.raw
  modified_base (489)..(489): a, c, t, g, unknown or other
  misc_feature (489)..(489): n is a, c, g, or t
tcagacagtatatacacgaccggtgctcgatttagcgtcgatctcaggggggggtctcaggaggcagcactctcgggacgtctccaccatggcctgggctctactcctcctcagcctcctcactcagggcacagggtcctggggactgtctaccctgactcagcccgccctcagtgtccgggactcctggtcagtcggtcaccatcttctgttcttccagcgacaattccactggccctttaaagtcctctatcatggtacgcagtggtcccggccgacgcccccaagtcctcttttacgacgtccttcgcgggcttcggcacgtccctggtcccgtttttcggccctccagttcctgacccacgtcccggcccttcccctcgacccactccaaccctaaaccgtcccggcctgacggatgtacggccttagtaccgttactttttcggtttgtcgtctattactttcgactttccacttacaaacttnttgttccttacgggtaagtccggggaccccgtcgtcctaggccgttccgtcgtccgtactaccgacccgaacggaccccaacccacctcgtcctaccgttccttccgttcccccgtcccttaccctctacttactacttgtctggtcggtccggg

SEQ ID NO: 178691 - DNA, 337 bp, Homo sapiens
  misc_feature: GYAE6OF01ASSNZ.44.10.A10.1.454.CMB.1.raw
  modified_base (211)..(211): a, c, t, g, unknown or other
  misc_feature (211)..(211): n is a, c, g, or t
  modified_base (331)..(337): a, c, t, g, unknown or other
  misc_feature (331)..(337): n is a, c, g, or t
tcagacagtatatacacgaccggtgctcgatttagcgtcgatctcaggctgtacattctacatggagttgtacagcctgagatctgacgacacgggcgtctattattgtgcgagagcccaacggaacctgcttctttctgactacgtgggccatggaaccctggtccaccgtctcctcagcctccaccaagggcccatccggtcttccccnggccgccctgctccaggacgccacctccgagcgcacgagccggccctgggctgccgtggtcaaggaccttacttcctatactactggtctaggagcgggtctggacaaggccgacatagnnnnnnn

SEQ ID NO: 178692 - DNA, 775 bp, Homo sapiens
  misc_feature: GYAE6OF01BOWL9.44.10.A10.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccaccggagaaattgtgttgacgcagtctccaggccaccctgtctttgtctccgaggggaaancgccaccctntcctgcgacgggcctagtcaagacgtgttacgacaccgaacccaccagtccttcttacgcccgtaggtaacccaccgaagaaacccgtgggccaggccctacccgaggtccctccctactacgtctaacgttacggaaacctacgttccccgaaccggacgggacccaacgttacgggtaccctcccccgaacccgtagggtttacccgaggtcgggtccgtaagggttccggggtacccggggtaacaaggttacgtttacccgaccgtttacccgtaacgaccccgtaagttccggaacggcccggaccttcgacgtacgttcgtaggtaacggttacttttacgactttaacggttttaactttacgttagtcgtaacgtcgtaaacggttaattaaacgttaaccgttccggttaccttaccgtaccgttacgggtttccgggggtaacccgggggtaccttaaggggtacggtaacgtaaccgtaagtaaaccggtcgtaggttacggcgtaggaccacgtacgtacgttcgttactcttacctccgttccccgtcttaacg

SEQ ID NO: 178693 - DNA, 682 bp, Homo sapiens
  misc_feature: GYAE6OF01B1SVQ.44.10.A10.1.454.CMB.1.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (494)..(494): a, c, t, g, unknown or other
  misc_feature (494)..(494): n is a, c, g, or t
  modified_base (654)..(654): a, c, t, g, unknown or other
  misc_feature (654)..(654): n is a, c, g, or t
  modified_base (677)..(677): a, c, t, g, unknown or other
  misc_feature (677)..(677): n is a, c, g, or t
tcagacagtatatacacgaccggtgctcgatttagcgtcgatctcagggggtcagtctcagtcaggacacagcatggacatgagggtccccgctcagctccgtggggctcctgctactcgtcggtcctccggaggtcgccagtatggtgacatccagtactcgaaccctgttccttccttccctcccttgtctcgtcttatagtaggagacgagcgtccgctactctacggttcggccggtactaacgtccgaacaaccgtaataacagttacttaagttttaaagtggtactacgacgtacgaagacgtaaccgaagggaacctccctaacgtacctcgtanccgttctactcggtaccnccgtccctcctacttcggacgtaacggtacgggttacttaccgttcctttaccgtaaggttaacggttcacgggtggaactggggttagcggttacggggtaggtaacttacggttcttcgaacctctaaccncttacctcctacgtacttccggacacgtaacgtagttactttacgttacgtacttaacgttactacgacgttacaacgttgttaacttcgtacccgttcgttaccgttcggtttaagggtcccgggtagacgtagcggtagactacgaagtaacggtcgnttacggctctaccgatctcgttntaccc

SEQ ID NO: 178694 - DNA, 791 bp, Homo sapiens
  misc_feature: GYAE6OF01AGZ0P.44.10.A10.1.454.CMB.1.raw
  modified_base (316)..(316): a, c, t, g, unknown or other
  misc_feature (316)..(316): n is a, c, g, or t
tcagacagtatatacacgaccggtgctcgatttagcgtcgatctcagggggtcagtctcagtcaggacacagcatggacatgagggtccccgctcagctccgtggggcctcctgctactctggctccggaggtgccagatgtgacactccgagatcgaccctagttccttcccttcctccctgttcctagtcttacgtagtacggagacgaggacgtccgcctatcctacgtcggaccggactaacgcacgtaactaattaacgacgtacttaatttaaagttggtatacgaggcaagacgaaccgacgggaaccncccgtagacctctagactctcgtctcgtccgcctcctacgtacgtcggagtacggtcggtacttcgttaccgttaggtaccggttgacgggtacgtggtaacgtaggtcgttacggtcgggtaaacttcgttattaccgtaccttcctaaccgacttacctttcccgtacgtacgtacccgtacaacttaacggttacgtaactttacgtttaaccgtaacgttaaccttttacgtaaccgtttataaccccgtaagtttaaggttaccgttaaccccgtttacccgttcccgggtttaaccccgttttaccggggtttaaccggggttaccccggggggaaacccgtacgggtaaccggttacgggtaaaccggttacggtttaaaacccggaaccggttaacggttcggtaacccggggttacgaacccctttaccgaaccgtttacgtacgttttcccgttgtttacccccg

SEQ ID NO: 178695 - DNA, 773 bp, Homo sapiens
  misc_feature: GYAE6OF01CD95C.44.10.A10.1.454.CMB.1.raw
  modified_base (184)..(184): a, c, t, g, unknown or other
  misc_feature (184)..(184): n is a, c, g, or t
  modified_base (278)..(278): a, c, t, g, unknown or other
  misc_feature (278)..(278): n is a, c, g, or t
  modified_base (694)..(694): a, c, t, g, unknown or other
  misc_feature (694)..(694): n is a, c, g, or t
tcagacagtatatacacgaccggtgctcgatttagcgtcgatctcgaggggggggtctcaggaggcagcactcgtcgggacgtcctccaccatggcctgggctctactcctcctcacgcctcctcactcgagggtcacgtagggtcctggggtctgtactacccgtgacgtcacgccgtcctgngtcggtccggtactcgtgcagtcgacactgtcttgtcgtctcgagcactacttccacgttcgtacctttaagctcgtactcgagtcggtaccgngtacggtccgggacccggaaccgtaccgtaaccccgttaacgttccgtttaccgtttacggtaccgtttccggttccgggcgggttacgtaccgggtacctccgggttacccggttcgggtttcccggttttaccggccgttaccgtacgtttcccgacgtacccggccggtcccggtccgttaccgtacgtacctaacgttaacccgaacccggttaaccgtccggtccgtaaggtaccggtacgtacggtacgtcgttaacgttcgttttaggtttcgtcggtacgtctacgtttacgtacgtacctctaacgttaactacggttcgttacggttccggtaaggtacggtcccgtcggtactacgtaccggtcgtaccgtcgtaccgtccgaccgtacccggtaccggtaaccncccgttcgtaccgttcgtcgtcccgttcccgtaacctccgtacctcggttactcggtacgttcgccgtggtacgtcggg

SEQ ID NO: 178696 - DNA, 883 bp, Homo sapiens
  misc_feature: GYAE6OF01EAEKZ.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccggaggtgccagatgtgacatccagatcgacccagtcctcccttcctccctgtctgtcttctagtaggagacaggacgtccgcctatccgtacgttcggaccgggacaacggtccaacgtaaccctaagtttaaaccacggtactttaaagtttttaaaagttcgggttaactaccggaagtaccgaaaggaaccggaaacccggaaacggggggtaaaaccccgtaccccccgttaacgggtaaacccctttaccccgtaacggttaacctttcccgttccgtcggtacccgttcccgtaccccttaccctacccgttccgttacgggaaccggttaacgggggttacgggtaaccttttccgttaaccggtttaaccgtaacggggtttaccgtaagggggttcggtaaccgttagggtacgggtaacgttcggggtaacggggaacttaaggttacctttaccgaccgtttacccgtacctaacccgtaccttcccgtaaccgtacgttccgtacgtaaccctaacgttaaggtaacgtttacgtttaactaacccgtttaaacctttaaccgttaacgttactaaacgaacgttaacgttaaccggtttactacccggttaccgtttacccggtttaccggtttaaccgggtttaccgggggaccgggtaacctacgggtacgtaaggtaccgtaacgtaacgtaacggtcgttacggtcggtacgtacgtacctaacgtctttcgtcgttaccc

SEQ ID NO: 178697 - DNA, 212 bp, Homo sapiens
  misc_feature: GYAE6OF02HEUFX.44.10.A10.1.454.CMB.1.raw
  modified_base (210)..(212): a, c, t, g, unknown or other
  misc_feature (210)..(212): n is a, c, g, or t
tcagacagtatatacacgaccggtgctcgatttagcgtcgatctcaggggaggaactgctcagttaggacccagacggaaccatggaagccccagcgcagcttctcttcctcctgctactctggctcccaggaactgtggctgcaccatctgtcttcatcttcccgccatctgatatatactgtctgagcgggctggcaaggcgcatagnnn

SEQ ID NO: 178698 - DNA, 541 bp, Homo sapiens
  misc_feature: GYAE6OF02HOXU8.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggcctcccagataccactggagaaatagtgatgacgcggtctccagcccaccctgtctgtgtctccgaggggaaagagcccaccctctcctgcagggccagtcagagtgttagcagcaacttagcctcgtaccagcagaaatctggccaggctcccaggctcctcatctatggtgcatccaccgagggccacgtggtactcccagcctaggttcaggtggcaggtggtctgggacagtgttcactctcaccatcagcagcctgcagtctaggattatttgcttagttttattacttgtacagctagtataatgactcggtcccttccgttcggaccaacgggacacggacgtggaagtaacgttaaccgaacgttggtacggtcgtacgacctaaccgtacttcgttgttaccttacg

SEQ ID NO: 178699 - DNA, 571 bp, Homo sapiens
  misc_feature: GYAE6OF02H2PLX.44.10.A10.1.454.CMB.1.raw
  modified_base (194)..(194): a, c, t, g, unknown or other
  misc_feature (194)..(194): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccagggganagagccacctctcctgtacgggccagtcggagtgttgctaagtcctagcctggtaccaacagaaacctggccaggctccaggctcctcatctatgatgcatccaagagggtcactggccaccccagacaggttcagtcggcaggtgggtctgggacagtacttcactctcaccgtcagcaatcgtacacgcctagtaagtatttgtctagtttattactgtctagtctagtccgttcctccgacggccgtcctctaccgtttcggggaccgggggtaccgtaacgggtgggacgacgtacgaggtacggaacgttggtcggtcgtgccgtacctacgttccgttcggttccttaccgtacttcccgttcccgtaccc

SEQ ID NO: 178700 - DNA, 408 bp, Homo sapiens
  misc_feature: GYAE6OF02I9GU5.44.10.A10.1.454.CMB.1.raw
  modified_base (401)..(408): a, c, t, g, unknown or other
  misc_feature (401)..(408): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctgaagattttgtgatgtattactgtcatttccatggtcccttactcgaacttttggccaggggaccaaactggaaatcaaacgaactgtggctgcaccatctgtcttcatctcccgcatctgatatatactgtctgagcggctggcaaggcgcatagnnnnnnnn

SEQ ID NO: 178701 - DNA, 411 bp, Homo sapiens
  misc_feature: GYAE6OF02I1B1Z.44.10.A10.1.454.CMB.1.raw
  modified_base (395)..(395): a, c, t, g, unknown or other
  misc_feature (395)..(395): n is a, c, g, or t
  modified_base (401)..(411): a, c, t, g, unknown or other
  misc_feature (401)..(411): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggtatcccagccaggttcagtggcagtgggtctgggacagagttcactctcaccatcagcagcctgcagtctgaagattttgctagtttatactgtcagcagtataatgactggcctccttcggccaagggacacgactggagattaaacgactgtggctgcaccatctgtctcatccttcccgcctatctgatatatactgtctgagcggctggcgaaggcncatagnnnnnnnnnnn

SEQ ID NO: 178702 - DNA, 494 bp, Homo sapiens
  misc_feature: GYAE6OF02I0GYD.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtgcagtggatcgtgggacagatttcactctcaccatctccagtctgcaacctgaagtatttgactaacttactactgtacaacagtagttatactcgtcccgttctacgttttcggtacggggaccaagcgtaggagtatacaaacgactgtagctgcacatctgtc

SEQ ID NO: 178703 - DNA, 318 bp, Homo sapiens
  misc_feature: GYAE6OF02G1AUF.44.10.A10.1.454.CMB.1.raw
  modified_base (313)..(318): a, c, t, g, unknown or other
  misc_feature (313)..(318): n is a, c, g, or t
tcagacagtatatacacgaccggtgctcgatttagcgtcgatctcaggcgtgtacattctacatggagttgtacagcctgagatctgacgacacgggcgtctattattgtgcgagagcccaacggaacctgcttctttctgactactgggccatggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatagnnnnnn

SEQ ID NO: 178704 - DNA, 410 bp, Homo sapiens
  misc_feature: GYAE6OF02FIDB8.44.10.A10.1.454.CMB.1.raw
  modified_base (399)..(399): a, c, t, g, unknown or other
  misc_feature (399)..(399): n is a, c, g, or t
  modified_base (404)..(410): a, c, t, g, unknown or other
  misc_feature (404)..(410): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctggagatttcgcgacttattactgccaacaatatctttttatccgtacagttttggccaggggaccaagctggagatcaaaggaactgtggctgcaccatctgtcttcatcttcccgccatctgatatatactgtctgagcgggctggcaaggcgnatagnnnnnnn

SEQ ID NO: 178705 - DNA, 537 bp, Homo sapiens
  misc_feature: GYAE6OF02IRZGW.44.10.A10.1.454.CMB.1.raw
  modified_base (196)..(196): a, c, t, g, unknown or other
  misc_feature (196)..(196): n is a, c, g, or t
  modified_base (351)..(351): a, c, t, g, unknown or other
  misc_feature (351)..(351): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccaggctcccaggctcctcatctatggtgcatccacagggcccaatggtactcccgagccaggttcagtggcagtggtctgggacngagttcactctcacatcagcagcctgcagtctagaagtattttgctagtttatgtactgtcagcagcgttagctaacgtcggaccgtactccgaccgttcggacccgtaagggaccaccggtaacgttggaacgtaacgttaaaccgaacgttcggtacggaccgtaggaccgtaccgagttccgg

SEQ ID NO: 178706 - DNA, 411 bp, Homo sapiens
  misc_feature: GYAE6OF02GY2VQ.44.10.A10.1.454.CMB.1.raw
  modified_base (400)..(411): a, c, t, g, unknown or other
  misc_feature (400)..(411): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctgaagattttgtgatgtattactgtcatttccatggtcccttactcgaacttttggccaggggaccaaactggaaatcaaacgactgtggctgcacatctgtcttcatctcccgcatctgatatatactgtctgagcgggctggcaaggcgcatagnnnnnnnnnnnn

SEQ ID NO: 178707 - DNA, 679 bp, Homo sapiens
  misc_feature: GYAE6OF02JYQMW.44.10.A10.1.454.CMB.1.raw
  modified_base (198)..(198): a, c, t, g, unknown or other
  misc_feature (198)..(198): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaattgtgttgacgcagtctccaggcaccctgtctttgtctccgaggggaaagngccacctctcctgcagggccagtcagagtgttaccagcaacttgcctggtaccaccagaacctggcaggcctccaggcctcctcactctatcggaacactccaccgacgggccacgtggtacctcccaacccgaggttccaggttcggcgacggttcggggtaccgggacagtacgttccacttcgtccaaccgtatccgagccggtcctggcctaggttcgtaggtacggtagttttgacgttagttttacttacgttcgttaccttaacgtaaccgtaaaggtacggttcggtaccgttacctaaattacttaccgttacgtttccggtacccgtacgggtaaccgtaaacggttcggtaacttaacgtaaccgaaaccgttaacgttacgggtacgtaccgttacggacctaaccctagtttaccgtacggtttaccttacgtaccgtttcccgttaccccgtcctacgttcctaacg

SEQ ID NO: 178708 - DNA, 488 bp, Homo sapiens
  misc_feature: GYAE6OF02FE9T5.44.10.A10.1.454.CMB.1.raw
  modified_base (232)..(232): a, c, t, g, unknown or other
  misc_feature (232)..(232): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtcctgctttctataggagacagagtcgccatcacttgccgggcaagtcagaccattaacngctatttaaattggtatcagcagagaccagggaaagcccctcaactcctgatctatgctgcgtccattttgcaaagtgggtccccatcaaggttcagtggcagtggatctgggacagatttcactctcaccatcagcagtctgcaacctgaagatttcgcagcttattattgtacaacagagtgactaatactccgctcacttcggcggaggaccagttgaggagatacgaaacgtactggtaggctgcacctacg

SEQ ID NO: 178709 - DNA, 585 bp, Homo sapiens
  misc_feature: GYAE6OF02HM2P6.44.10.A10.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
tcagacagtatatacacgaccggtgctcgatttagcgtcgatctcagggggaggaactgctcagttaggacccagagggaaccatggaaaccccagcgcagcttctcttcctcctgctactctggctcccagataccaccggagaaattgtgttgacgcagtctccaggcaccctgtctttgtctccaggggaangccacctctcctgcagggccagtcagngtgttaggactactagcctggtatcaangacactggccaggctccaggctcctcatctatgatgcatccaagtacgggccgcggcacgtcccgagcctaggttccaggtggctaggtgggtctggacgacagtacttcgactctacacctatcgaggccggtacgtagacggaccggtaagtattttcgacgttagtttacttacgtagtactaacgtaccgtacgacgtacgtacggtaccgtacggttacgttacggttttacggaccggtacgggaccgtaacgtcgtaggacgtacgtacgaacgtacgtggtcggcgtacgccgactacgtcgtcgtcttctactccttcccgctacg

SEQ ID NO: 178710 - DNA, 512 bp, Homo sapiens
  misc_feature: GYAE6OF02JGIYL.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggttcagtggcagtgggtctgggacagagttcactctcaccatcagcagcctgcagtctgaagtatttgctagtttattactgtcagctagtatagtgtactggtccttcgttcgtacctttcggcccgttcgggaccctacgcgttcgtactttacaaacgtactggtcgctcgccacctatctcg

SEQ ID NO: 178711 - DNA, 500 bp, Homo sapiens
  misc_feature: GYAE6OF02HBP1S.44.10.A10.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (399)..(399): a, c, t, g, unknown or other
  misc_feature (399)..(399): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccacctctcctgcagggccagtcagagtgtagcagcaacttagcctcgtaccagcagaaatctggccaggctcccaggctcctcatctatggtncatcccaccgagggccacgtggtactccccgagcccaggttcaggtcggcaggtgggtctgggacaggtagttcactctcaccatcagcagcctgcagtctagaagtntttgcttagtttattactgtcagtcagtataatgtactggccttccgtcgaccaaggcacgactggagtaataacgactgtgtctcgcacctatctgtctc

SEQ ID NO: 178712 - DNA, 319 bp, Homo sapiens
  misc_feature: GYAE6OF02FSGQD.44.10.A10.1.454.CMB.1.raw
  modified_base (314)..(319): a, c, t, g, unknown or other
  misc_feature (314)..(319): n is a, c, g, or t
tcagacagtatatacacgaccggtgctcgatttagcgtcgatctcaggctgtacattctacatggagttgtacagcctgagatctgacgacacgggcgtctattattgtgcgagagcccaacggaacctgcttctttctgactactggggccatggaaccctggtcaccgtctcctcagcctccaccaagggcccatcggtcttccccctggcgccctgctccaggagcacctccgagagcacagcggccctgggctgcctggtcaaggactacttccacgtctactgctgagcgggctggcaaggcgcatagnnnnnn

SEQ ID NO: 178713 - DNA, 554 bp, Homo sapiens
  misc_feature: GYAE6OF02GZXKR.44.10.A10.1.454.CMB.1.raw
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
  modified_base (344)..(344): a, c, t, g, unknown or other
  misc_feature (344)..(344): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatcgacccagtctccttcctcctgtctgcttctataggagacagagtcgccatcacttgccggnaagtcagaccattaacagtactatttaaattggtatcagcagagaccaagggaaacncccctagaacctcctgactctctgctcgcctccactctgcaagggtggagtctcttcgaaggttcaggtgctagnggatcgtgggacagtacttcactctcacactctcagtctgaccacctagagttatttcgactaacttactactactacaactagtagtttactacgttccgtaccccgttacgttacggttttcgggtaccgggggtacctaacggtcgtagggacgtaactaaccgaaacggtacgtggtacgacgtacgacctactacgttctgttcc

SEQ ID NO: 178714 - DNA, 529 bp, Homo sapiens
  misc_feature: GYAE6OF02GIL0W.44.10.A10.1.454.CMB.1.raw
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (506)..(507): a, c, t, g, unknown or other
  misc_feature (506)..(507): n is a, c, g, or t
  modified_base (509)..(529): a, c, t, g, unknown or other
  misc_feature (509)..(529): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctgcagtctgaagtattttgctagtttattactgtcagcagtatagtgacgtcggtccttccgttctaccgttttccggcccgttcgggaccctacgtagttccgtatttaccgaaaacgtactggtacggtccttacggaccacctattctcgttccttctacttcccttaccccgcctacttcctagtaacttacttacttaccttgttaccttggacggtccggggtctacgggaccgaacgggtccgacgtaagttacggcngntanngnnnnnnnnnnnnnnnnnnnnn

SEQ ID NO: 178715 - DNA, 413 bp, Homo sapiens
  misc_feature: GYAE6OF02H9FZ9.44.10.A10.1.454.CMB.1.raw
  modified_base (377)..(377): a, c, t, g, unknown or other
  misc_feature (377)..(377): n is a, c, g, or t
  modified_base (405)..(413): a, c, t, g, unknown or other
  misc_feature (405)..(413): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctgaagattttgtgatgtattactgtcatttccatggtcccttacctcgaacttttggccaggggaccaaactggaaatcaaacgaactgtggctgcaccatctgtcttcatcttcccgcatctgatatatactntctgagcgggctggcaagggcgcatagnnnnnnnnn

SEQ ID NO: 178716 - DNA, 315 bp, Homo sapiens
  misc_feature: GYAE6OF02H6FE5.44.10.A10.1.454.CMB.1.raw
  modified_base (309)..(315): a, c, t, g, unknown or other
  misc_feature (309)..(315): n is a, c, g, or t
tcagacagtatatacacgaccggtgctcgatttagcgtcgatctcaggctgtacattctacatggagttgtacagcctgagatctgacgacacgggcgtctattattgtgcgagagccccctgagacggtccccgcttgactactggggccagggaccctggtcaccgtctcctcagcctccaccaagggcccatcggtcttcccctggcgccctgctccaggagcacctccgagagcacagcggcctgggctgcctggtcaaggctacttccacgtctactgctgagcgggctggcaaggcgcatagnnnnnnn

SEQ ID NO: 178717 - DNA, 720 bp, Homo sapiens
  misc_feature: GYAE6OF02FP7CP.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaagccccctagacctctagactcctctcgctcgcctcctactctgacgtaagggtggtacgtccttccttacgtaacggttcgtaggtcggacgtaggtggtacttcggtagggaactagttactttacctacgtcctaccaacctacttcctaccgtacgttcgtcgaaccctaaccgttagtaacgtttagttttacgaaccttaaacctttacctacgttacgtaaccgtaaacgtaacggtttaacgttttaacttacccgttacccggtttaccccccgttttaaccggttttaccgggtttttaccggggggtaaccggggtaaacccgttaacggtccgggttaacgggtaacggtaaaccttaaaccggtaaaaaccggttacggtttacgggttacgggtaccgtttccggaacccgtaaccgttacgtttaccgtttacgtttaccc

SEQ ID NO: 178718 - DNA, 553 bp, Homo sapiens
  misc_feature: GYAE6OF02GXCGR.44.10.A10.1.454.CMB.1.raw
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (506)..(506): a, c, t, g, unknown or other
  misc_feature (506)..(506): n is a, c, g, or t
  modified_base (548)..(548): a, c, t, g, unknown or other
  misc_feature (548)..(548): n is a, c, g, or t
tcagacagtatatacacgaccggtgctcgatttagcgtcgatctcagggggggggtcgtcaggaggcagcactctcgggacgtctccaccatggcctgggctctactcctcctcagcctcctcactcaggcacagggtcctggggactgtctaccctgactcagccgccctcagtgtccgggactcctggtcagtcggtcaccatcttctgttcttccagcgacaattccactggaccctttaaagtctctatcatggtacgcagtggtcccggtcgacgcccccaaagtcctctttacgacgtcctttcgcggcttcggcagtccctgtccgttttcgcctccagttctgaccacgcggccctccctcgacctacgtccaccaaactcccggcctggacgatgaggctgacttacttttgtntgctattnttcgtattcactanaaatntgtcttacggagtcgggacctgtcgagcgttcctgcgttcacgccaagcccaaccnctcgtcacctctcgttcccaccctcctcattctactgtctgngtcgg

SEQ ID NO: 178719 - DNA, 488 bp, Homo sapiens
  misc_feature: GYAE6OF02F4SLL.44.10.A10.1.454.CMB.1.raw
  modified_base (480)..(480): a, c, t, g, unknown or other
  misc_feature (480)..(480): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaatggtatcagcagagaccagggaaacgccctagaactcctgatctctgctgcctcactctgcaaggtgatctcttacaagttcagtgcagtggatcgtgggacagtattcactctacacatctctagtctcgacaactgaagtatttgactaacttactactgtacaacagtattactactcgtcccttctacgtttcggcgggacacgtctggacatacgaactacgtgtgctcgctacncttctgtc

SEQ ID NO: 178720 - DNA, 533 bp, Homo sapiens
  misc_feature: GYAE6OF02GCHZ2.44.10.A10.1.454.CMB.1.raw
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtgagtctctcaaggttcagtggcagtgatcgtgggacagtatttcactctcaccntcctcagtctgctaacctgaatnttttagactaacttactactgtacaactagagttactactcgtcccgtttactaccgttttggtaccggggtaaccaggtcgtggacgtactaccgtaaacggtaaccgtggttacggcgtacgacctaaccgtacttcgtacgttacc

SEQ ID NO: 178721 - DNA, 555 bp, Homo sapiens
  misc_feature: GYAE6OF02HJC11.44.10.A10.1.454.CMB.1.raw
tcagacagtatatacacgaccggtgctcgatttagcgtcgatctctagggggtcagtctcagtcaggacacacgcatggacatgagggtccccgctcagctccgtggggctcctgctactctggctccgaggtgccagatgtgacatccagatggacccagtctccttcctccctgtctgcttctataggagacagagtcgccatcacttgccgggcaagtcagaccattaacagctaatttaaatggtaatcagcagagaccagggaaacgcccctgaacctcctgatctctgctgcctccacgtctgccaaggtggagtctcttacaaggttcagtggcaggtgatcgtagggacagtattcactctcacctatcctcagtctgacctaaccgtgaagtattttgacctaacttactaactgtaccaacgagtattactactcgtcccgtttcgtacgttttacgggaccggggtaccgtaagggtcggaaggtacgtacggacggaaccgtaacgtcggtacggcctacgccgacctacttcgtcgttcccg

SEQ ID NO: 178722 - DNA, 585 bp, Homo sapiens
  misc_feature: GYAE6OF02H8IGD.44.10.A10.1.454.CMB.1.raw
  modified_base (270)..(270): a, c, t, g, unknown or other
  misc_feature (270)..(270): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaaagtcagaccattaacagctaattttaaatggtatcagcagagaccaagggaaacncccctagaactcctgatctctgctgcctcactctgacaaggtgagtctcttacaaggttcagtggcagtgatcgtaggacagtattcactctacacatctcagtctgacctaacctagtaaagtatttacgactaaacttacttactagtaccaacgtaagtaagttactacctcgtaccccgtttacgttaaccgttttacgggaccggggtaacctaaggtaccgttagggtaacgtaacgttaaccgaaaacgtaaccgttaggtacggtacgtacggacccgtaacccgtagtttacccgttagtttaccc

SEQ ID NO: 178723 - DNA, 561 bp, Homo sapiens
  misc_feature: GYAE6OF02FVVHP.44.10.A10.1.454.CMB.1.raw
  modified_base (196)..(196): a, c, t, g, unknown or other
  misc_feature (196)..(196): n is a, c, g, or t
  modified_base (393)..(393): a, c, t, g, unknown or other
  misc_feature (393)..(393): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttgcctcgtaccagcagaaatctggccaggctcccaggcctcctcatctatggtgcatcccacagggccatggtactcccagccaggttcagtggcaggtggtctgggacaggagttcactctcaccatcagcacgcctgctagtctagaagtntttgcttagtttacttacgtgttacagtctagttaataagtgtaccgttcggcccttcccgttcggacccgtaagggaccaccggtacgtagggaacgtaacgttaaaccggacgttacggtacggtacctacggtaccgtaaccgtacgttccgtacgttccttacc

SEQ ID NO: 178724 - DNA, 458 bp, Homo sapiens
  misc_feature: GYAE6OF02FFZXR.44.10.A10.1.454.CMB.1.raw
  modified_base (211)..(211): a, c, t, g, unknown or other
  misc_feature (211)..(211): n is a, c, g, or t
  modified_base (347)..(347): a, c, t, g, unknown or other
  misc_feature (347)..(347): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (429)..(458): a, c, t, g, unknown or other
  misc_feature (429)..(458): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcagtgggtctgggacngacttcactctcaccatcagcagcctggacgcctgaagattttgtgattgtattactgtcattttccattggtcccttacctcgaacttttggccaggggaccaaactggaaatcaaacgaactgtggctgcaccntctgtcttcatcttcccgcatctgatatatactgttctgacgcgggctcgggcaagggtccgactagtaaggtncgntacgnnnnnnnnnnnnnnnnnnnnnnnnnnnnnn

SEQ ID NO: 178725 - DNA, 581 bp, Homo sapiens
  misc_feature: GYAE6OF02FHENA.44.10.A10.1.454.CMB.1.raw
  modified_base (197)..(197): a, c, t, g, unknown or other
  misc_feature (197)..(197): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgttaggactacttagcctggtatcaacagacaccgtggccaggcctcccaggcctcctcatctatgatgcatccaagtagggccgcgggcatccccagcccaggttcagtcggcnggtgggtctgagacagacttcactctccaccancacgcggccgtagacgccggaagtagtttgctagtttattactgtacaactaccgtacgtcgtacgtcggtaccgtaggttacgtaggttttcggaccggtacggggacctaacggcgtacgggtacgacgtacgaaacggtaacgtggtacggtcgtacggaccgacctacgttccgtacgttaccgtttcctaccgtttcccg

SEQ ID NO: 178726 - DNA, 633 bp, Homo sapiens
  misc_feature: GYAE6OF02F1MA9.44.10.A10.1.454.CMB.1.raw
  modified_base (356)..(356): a, c, t, g, unknown or other
  misc_feature (356)..(356): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagttgatgaacgcggtctccacgcccacctgtctgtcgtcctccggagggaagagccaccctctcctgcagggccagtcaggagtgtagcagcaacttagcctcggtaccagacaagaaactcgtcggaccgtacggcctcccgaggcctccctacattctagtaggtctctactccgaccagggccacgtcgtactcccaggtcccngttcgaggtggctaggtcggactacggacacgtacttcacctctaccaccgataccaccacgcctaagaccgtcgtaagaacgttacttacggacttagtttaacttacgttcgttacctacgtaaccgttaagtaacgttcggtaccctacgtacttacttaccgtacgtttccgggaccgtacgggtaacctaaaggtcgacttaacgaaccgtaaacgtacgttcggtacgtccgtacgacctaccgtacgttcttacgttacctacttacccg

SEQ ID NO: 178727 - DNA, 584 bp, Homo sapiens
  misc_feature: GYAE6OF02HQCXV.44.10.A10.1.454.CMB.1.raw
  modified_base (197)..(197): a, c, t, g, unknown or other
  misc_feature (197)..(197): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagngccaccctctcctgcgagggccagtcagagtgttagcagcaacttagcctcgtaccagcagaaatctggccaggctcccaggcctcctcatctatggtgcactccaccgacgggccacgtggtactcccagccgaggttcaggtcggactagggtcggggtcgtggggacaaggtnttccactctaccaccatccganccgacgtccgtgcctaggtctaggaattagttttgacttaaggttttattacgttgtcagtctaagtattaagtgtacgttcggccctttcccgttacgggaccaacgggtaccacggacgtaggaacgtaaacgttaaccgagttggtacgtacgtacggacctaccgtacttccgttcgttcttccg

SEQ ID NO: 178728 - DNA, 574 bp, Homo sapiens
  misc_feature: GYAE6OF02HBSND.44.10.A10.1.454.CMB.1.raw
  modified_base (266)..(266): a, c, t, g, unknown or other
  misc_feature (266)..(266): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaatggtatcagcagagaccaagggaacncccctgaacctcctgatctatgctcgcctccactctgcgaaggtggatctcttacgaaggttcaggtgactaggtggatcgtggacaggtatttcactctcacctactctcagttctgaccaacctagaagtatttagacttaacttactactacgtaccaactagtatttactacgtccgttacccgtttaccttacggtttttacggggaccgggggtaaccacgggtcgttaggtaacggtataaccgaaacggtaacctagggtacggaccgtacgacctacccgtacgttacctgtttacccg

SEQ ID NO: 178729 - DNA, 674 bp, Homo sapiens
  misc_feature: GYAE6OF02JHJU0.44.10.A10.1.454.CMB.1.raw
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (429)..(429): a, c, t, g, unknown or other
  misc_feature (429)..(429): n is a, c, g, or t
tcagacagtatatacacgaccggtgctcgatttagcgtcgatctcagggggtcagtctcagtcaggacacagcatggacatgagggtccccgctcagctcctggggctcctgctgctctggctcccaggttcgagatgtgacatcgagatgacccagtcctccttccttcctgttcttcttctgttggaggcagcgtcaccatcacttgccgggcagtcaggttcgttttcggngcttgttgccttggtttacaaacgaaaagggggcacggacccctaaggtcctcgtctctcgtagaaaccngacgtaggaagtagacggtcccgtacaggttcaggtcgaccgagttcccgagggtcgggtcgggccggacgtccactctacgactagttcgaccgtacctggccggtacctagaacgtctttcgngtactaacttttacgtttctggtacaggtctaagttactacaagttacgtccgtacccctttgttaaccgttttcgggaccgtaacggggaaccctaaggtccgttaacgggtaaacttccgaaaaaccggtacgttacgggtacggtaccttaggaccctaaccgttaacgttccgttcggttaaccctttccgtaaccgttttccccttacccggaccctttaacttccgttagtactttaac

SEQ ID NO: 178730 - DNA, 759 bp, Homo sapiens
  misc_feature: GYAE6OF02HWL8D.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctccctgcagggccagtcagagtgttagcagcaacttagcctcgtaccagcagaaatctggccaggcctcccaggcctcctcatctatggtgcatccaccgacgggcccacgtcggtactcccagcccgtagggttcaggtgggacctagggtcgggggtacccgggaactacgggtaacgtttccaaccgttcctacccgaaccctaagttcccgacggtcccgggtccccgtacggtcccgtaacggttccgttaggtaagggtttacgtttttcgggaccgtttaacggttttttaactttaaccgtttcggtttaaccgtacggttacgtaaacggttttaaagttaaacgtttaaaccggttcgggtacccctttacgttccggttaacccggtttttccggggggaacccgggggggtaaacccgtaaagggggttacgggtaacggtacgttaaccggtaaaaccggtaaccgttagggtacggtccgttacggaaccgtaccgtacgttccgttacggtttccctttaccgtacgtttacccccg

SEQ ID NO: 178731 - DNA, 637 bp, Homo sapiens
  misc_feature: GYAE6OF02HFN16.44.10.A10.1.454.CMB.1.raw
  modified_base (195)..(195): a, c, t, g, unknown or other
  misc_feature (195)..(195): n is a, c, g, or t
tcagacagtatatacacgaccggtgctcgatttagcgtcgatctcaggggagagctgctcagttaggacccagagggaaccatggaagccccagcgcagcttctcttcctcctgctactctggctcccagacaccactggagaaatagtgatgacgcagtctccagccaccctgtctctgtctccgaggggaaangcccaccctctcctgcagggccagtcagagtgttggcagcagcgtagcctggttccagcagaactggccagactccaggctcctcatctataccacactccaccgagggccactggtactcccagccagacttcagttgctacgtgggtcgtgggactaggcgttcactctccaccactacacgtcgacgcccgtgcgtacgttcgtacggtaaagttacgtttttacggacgtttaacgttttaatttaaccgttacgttacccgtaaaccgtaacccggttaacgtaccggtacgttaccgggtacccgttaacgggtttaaccttaacggtttttacgggacccggtaacgggggacccgtaaggtccggtagggtaccggtacgtaaccgaaacggtacgttacggtacggccgttacggtaccgtacctagttaccg

SEQ ID NO: 178732 - DNA, 579 bp, Homo sapiens
  misc_feature: GYAE6OF02JHQZN.44.10.A10.1.454.CMB.1.raw
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttggccggcaagtcagaccattaacagcttaatttaaattggtatcagcagagaccagggaacgcccctgaacctcctgactctctgctcgcctccactctgacaaggtggagtctcttacgtaaggttcaggtggactaggtggtagtcgtagggaacaggtacttttcacttcctacaccctattcctaccacgttcttgacctaactagtaagttacttttcgacttaacttactactgtacaaacagtagttactacgtccgtaccccgtttacttaccgtttgggtaccgggtactaacggtcgtacggacgtaactaccgaaacgtaacgttacggtcggtactacgtacaccgtattccgttagttcc

SEQ ID NO: 178733 - DNA, 543 bp, Homo sapiens
  misc_feature: GYAE6OF02JGAPR.44.10.A10.1.454.CMB.1.raw
  modified_base (212)..(212): a, c, t, g, unknown or other
  misc_feature (212)..(212): n is a, c, g, or t
  modified_base (505)..(505): a, c, t, g, unknown or other
  misc_feature (505)..(505): n is a, c, g, or t
  modified_base (515)..(520): a, c, t, g, unknown or other
  misc_feature (515)..(520): n is a, c, g, or t
  modified_base (522)..(543): a, c, t, g, unknown or other
  misc_feature (522)..(543): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagccctcccaggctcctcatccacggtgcatccaacagggccactggcgtccctgacaggttcagtggcagtgggtctgggacngacttcactctcacatcacagcctagacgcctagaagtattttgctagtttattactgtctacgaaccgtaagtaagtcgacctaccgaattacttccacgtttccggacctagggtaacctaaagtcggtaataacgttaccaaaacgtaacgttggtacggctacggcctaacctatttcgtcgttaccttcgaactttcccgtaccccgacctacttcctagtaactttaacttactaccgtttgtacgttggaacgggtccggtcttcgggaacgaacggtcgtaaccngttaacgctnnnnnngnnnnnnnnnnnnnnnnnnnnnn

SEQ ID NO: 178734 - DNA, 580 bp, Homo sapiens
  misc_feature: GYAE6OF02I79ZV.44.10.A10.1.454.CMB.1.raw
  modified_base (194)..(194): a, c, t, g, unknown or other
  misc_feature (194)..(194): n is a, c, g, or t
  modified_base (355)..(355): a, c, t, g, unknown or other
  misc_feature (355)..(355): n is a, c, g, or t
tcagacagtatatacacgaccggtgctcgatttagcgtcgatctcagggggaggaactgctcagttaggacccagagggaaccatggaagccccagctcagcttctcttcctcctgctactctggctcccagagatcaccggagatattgtgttgacacagtctccaggcaccctgtctgtgtctcaggggaanagccaccctctcctgcagggccagtcagagtcgttaccagcaacttagcctaggtaccaccagaaacctgggccaggcctccaggctcctcatctatggaacatccacagggccacgtggtactccccaccgaggttccaggtcggcaggtcggtccgganagtacgttcactctcacatcagccggcctgctagtctgagtattttgcttagtttattacgtgtactaggctagtaatagtcgtactcggtccctccgttccggaccgaacgggacctaccggacgttagggaacgtaaagttaaaccgagttacggtcggtaccgtagaaccctactacgttcttacgttcttactaccgttcccgttccccgtactattaccg

SEQ ID NO: 178735 - DNA, 543 bp, Homo sapiens
  misc_feature: GYAE6OF02F56MH.44.10.A10.1.454.CMB.1.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttaccagccaacttagcctggtaccaccagaaacctgggcaggctcccaggcctctcactctatggaacatccaaccgaggggcccacgttgggtatccccaaccaggtttccaggtcggcaggtcgggtccggganagcgttcactctcaccatcagcggcctgcagtctgaggtatttgctagtttattactgtcagcagttataataactcgcctctctacgtttcgggcgggggtaccagggtgagactagaacgtactgtaggcgtgaccacctattcgtgttccttctacttcctcccggctacttccg

SEQ ID NO: 178736 - DNA, 331 bp, Homo sapiens
  misc_feature: GYAE6OF02IAFNU.44.10.A10.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
  modified_base (323)..(331): a, c, t, g, unknown or other
  misc_feature (323)..(331): n is a, c, g, or t
tcagacagtatatacacgaccggtgctcgatttagcgtcgatctcaggggggggttcgtcaggaggcagcactctcgggacggtctccaccatggcctgggctctactccctcctcagccgtcctcacgtcagggcacagggtccgtggggactgtctgccctgactcagcctgcctccgtgtctgggtcncctggcaggtcggtcaccatctcctcgcactggacnccacgccggtcacgcccaaggcccaaacccnctggtcacgtctgttccccgacctcctctatatactgtctgacgcgggctggcaaggcgcatagnnnnnnnnn

SEQ ID NO: 178737 - DNA, 595 bp, Homo sapiens
  misc_feature: GYAE6OF02HK10B.44.10.A10.1.454.CMB.1.raw
  modified_base (200)..(200): a, c, t, g, unknown or other
  misc_feature (200)..(200): n is a, c, g, or t
  modified_base (417)..(417): a, c, t, g, unknown or other
  misc_feature (417)..(417): n is a, c, g, or t
  modified_base (452)..(452): a, c, t, g, unknown or other
  misc_feature (452)..(452): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagcccaccctgtctgtgtcctccgaaggggaaancgccctaccctctcctgcagggccagtcagtagtgttagcagctaacttgcctcgaccagacaagaaatcgtggccaggcctcccgaggcctcctctaactctaagtggtcgcactccaccgacgggccctacgtggtaacctccgacgccgtaggttcagtggactggtgggtctgggacaggcttcactctcacatcagtcacgctcgctacgtntacggtaatgttttgacgtttaagtttactacgtnttacagtactaagttataactcgtacgtcgttcccgttcccgttacggaccgtaacggaccgtacgtacgtagggtaacaaacgtttaaacggacgttacgtacggtcttacgacccgtaacttgtaccgtacgtttctaccg

SEQ ID NO: 178738 - DNA, 561 bp, Homo sapiens
  misc_feature: GYAE6OF02IWD1B.44.10.A10.1.454.CMB.1.raw
  modified_base (196)..(196): a, c, t, g, unknown or other
  misc_feature (196)..(196): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcgagggccagtcagagtgtagcagcaacttgcctgtaccagcagaaatctggccaggctccaggctcctcatctagtcggtgcactccaaccgagggccacgtggtactcccgagcctaggttacaggtgcgaggtggtctagggacaggtattcactctcaccatacagcacgcctgcagtctagaattactttgacttaagttttattactgtacagctaagtataatgtactcggacccttccgtcgggtaccgaaacgggtacaaccgtacgtaggtacggtaaacttaaacggaacttacggtaggaccttaggaccctaccctattccgtttgtaccctttaacg

SEQ ID NO: 178739 - DNA, 802 bp, Homo sapiens
  misc_feature: GYAE6OF02IS8ND.44.10.A10.1.454.CMB.1.raw
  modified_base (214)..(214): a, c, t, g, unknown or other
  misc_feature (214)..(214): n is a, c, g, or t
tcagacagtatatacacgaccggtgctcgatttagcgtcgatctcagggggtcgagtctcagtcaggacaccagcgatggacatcgagggtccccgctcagctcctggggcctcctgctactctggcctccgaggtcgccagatgtgacatccagatcgacccagtcctccttcctccctgtcgtagcttctactaggagtacaggacggtccnccatccaacttggccgggactaaagttcaacgacccgtaattaaacagtaccttaattttaaagttcgggtaatccgtacgacgagtacgaccgaagggaaacgtccccctagaaccttccgtagacttcctcgtagccgtcggccctccgactccgtacgaccgtaagggtcggtagttcctacgttcgtaaggttcgaggtcggacgtaaggtcggtactcgtacgggtaactacggtacctttccaaccgttcctaccgtaaaccctacgtcccgttaccgtacggttaccgtacgtaaccgttaaacccgtttaggtaaacgtttacgttttacgtaacccttaaaacctttaccgttaaaccgttcgtaacctaaaccgtaaggtttaaccgttaacgttaacccggtacccgttacccccgggtttaactttaaccggggtttttacggggaacccggggtaaacctaacggtacggttaacgggtaacggtaaccgttaaacccgaaaacggttccggttaacggttaccgggttactacccggtaaccgtacccgttaacgttcccgttaccgttacccg

SEQ ID NO: 178740 - DNA, 1003 bp, Homo sapiens
  misc_feature: GYAE6OF02JXL66.44.10.A10.1.454.CMB.1.raw
  modified_base (224)..(224): a, c, t, g, unknown or other
  misc_feature (224)..(224): n is a, c, g, or t
tcagacagtatatacacgaccggtgctcgatttagcgtcgatctcagggggtcagtctcagtcaggacacagcatggacatgagggtccccgctcagctcctgggctcctgctactctggctccgaggtcgccagatgtgacatccagatcgacccagtctccttcctcctgtctgtcttctataggagacagtacgtcgacctatctacgttcggaccgggtntaaacgtccgacgaaccctaatttaaccgagtacctttaaagttttaaacgtttagggttaacttacgaacggtacgtaaggaacggtaacccgaaggggaaaacgtaccccccggtaagaaacccgttcccgtaggtaacgtccttacgtccgtacgtccgtacccttaccctaaccttccgtacgggtaccgtaaacggggttacgggtaaccggttacccttttaccgttaaccggttaaacggggtttccgtaacgggtttaccgggggtaccgttaaaagggggtttccgggtaacgtttaaccggggtacggggggtaaacccttaagggggttttaaacccttttaccgttaacccgtttaccgtttaacccgtaaaccccggttaacttcccccgttttaacccggtaacggttttacccgtaaccggtttaaacccgttaaaccccgttaagggtttaaaaaccgtttcgttttttaaccggaaacccgtttaaacctttaaccgtttaccttaaaccggttaacccttaaaacggtaacggtttaaacgttttaaccgttaaccgttaccccggttttaacccccgttttaaccggtttaaaccgggtttttacccgggtaaaccccggggggttaacctaacggggttaccgttaacgggttaacggtaacccggtttaaacctaaaaccgggttaaccgtttacgggttaccggtaccggttaacccggtcgttaaacccgtacgttaccggtttaccgttacccgg

SEQ ID NO: 178741 - DNA, 683 bp, Homo sapiens
  misc_feature: GYAE6OF02FHAH4.44.10.A10.1.454.CMB.1.raw
  modified_base (213)..(213): a, c, t, g, unknown or other
  misc_feature (213)..(213): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccgggnaagtcagaccattaacagctatttaaatggtatcagcagagaccgaagggaaacgcccctagaacctcctagactctctcgctcgcctccactctagcgaaggtggagtctctacgtaaggttcaggtcggactaggtggattcgtggggaacctaggtacttttccgacttccgtaccaacctacgttcctcccgtacgttccgtacgtacccgtaaaccgtagtaaagtttacttttacggaaccttaaacctttaccgttaacgttacgttaaccgaaacgttaaggttaacgttttaacgtacccgttaccggttacccccgttttaacgtaaccggttttttacggggtaacccggggtaaccttaacggtaccgttagggaacggttaacgtaaccgtaaaaccggtaaccgttacggtacggtacgttacggaccctaacctacgttaccgttgtttaacccg

SEQ ID NO: 178742 - DNA, 698 bp, Homo sapiens
  misc_feature: GYAE6OF02HH9K0.44.10.A10.1.454.CMB.1.raw
tcagacagtatatacacgaccggtgctcgatttagcgtcgatctcaggggggggggtctcaggaggcagcactctcgggacgtctccaccatggcctgggctctactcctcctcagcctcctcactcagggcacagggtcctggggactgtctaccctgactcagccgcctcagtgtccgggactcctggtaagtcggtcaccatcttctgttctccagcgacaattccactggtacctttaaagtctctatcatggtacgcagtcggtccgggccgacgccccaaagtcctctttacgacttccttcgcggtcttcggcacgtccgtcggtccgttttcggcctccagttctcgaccacgccggcctccctcgacctactccaacctaaaccgtccggacctggacggtactggacggtcgtacgtaccgtttcttttacggttgtcggtctaatttacgttttcgtatttctaccgttactaaacttagttcgttacgtttacgggtaaacgggttccgggacccggtacggtcctaacggtccggttaccgttcggtccgtaccgaccggaaccccgtaacgggaccccctaaaccccgacgttacgtacctacgttccgttccggtttacccccaacccttccttacccttacgtaaccttcgttacgttccgtacggtaccggtccggtacgg

SEQ ID NO: 178743 - DNA, 721 bp, Homo sapiens
  misc_feature: GYAE6OF02JAO3U.44.10.A10.1.454.CMB.1.raw
  modified_base (230)..(230): a, c, t, g, unknown or other
  misc_feature (230)..(230): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtcctccgaaggggaaagagcccaccctctccgtgcagggccagtcagngtgttagcagctaacttagcctcgtaccagcaagaaatctggaccaggctcccgaggtcctcctcattcctagtggtgccatcccacgtaggcccacgtggtactcccagcctaggttcaggtggccgaggtcggggtactagggaactaggtacgtttacaccttccgtacgaacccagttccgaacgtccgaaccggtcccgttacggcgtaacggttctaaagggttaaggttcgtttttacggaaccgtttaaggttttttaacgtttaccgttaggttaccgttaacggtaagttaacgtttaagttaaacgttcgggttaaccgttccgggttacccctttacccccggtttaccgggaaacccgttaaacggggaccgtaacccggtaacgtgggtaaacggttaaacgttaaaccggtaggttacggtaccgggttctacggtacctaaacccgttaggttcccgttacgttacctttacccg

SEQ ID NO: 178744 - DNA, 860 bp, Homo sapiens
  misc_feature: GYAE6OF02ISDAW.44.10.A10.1.454.CMB.1.raw
  modified_base (197)..(197): a, c, t, g, unknown or other
  misc_feature (197)..(197): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcaggagtcgttaccagacctaacttacgcctacggtaaccaaccgaacggaaaacccgtggggaccacgggtccctaccccgagggcccttccctctactccttaagtacgggaaacctacgtacccgaaccgacggggcccaacgttcggtacctcccccgaacccgtacggtttccgaacggttcgggaccgtaggggttccggggtacccggggtaacgaacgggtacgtttacctaccgttacctaccaacccgtaacttaccgaaccgggtcccgggtcccttcggaccgtaacggttccgttacgggtaaagggtttacgttttttacgggaaccgttttaacggttttaacgtttaaccgtttcggttaccgtaacggtacgttaaagttaaacgttaaacgttaaccggttccggtacccgtttacgttacccggtttacgggttttacccggggggaaccgggggggttaaccggtaacgggggttacgggtaaacggtaacgtaaaccggtaaaccgggttaacggttcgggttaccgggtaccgtcggaccctaaccgtaccgttaccgtttaccggttccttaccgttaccgtttccccttaccccgggtacccttagttacccg

SEQ ID NO: 178745 - DNA, 781 bp, Homo sapiens
  misc_feature: GYAE6OF02H2Q1E.44.10.A10.1.454.CMB.1.raw
  modified_base (200)..(200): a, c, t, g, unknown or other
  misc_feature (200)..(200): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccaactggagaaatagtgatgacgcggtctccagccaccctgtctgtcgtctccgaaggggaaanagcccaaccccgtctccgtgacgacgggccagtccaggtagtgttagcagacaacttagcctacgtacagcagaaatctggccaggctcccaggctcctacatctatggtcgacatacccaaccgtacgggcctaacgttcggtaactcccgaacgtacccgtagggtttccaaggtcgggactaagggttcggggtacgttcggggaaccgtaaggtacgtttacccgaaacccgtttcccgtaacaaccccgtaaacttaccgaacggaccctaacggccccgtagaccgtaaacgttccgtaaggaaacgtttagttttacggtaacttaacgtttttaaagttaccttaagttccggaaagtaccgttaaagtttaacgtaaacttacgggtaaacccgtttcgggtaccccgtttaccccgtttacggggaacccgtaaacggggtaacccgttaaccgggtacgttaacggggaaacgttaaaccgtttaaaaaccgggtaacgttaacgggaccggttaccgttaccggaacccgtaccggttaacttccggtttacgttaccctttaacccgg

SEQ ID NO: 178746 - DNA, 622 bp, Homo sapiens
  misc_feature: GYAE6OF02FVRZK.44.10.A10.1.454.CMB.1.raw
  modified_base (262)..(262): a, c, t, g, unknown or other
  misc_feature (262)..(262): n is a, c, g, or t
  modified_base (423)..(423): a, c, t, g, unknown or other
  misc_feature (423)..(423): n is a, c, g, or t
tcagacagtatatacacgaccggtgctcgatttagcgtcgatctcaggggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacncagtcggtccggccgagcccccaaagtcctctttacgacgtccttcgcggtcttcggcaggtccctggccgttttcggcctcctagttctgacctacggcgcctccctgaccatcaccaaactcgcctgagatgagctgacttacgttttgtgtgctattntttcgtattctactcaaattagttcgtacgttcggtaagtcgggtacccgtcgtcagccgttcctaggtcgtcgacgtccccaaagggtccccaaacccgccgttcgtacctaaccgttcccttaccggtttcccccgtccccgttaccttccttaacgttaccttaccgttcgtccgtttacgggaccgtacccgggg

SEQ ID NO: 178747 - DNA, 424 bp, Homo sapiens
  misc_feature: GYAE6OF02ITY4M.44.10.A10.1.454.CMB.1.raw
  modified_base (259)..(259): a, c, t, g, unknown or other
  misc_feature (259)..(259): n is a, c, g, or t
  modified_base (413)..(424): a, c, t, g, unknown or other
  misc_feature (413)..(424): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggcgtccctgacaggttcagtggcaggtgggtctgggacagacttcactctcaccatcagcagcctggacgcctgaagtattttggngtatgtattactgtcatttccatcggtcccttactcttaactttggcctaggggaccaacgtaggaaactacaaacgtatgtgctgcacatctgtcttcatcctccgcctatctgatatatactgtctgagcggctggcgaacggcgacatagnnnnnnnnnnnn

SEQ ID NO: 178748 - DNA, 631 bp, Homo sapiens
  misc_feature: GYAE6OF02IOB3A.44.10.A10.1.454.CMB.1.raw
  modified_base (268)..(268): a, c, t, g, unknown or other
  misc_feature (268)..(268): n is a, c, g, or t
tcagacagtatatacacgaccggtgctcgatttagcgtcgatctcaggggggggggtctcaggaggcagcactctcgggacgtctccaccatggcctgggctctactcctcctcagccctcctcactcagggcacagggtcctggggactgtctaccctgactcagccgccctcagtgtccgggactcctggtcagtcggtcaccatcttctgttccttccagcgactaattccactggtaccctttaaagtcctctatcatggtacncagtggtcccggccgacgacccccaaagtcctctttacgacgttccttcgcggtcttcggctacgtcccgtggtccgttttcggcctcacgttctcgaccacgccgcctcctgaccactcaaccaactccgctgagatgaggctgtacttcgttttgtgtgtctattactttcgattcgactactaaattgttcgtccgttacggaggttccgggacccgtcggtcgacggtccgttccgtggtccgtacaccggaccccgaaacggacccctaaccccgtctccggtacctaccgttcccgttacccgttcccctacccttcccgtacttacttacttacctcgtacgttcggaggtccggg

SEQ ID NO: 178749 - DNA, 660 bp, Homo sapiens
  misc_feature: GYAE6OF02H35YI.44.10.A10.1.454.CMB.1.raw
tcagacagtatatacacgaccggtgctcgatttagcgtcgatctcagggggtcagtctcagtcaggacacagcatggacatgagggtccccgctcagctcctgggactcctgctgctctggctcccagatactagatgtgacttccagatgacccagtctccatcctccctgtctgcatctgtgggagacagagtcaccatcacttgccgggcgagtcaggccattagcaattatttagcctaggtatcagacagaaaaccagggaaaccctaccctaacctccctagacttctttgctgcactccctactttgactaatcgacggggtccctagttcctcggttcagccggtacaggtcggatcgtaggactagtatttcgtccttactaccaccctactaccgagaccctaagccgttcggaccacggtacccgtaaggtaaacgtagtttacgttacgtaaccttaaaccttttaacttaacgtttaggttaaaccgtaaaacgttaacctaaaccgtacgttacccgtaccccctacgttaaccgtaccgttttacccggacccgttacggggaaacccgtaaaggtaccggtaaactaaccgttaaccgaaaaccgtacgttacggttacggtacgtaccgccctaacgttaccg

SEQ ID NO: 178750 - DNA, 642 bp, Homo sapiens
  misc_feature: GYAE6OF02F5633.44.10.A10.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatccacttggccggnaagtcagaccattaacagtctatttaaatggtatcagcagacgaccagggaaacncccctagaacctcctagactctctgctcgcctcactctgacgtaggtcgacttctacttacgtaaggttcaggttcggacgtaggtaggtactacggtaggggtaactaggttacgttttccacttaccgtacaacctacttccgtaccgacgttccgtacgacctaaaccgttaggtaaagttacttttcgaaccttaacgttactaacgtacgtacaaacgtagttaacgttactaccgtccgtaccccgtttacgttacggttttacggggaccgggaacctagggtcgtacgggacgtaacgtaaccggtaaaccggttagttagggtcgaccgttacgacccgtaacctaggtttcccgtacgttccg

SEQ ID NO: 178751 - DNA, 683 bp, Homo sapiens
  misc_feature: GYAE6OF02G7KOK.44.10.A10.1.454.CMB.1.raw
tcagacagtatatacacgaccggtgctcgatttagcgtcgatctcgagggggtcagtctcagtcaggacacagcatacggacatgagggtccccgctcagctcctggggctcctgctactctggctccgaggtgccagatgtgacatccagactcgacccagtcctccttcctcctgtctcgcttcgtagtacggagacagagtccaccgatccacgttggaccgggcaagtccagacgctaattacgggaactttctttaaagttcggttaactcgaagtactaaggacggtaccgaaggggaaaccgcccctacaaccgtcctagactactatcgtactcggtcgtccgtattttcggacgtaaacgggtcgggtaaccctagttaccgtaggttacgtaggtcggtacgtaggtcggtaactcggtacgggactagttactttaccacgttctaccgtacctactacctacgtactaacggtctacgtaccgtaactagtaacgtacgttacgacgtagttactttattacttacgtactaacgtaggtagtacgaactaacgtaccgtccgttacgtacgttaccgttacgggaccgggtaccgtacttacggtacggttcggtaacggtactaacggtaacgtaacggttcggtacggtctacggtacctacgtacgg

SEQ ID NO: 178752 - DNA, 557 bp, Homo sapiens
  misc_feature: GYAE6OF02JHBTQ.44.10.A10.1.454.CMB.1.raw
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctcctgtctgcttctataggagacagagtcgccatcacttgccggcaagtcagaccattaacngcttattaaatgtatcagcagagaccaggaacgccctagactccngactctctgctcgcctccactctgactaaggtgtactctcttacgaagttcaggtcggctaggtggtatcgtagggacagtactttcacttcacacctatcctcgagtctgacctaactgaattgtttcacttaacttacacttagaccaagtagttacgttactaccgttccgtacccgtttattacgggtttcgggtaacggggaccaaggttcgtaggacgtaacgtaaccgtaaacggtacttggtacgtcgtacgtacctaaccgtagttcttagttcc

SEQ ID NO: 178753 - DNA, 569 bp, Homo sapiens
  misc_feature: GYAE6OF02JMQS1.44.10.A10.1.454.CMB.1.raw
  modified_base (266)..(266): a, c, t, g, unknown or other
  misc_feature (266)..(266): n is a, c, g, or t
  modified_base (418)..(418): a, c, t, g, unknown or other
  misc_feature (418)..(418): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(553): a, c, t, g, unknown or other
  misc_feature (549)..(553): n is a, c, g, or t
  modified_base (555)..(560): a, c, t, g, unknown or other
  misc_feature (555)..(560): n is a, c, g, or t
  modified_base (562)..(569): a, c, t, g, unknown or other
  misc_feature (562)..(569): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggcctcctcatcccaggtgcatcccaacgacgggcccacttggtatccccagccaggttcagtggcagtgggtctgggacaggagttccacgtctacaccatcgacgcagcccttgccagtctgaagtnttttcgcttatttattctgttccagtctagtataacttaagtcggaccttctccgtacgtttccgggcgggggaaccgtagggtcggagtactaccgacggtacgaacgttcggtggacgtcgaccgacgtaacgtcgttacgttcctttanaccttttaccgtcccgtaaccgtctcgttacgagtttaacttaagtccttaggttccctaggtaaccggtcgggtacttcggggtaacgaacgggtccgacgtaagtgaccngtacgncgtngtcangntnnnnngnnnnnngnnnnnnnn

SEQ ID NO: 178754 - DNA, 587 bp, Homo sapiens
  misc_feature: GYAE6OF02JXNX2.44.10.A10.1.454.CMB.1.raw
  modified_base (187)..(187): a, c, t, g, unknown or other
  misc_feature (187)..(187): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
  modified_base (575)..(576): a, c, t, g, unknown or other
  misc_feature (575)..(576): n is a, c, g, or t
  modified_base (580)..(580): a, c, t, g, unknown or other
  misc_feature (580)..(580): n is a, c, g, or t
  modified_base (583)..(587): a, c, t, g, unknown or other
  misc_feature (583)..(587): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggcctcctcatccacggtgccatccaacacggccactggcgtccctgacnggttcacgtggcagtggttctgggacacgatttcacctctcaccactcagcagccttgcagcctaggagtactttcggctacttacttacgtacgaccaaactattactttacgtttttactccgttactagttttcggacgttacggggacctaaaggtcaggtaagtctaacggtaaaggaacttcgtacggcttagccctaaacgcttcgtagttcctttcgaacgtttccccttccccgcccgtagtttcctagttaataccttaaagtttccccgttagttccgtacggttaccgggtccgggtagttcgggtacccgtaggggaccctagtaacgtacgngtntacgntantatngnacgcgctanatgatnagnacagtcnngacnacnnnnn

SEQ ID NO: 178755 - DNA, 698 bp, Homo sapiens
  misc_feature: GYAE6OF02GC3J3.44.10.A10.1.454.CMB.1.raw
  modified_base (197)..(197): a, c, t, g, unknown or other
  misc_feature (197)..(197): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagcccaccctgtctgtgtctccaggggaaangcccaccctctcctgcagggccagtcagagtgtagcagcaacttgcctcgacagcaagaatcgtaggccaggcctcccgaggtcctccctcacttctaagtggtcgacctactcccgaaccggacgggccctaacggtacggttacctccccgagtcccgtaaggtttccgaaggttcgggaccgtagggttcggggtacggtaggggaactagggtacgtttcaccgtcctaccgaccctatccgaagccacgtccgtagtacctacggttacgtaaggtaacgtttacgttttaggaccttttaaggtttactttaccgttgtaacctaggtaaacctaaggttaattaaaccgttcgtaaccgtttccggtaccccgtttacccgtaccggaccggtaaacgggacctacgggtacgtaagtaacggtaaactttaaaccggaacggttggtaacggaccgtcgacctaaccgtacgtttaccgttactctttacccg

SEQ ID NO: 178756 - DNA, 785 bp, Homo sapiens
  misc_feature: GYAE6OF02JOTBI.44.10.A10.1.454.CMB.1.raw
  modified_base (146)..(146): a, c, t, g, unknown or other
  misc_feature (146)..(146): n is a, c, g, or t
  modified_base (199)..(199): a, c, t, g, unknown or other
  misc_feature (199)..(199): n is a, c, g, or t
  modified_base (735)..(735): a, c, t, g, unknown or other
  misc_feature (735)..(735): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagactaccactggaanaaatgtgatgacgcggtctccagccaccctgtctgtcgtctacgaaggggaancgcccaccgttctcctgacgagggccaagtccaggtagtacggttacgcaggtacctaaacgtttcggcccttccggaaccaggaccaaaggtaaactccgtaggaccccgaaggtaacctccccgagggtccttccttacgatttacctggttacggtcgacttaccacccgtaccgacggggtacctaccgttcgggtaacccttccccaacggtaccccgttggggtttacacgggttccgggactttaacggggtcggggttcgtacgggggaaccttaacggttaacccgttaccgttaacccgttcggttaacccaccttagtacccggacggtacccggtactaacgggaccggtaccgggtaaactttgttttacggaccgtttaagtttacgttaacctttcggaaccctaagttaaccccggttaccgacgttacggttccgtacggttaaccgttaggttacgtttcggaaccggtacgggtaaccgtagtaccggtacgacgtccgaagtaaccggtagtacgngggtcctacggtcccaacttggaccttcgttacctaccgttacttccccg

SEQ ID NO: 178757 - DNA, 668 bp, Homo sapiens
  misc_feature: GYAE6OF02JLIUU.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccacctgtctgtgtctcgaggggaaagcgcccaccctctcctgcgagggccagtcagagtgttacgcagcctaacttcgccctacgtaccgagccgtaagaaacttcgtcggaccgaggtccctacccgacggtcctcccgtacactccgttagtcggttcgacctactcccgaccgaacggggtccctacgtcggtaacctcccgaggtccgtaggtccaaggtcggaccgtagggtcgggtacgacgggtacctaggtcgttcgacctaccgtcaacctacgtcgacgaccgcgtcctacggctaggtactagtaagttagtttcgtagtttaacgttttacttagttcgttacgtacgtacttataagttaactcgtacgtccggttccttacccgttcggaccggtaacggaccgtacggtacgtaggtacgtaaacgttaaccggtacgtcggtcgtaacgtcgtacccgtagtacgtacgttaccggtcttccg

SEQ ID NO: 178758 - DNA, 761 bp, Homo sapiens
  misc_feature: GYAE6OF02JRBPO.44.10.A10.1.454.CMB.1.raw
  modified_base (678)..(678): a, c, t, g, unknown or other
  misc_feature (678)..(678): n is a, c, g, or t
  modified_base (687)..(687): a, c, t, g, unknown or other
  misc_feature (687)..(687): n is a, c, g, or t
  modified_base (700)..(701): a, c, t, g, unknown or other
  misc_feature (700)..(701): n is a, c, g, or t
  modified_base (703)..(703): a, c, t, g, unknown or other
  misc_feature (703)..(703): n is a, c, g, or t
  modified_base (707)..(707): a, c, t, g, unknown or other
  misc_feature (707)..(707): n is a, c, g, or t
  modified_base (718)..(718): a, c, t, g, unknown or other
  misc_feature (718)..(718): n is a, c, g, or t
  modified_base (722)..(722): a, c, t, g, unknown or other
  misc_feature (722)..(722): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
  modified_base (747)..(747): a, c, t, g, unknown or other
  misc_feature (747)..(747): n is a, c, g, or t
  modified_base (760)..(760): a, c, t, g, unknown or other
  misc_feature (760)..(760): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggcctcctcatccacggtgcatccaacgagggccacgtggccgtaccctgacgtagggttcaggtcggcaggtcgggtctggggacagaccgttcactccgtaccacctaatcgacgtccgaacgtccgtgggacgtaccgtaggtaacggttattttggagtagttacggttactttacgttcgttaccttacgttttaccgtacgttccgggtttaccccctttacccggttaccggttaaaccggtttttcggggaacccgggtaaaaccgggggtaaccctaaaaccgggttaacggaaaacgttaacccgaaaaccggttaaacgttcgggtacggtacgtaccgaccgtaacccttagttaccggttcgtttactttacggtcccgtttaccccttaacccgttacctaacctttccgtaaacttacgttaacgtttaacccgttaacttcgggttacccggttacgggacgggggttaccgggtcccggtagggtaaccgggtaaacccggggtccgaaccgttaaggttccgngtcgacgtntacgtcagctacnngntcgngcgtacgtcgngcgngtcgtacgtntntcgtgtgtacganagtagagtctagng

SEQ ID NO: 178759 - DNA, 832 bp, Homo sapiens
  misc_feature: GYAE6OF02H0O11.44.10.A10.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (312)..(312): a, c, t, g, unknown or other
  misc_feature (312)..(312): n is a, c, g, or t
tcagacagtatatacacgaccggtgctcgatttagcgtcgatctcagggggtcagtctcagtcaggacacagcatggacatgacgggtccccgctcagcctccgtggggcctcctgctactctggctccggaggtcgccaagatgtgacatccagatcgaccctagtcctccttccctccctgtctgtcttctagtagganacngtacgtcgccatctaccgttcgggccggacaacgtccgaagtaccctaattaacgagtactttaattttaaagtttggtataccagcaagacgaaccgaagggaaccncccctagaacctcgtacgtacttcctctaggtcctcgtcccctccgtaccgtttccacggtaacggtacgggtcggtaccggtttacccttccgttaacgttaacgggtttcgaaggggttcgaccggtaggtcggtaacgtccggtaagggtaaccgttagtttaccttaccgtacccgtttacctacctaccctaacgttcccgtaccgtacgttccgtacgtaaccgtaaccggttaacgttaacgtttacgtttaccgtaaccgtttaaccttaccttaacgttacgtaacctaaacgtaccgttaacgtttaccgttacccggttaccccgtttacccgttttaccggtttaaccggggtttccgggggtaacccgggttaaccgggtaacgttcgggttaacggttaaccggaaccgtttaaaccggtaaccgggttaaaccggttcccgggttaaggtacccgttaacccgggtactaaccccgtttagttccggttttaccttaacccccgg

SEQ ID NO: 178760 - DNA, 643 bp, Homo sapiens
  misc_feature: GYAE6OF02IIV9Y.44.10.A10.1.454.CMB.1.raw
  modified_base (198)..(198): a, c, t, g, unknown or other
  misc_feature (198)..(198): n is a, c, g, or t
  modified_base (613)..(613): a, c, t, g, unknown or other
  misc_feature (613)..(613): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagcccaccctgtctgtgtctccgaaggggaangcccaccctctcctgcgagggccagtcagagtgttagcagcaacttgcctacgtaccagcaagaaactctggaccaggcctacccgaggtcctccctctaacttctaagttcgggtagcctacctcccgaaccgaggggccctaacgtcggtaacctcccgagcccgtagggttccaagtcgggactagggttcggggtcctaggggaaccaaggttacgtttaccacctttcacccgaacctacgtccaacggcctaacgcccgttagacgtacgttacgagtaagtttattttcgactttaagttttactacgtgtcgagagtaagtaataagtcgtacgttcggtacccttcccgtacggaaccgaacgggacacgtacgagtaacgtaacgttaaacgagttcggcgtacncgtacctacctattacgttcgttactaccg

SEQ ID NO: 178761 - DNA, 675 bp, Homo sapiens
  misc_feature: GYAE6OF02IILML.44.10.A10.1.454.CMB.1.raw
  modified_base (193)..(193): a, c, t, g, unknown or other
  misc_feature (193)..(193): n is a, c, g, or t
  modified_base (476)..(476): a, c, t, g, unknown or other
  misc_feature (476)..(476): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctcagccaccctgtctgtgtctcgagggaancgccacctctcctgcgacgggccagtcagagtgttagcagacaacttgcctcgtaccagtacagaaactcgtcggaccgacggcctcccgacggtctcccgtctatcttagtcggtcgccactcccgaccgacgggccctacgttaggtaccttcccgacgtccgtacggttcgacggtcggacgtagggtggggttacgtacggggtacgaggtacgttccgtacttcctacctaaccgtctacgacgctaacgtccctgaccgtagtccgtagtaacgttnttttcgacgtttacgttttacttacgttcgacgtaacgacgttaagttaagttaacgtcgtaaccggttcccggtcccttttacccggtaccgggtaaccgtaacggtaccgtaacggtaccgtaggtaacgtaaacgttaaccgtacggtggttacgaccgttacgaaccgtcctacgttcgttcgttacgttacccg

SEQ ID NO: 178762 - DNA, 456 bp, Homo sapiens
  misc_feature: GYAE6OF02GZ7TZ.44.10.A10.1.454.CMB.1.raw
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
  modified_base (437)..(456): a, c, t, g, unknown or other
  misc_feature (437)..(456): n is a, c, g, or t
tcagacagtatatacacgaccggtgctcgatttagcgtcgatctcaggggatagagcctccctctcctgcagggccagtcagaatattggcgccgactacttagcctggtaccagcagagacctggccagcctcccaggctcctcatccacggtgcatccaacagggccactggccgtccctgacaggttcagtggcaggtgggtctgggacagacttcactctcaccatcagcagcctggacgcctgaacgtattttggtgatgttattactgtcatttccattcggtcccttacctcgtaacttttggccacggggaccaaacgtgaaactcaaacgactgtgcttgcacatctntcttcactcttcccgcctatctgacttatagtactcgtactggacgtcgggtntcggtaccgaggccacgtagtagcnannnnnnnnnnnnnnnnnnnn

SEQ ID NO: 178763 - DNA, 627 bp, Homo sapiens
  misc_feature: GYAE6OF02HGCCO.44.10.A10.1.454.CMB.1.raw
  modified_base (187)..(187): a, c, t, g, unknown or other
  misc_feature (187)..(187): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgtcagatgtgacatccagatgacccagtctccttcctcctgtctgcttctatagganacagagtcgccatccacttcgccgggcaagtcagaccattaacagtcttaatttaaattggtatacagcaagacgaccgaagggaacgccccctagaacctcctagactctcgtgctcgcctccactctagcgtaaggtgacgttctacttacgtaaggttcaggtcggcgtaggtggtgttacgaggtactagttactttcgacttcacgtacctatccgtaccagttcacgactaaccgtagtaacgttactttacgaacttaacgtttaactacgttacgtaacctaacgtaaagttacgtttacgtaccttccggttaccccgtttagttaccgggttttacgggccgggtaaccgtacggtcgttaacggtacgtaactaaccgtaaacggtagttcggtagtacgttcggaccctaacgtacttacgtcttccg

SEQ ID NO: 178764 - DNA, 671 bp, Homo sapiens
  misc_feature: GYAE6OF02I5LIC.44.10.A10.1.454.CMB.1.raw
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
  modified_base (651)..(651): a, c, t, g, unknown or other
  misc_feature (651)..(651): n is a, c, g, or t
tcagacagtatatacacgaccggtgctcgatttagcgtcgatctcagggggtcagtctcagtcaggacacagcatggacatgagggtccccgctcagctccgtggggctcctgctactctggctccgaggtgccagatgtcgacatccagatcgacccagtctcccttcctccctgtcctgcttctatagganacagctcgcctatccacttcggcgggcaaggtcagacctataacagtcttatttaaatgtancagcaagnaccgaggaacnccctgaactccngtactctcgtgcctncccgtctactcgtacgacgtaacggtcggtactttccgtcgttaactaacgggttcgtaggttcggagtacggttgtaacgtccgggtaaaggctaggtttacgttcctaagtccccttanaaccggttactccgttaacccngttccggtaactaccaacgttacggtaacgttacgttacgtaacctttaacttacttaccgttcgtaaaccaacgtaagttaacgttaaccgttaccgtccctttacccgttacgttaccgggtttacgggaccgggtaacctagggtcctaacggtacgtaaccggtaactaaccgggttaacgtagttcccgtactcgaaccgtntaaccggttcttcgttaccg

SEQ ID NO: 178765 - DNA, 829 bp, Homo sapiens
  misc_feature: GYAE6OF02HX6D6.44.10.A10.1.454.CMB.1.raw
  modified_base (176)..(176): a, c, t, g, unknown or other
  misc_feature (176)..(176): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctntcttctataggagacagagtcgccatccacttggccggcaagtcaacgaccaattaacagtcttaatttaaagttggtatcagcagagaaccgaagggaaactccccgtagaacctccgtagtacttctcgtcgtccgtccgcccctacccgtaccttccgtacggacgttaagggtcggtaccgtttccttaccgtttaacggtaacgggtttaccgacgggtcggtacgtacgggttcggtaacgttcgggtaagggtaacgtaacggtttacttttacccgacctttaccgtacccttaaccctacgtttccccttacccgtacgtttaccgtaccggtaaaccctaaaccgtttaagtaaaccgtttttaaccgtttacgtaaacccgtttaaaaccttttacccgttaaacgttaaccgttaaccgtaaaacgttaacggttaaacgtttacccgttaaccgtttccccggttaccccgttttttaacgtttacccggggttttttaccggggaacccggggttaacctaaacgggtttccggttaacgggtaaacggtacctttaaaaccggaaacccggttaaacgttcgggtaccggtttacgaccggtacccttaacgtacccgtttcgttaccgttttacccg

SEQ ID NO: 178766 - DNA, 660 bp, Homo sapiens
  misc_feature: GYAE6OF02HU56I.44.10.A10.1.454.CMB.1.raw
tcagacagtatatacacgaccggtgctcgatttagcgtcgatctcaggggggggggtctcaggaggcagcactctcgggacgtctccaccatggcctgggctctactcctcctcagcctcctcactcagggcacaggatccgtgggctcagtctcgccctggctcacgcctccctccgtgtccgggtctcttggacagtcagtccaccatcctcctgcacgtacggaaaccacgacgtaggtaccggttccgggtttacgtttttcggaccggttcgttccttccgtgggttaccaggccaacgaccccaagaaaccaccgaccccaaactctaatttatttactcggacgtactagttcgttccgtcccgtttcggtcgtcccgtgacgtcctcttccgtcgtcggtacctagtccgtacgacaccggaccgtccctcccgtagacctactccgtcgtcgggcctccggaggtctaggacggacggtcggtctagttacttacgtacgtgacgtacgtctacataacgtacgtaaggtacggtaacttacgtttacgtacggtacgacgacgacgaacgacgcgtacgaccgtcgtacgtacgacgccgacgtccgcccgtcccgtcggtcctaccgtccgttccgtcccctccctccg

SEQ ID NO: 178767 - DNA, 609 bp, Homo sapiens
  misc_feature: GYAE6OF02IBI5Z.44.10.A10.1.454.CMB.1.raw
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaacgacgcccaccctctccctgccgagggccagtcagacgtgttagcagctaactagcctcggtaccagtcaagtaactcgtggccaggtcctcccgaggccttcctctatccgttagtggtcgctactcccgaccgacgggcctacgtcggactccccagcccgtaggttcgaggtggtactgggtcgggtcgtagggacngtacgtcactcgtcactntcancgntcctgctcgtgtagttagttgtttcagttactttagtcgtagtccgagtactaagttaactagtcgtaccgtacccgtcccgtttccgggtaccgacggtaaaccggcgtaacggacgtcggtaaacgttaacgtaaaccggtgtacggtacgctaccgaccgtacttaggttccttcggtccttaccg

SEQ ID NO: 178768 - DNA, 721 bp, Homo sapiens
  misc_feature: GYAE6OF02GOTF4.44.10.A10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccagccacctgtctgtgtctccaggggaaagngccaccctctcctgcagggccagtcagagtgttaccagcaacttagcctggtaccaccagaaacctgggcaggctcccaggctccctnatctatggaacatccaccagggccactggtactcccaccaggttcagtggcaggtcggggtccggacaggtactttcgacttctacacctatcaggccggcctggacctaggttcctaggtaacgggttattttttcggacgttaaggtttttaactttaaccgttacggttacctaaaggtccgttaaaggtttaactaaacgttcggtaaccgttccgggtccccgttaccccgtttaccgggtaacccgtaaacgggggaccctaacgggtaaccgttacggggaaacgttaaacgtttaaaaaccggaaccgtttagggtaccgggttaccgttaccgggaacctaacccggttaaccttcccgttacgggttttccctttacgtaccgtttccccctttacccccgggaaccccttagttcccgttaaccgg

SEQ ID NO: 178769 - DNA, 742 bp, Homo sapiens
  misc_feature: GYAE6OF02H5OX1.44.10.A10.1.454.CMB.1.raw
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
tcagacagtatatacacgaccggtgctcgatttagcgtcgatctcagggggtcagtctcagtcaggacacagcatggacatgacgggtccccgctcagctccgtggggctcctgctactctggctccggaggtgccagatgtgacatccgagatcgaccctagtccttcccttcctccctgtctgcttctataggacgtanaggagtcgccatcacgttcggccgggacaaggtcacgacctagttaacngtactttaatttaagttggtancgtaagacaaggaaccgaacggaacgggaaaccgtcccctaaggtaacctaccgtagtactccgtctacggccttcgcccctacgtaccttgacggacgtacggtcggtactcttaccgttacgtacggttacagggtacggtcgtaggtacggtactccgggtaaggacttacgttacgttactaccggtacctaccgtaccttaaccttcccgtacccgtacggttcgtaaccggtaacctaaaccggtaggtaaacgtttacgttaaccggttaaccctttaacggttaaaccttaccgggttaactaaccggtaacgttaacgtaacgtttacctaccggttacccgttacccgtttacgttacgggttcgggtaaccgggtaccacggttacgtacggtaacgtacgtaaccgtaacggtacggtacggccgtacgacgtacccgtactacggttactcgttacc

SEQ ID NO: 178770 - DNA, 899 bp, Homo sapiens
  misc_feature: GYAE6OF02JJR99.44.10.A10.1.454.CMB.1.raw
tcagacagtatatacacgaccggtgctcgatttagcgtcgatctcagggggaggaactgctcagttaggacccagacggaaccatggaagccccagcgcagcttctcttcctcctgctactctggctcccagataccactggagaaatagtgatgacgcggtctccgagccacctgtctgtgtcctaccgaggggtaaaccgtaccacccgttctccgtgccgaggggccagtcaggagttgtaacgcaggccaacttacgcctcgtaaccagtcaacgaatccgtaggacccaggcctccgacggtctccgatacttcgtaagtacggaacctactaccgacccgtaacgggcctaacgtacggtaacctccccaaccgtaggttcaacggtcggactgggtaccggggtccggaactaggtaccgttacaacccgtttctaccgaacctacggtacgtaaccgggtccgggtacccgtaacggtacccgtaacggtaccggtttaacgggtaacgggtttaacgttttaccggtaacgtttaacgggttttaaacctttaaccggttaccggttaaccgtaaccggtaccggtttaaaacggttaaacgttaaaaacggtttaacccgggttccgggttacccgtttacccggtttaaccgggttttaacccggggttttacccggggggacccggggggggttaaaacccgttaacgggggtacggttaaacggggtaaaccttaacccgggtaaaacggttaaccgggtttacggtttaacggggtacccgttaacgggtaaccccttaaacccgggttaacgttaacccggtttacccggttaaccgttttacccggtaacccgttttcccccggttaacccccggtttaacgg

SEQ ID NO: 178771 - DNA, 648 bp, Homo sapiens
  misc_feature: GYAE6OF02HK4KT.44.10.A10.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
tcagacagtatatacacgaccggtgctcgatttagcgtcgatctcagggggaggaactgctcagttaggacccagacggaaccatggaagccccagcgcagcttctcttcctcctgctactctggcctcccagataccactggaagaaatagtgatgacgcggtctccagccaccctgtctgtgtctccgagggaaancgccacctctcctgcagggccagtcagagtcgttagcagactaacttagcctacgtaacngacaagtaaactctacggcctaaggtcctccgaggtcctcctactattcctagtggtcgactactcccaaccgacgggaccctaacgtggtaacctccccgaagtcccgtaaggttcaaggtcggcgtaaggtcggtacgtacgggaactacggtattaccgaacttcctacgaacctactaccgacgactacgcctaggactagtctaggtaacgttcgtttacgacgttaattttaacgtacgtagttacaagtacttaaagtaacttagtaccgtacgttccgggtacccttacccggttacggaccgtaaacgggaccctagaccgtaggaaccgtaaataaaccggatcggtacgtctacgtacgtacctagttctacgttctac

SEQ ID NO: 178772 - DNA, 570 bp, Homo sapiens
  misc_feature: GYAE6OF02G80WT.44.10.A10.1.454.CMB.1.raw
  modified_base (266)..(266): a, c, t, g, unknown or other
  misc_feature (266)..(266): n is a, c, g, or t
  modified_base (530)..(530): a, c, t, g, unknown or other
  misc_feature (530)..(530): n is a, c, g, or t
  modified_base (537)..(542): a, c, t, g, unknown or other
  misc_feature (537)..(542): n is a, c, g, or t
  modified_base (544)..(570): a, c, t, g, unknown or other
  misc_feature (544)..(570): n is a, c, g, or t
tcagacagtatatacacgaccggtgctcgatttagcgtcgatctcagggggatagagcctccctctcctgcagggccagtcagaatattggcgccgactacttagcctggtaccagcagagacctggccagcctcccaggcctcctcatcccgacgggtgaccatacccaacgacgggccacgtgggccgtcccctgacgtaggttcaggtcggcaggtgggtctgggacagtacttcactctcaccatccagcagcccgtggacnccgtagaagtacttttggagtaactgtaacttctgtactatttcctagttccgttacccttaccgttacgttaacgttttcggaccgtaacggggaaccctaaacgtaggtaaaataccgaaaaccgtaacgttggcgggtctacgacctaaccagttccttaacggttctactacgttacccttccccgactacttccgtagtaacttaacggttaactcgttacgtcgtacgtacggccgggtctagggacgaacggccganagtcgannnnnngnnnnnnnnnnnnnnnnnnnnnnnnnnn

SEQ ID NO: 178773 - DNA, 708 bp, Homo sapiens
  misc_feature: GYAE6OF02FJ3EN.44.10.A10.1.454.CMB.1.raw
  modified_base (245)..(245): a, c, t, g, unknown or other
  misc_feature (245)..(245): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatcgaccctagtcctccttccttcctgtccttcttctggttggaggcagcgtacaccatccacttggccgggtcgagtccagggttcggttttcggngtaccttggttcgccgttacgggtttaccaaaacggtaaaaaggggggcgtaaccggtaccccgttaacggttcctacgttcctcgtccggtacgaacccgagtaccggtaggaacggtgtaccgtcccggtctagggttcaggttcgccgtacggtccggaggtcggtacggggccggtactcccgacgtcctcacccgtatcggaccgtaccgtggacccgtctaggaacgtcgttctagaccttaactttattcgtacgtcgtaacgccgtaagtattaccgtacgtaccgttcccggttaccccgtttataccggtttcggacccggtaacgggaccgtacgtacgtaaggtaaacctccggtaaaacgtacggtcgtacggtactcgaccctaacgttctacgtccggttcttaccggtaccttaccgttccccgccttagttaccgtagtaacttac

SEQ ID NO: 178774 - DNA, 843 bp, Homo sapiens
  misc_feature: GYAE6OF02G3JNG.44.10.A10.1.454.CMB.1.raw
  modified_base (225)..(225): a, c, t, g, unknown or other
  misc_feature (225)..(225): n is a, c, g, or t
tcagacagtatatacacgaccggtgctcgatttagcgtcgatctcagggggtcagtctcagtcaggacacagcatggacatgagggtccccgctcagctcctggggctcctgctactctgctccgaggtgccagatgtgacatccagatcgacccagtcctccttcctccttgtctgtcttctatacggagacagaggtccgcctagtccacgttacggccgganaacgtcacgtacctaattaaccgagtacttaattttaaagttcggtaactacgaagactaacggtaacggaaccggacgggaaaccgtccccgtagtaacccgtccctagccgttaccttcgtagtccgttccgcccttacccgtacgttccgtacggtaacggtaacggttacgggtaacttcccgttacgttaacggttaccgggtaacgtgggttaccggtaacggttacggtacggtaccgggttacggttaaccgggaaacttcgtttaaccgtccttaacccgttactaacccgtaaccccttggtttaacccctccccggtaacggtttcccaggtaaccctaacggttaacgtaacgtttacttttaccgtaaacccctttaacggttaacttaccggtttacgtaaacccttaacgggtaaaacggtttaactttcccggttaaaccttttccccgggtacccgtttaacggttccggggtttaaacccggggaacgggttactaccgggttacggtaccgaaaggtttccccaaacgggtacggttacggttaccgtacgggttaaccacggcccctttaaacgggtacccttcgttacccgttaccc

SEQ ID NO: 178775 - DNA, 626 bp, Homo sapiens
  misc_feature: GYAE6OF02HOCZQ.44.10.A10.1.454.CMB.1.raw
  modified_base (214)..(214): a, c, t, g, unknown or other
  misc_feature (214)..(214): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagacagtatatacacgaccggtgctcgatttagcgtcgatctcagggggtcagtctcagtcaggacacagcatggacatgagggtccccgctcagctcctggggctcctgctactctggctccgaggtgccagatgtgacatccagatgacccagtctccttcctccctgtctgcttctagtaggagacagagtcgccatcacttggccggnagtcaggccattagctaatttatttagcctggtatcagacagaaaccagggaaacctcctaacctcctgatcttgctgcactcctactttgacaatcgacgggtccctataccgttcggttacaggcggcaggtggatcgtagggaactagtacttttctcctcgtaccacctatccagtcaacgtccttcgacacgtccctagaagtnttcggttanaaccttaactttacttacgtacttaaacgtaaaacgtacaactacgttacccgtcccttacaccgttaaccgttccgggacccttacggggtaacctaaaggttaccgggtaaattaaccgtaaccggtaaaaccgtacggtaacggttccggtacgtaccggtaaccgtaacccgtagttccgtttaacccgg

SEQ ID NO: 178776 - DNA, 805 bp, Homo sapiens
  misc_feature: GYAE6OF02H2WQG.44.10.A10.1.454.CMB.1.raw
  modified_base (301)..(301): a, c, t, g, unknown or other
  misc_feature (301)..(301): n is a, c, g, or t
tcagacagtatatacacgaccggtgctcgatttagcgtcgatctcagggggtcagtctcagtcaggacacagcatggacatgagggtccccgctcagctccgtggggctcctgctactctggctccgaggtcgccagatgtgacatccagatcgacccagtccttcccttcctccctgtctgtcttactagtaggagacgagacgtccgacctatctacttcggccggacaacgtcaacgacctattaacagtactttaatttaaacgttggtactcgagcagaacgaccgaagggaaccncccgtacgaaccttcctagtacttaccgtcgtcgtcctccgcccgtccctacgttcgtacgacgtaaggtggtacgttcgttcgttacgaggttacgaggttcgacgtaggtacggtacgtacgggtagggtaactagtttacttaccgtaaccgtttccctaccgtaaccctcttaccccggtaccgtaacggttccgttaccgaaacccgttaaacggtttaacgttacgggttttaacttttaaccccgggtaacttttaaaccccgttttagttacccgtacgtaaaccgttaacggttaaaccggtttaaactttccgtttaccccgtttacccgggttttaccccgtttttaacgggtttaccgggggttttaaaccggggacccgggtaaacgttacggggtacgttaacgggacgttaaaccggtaaacccgttaagggtaccgttcggtaccgtacgtacggtaacccttacgttactttccggttctttacccg

SEQ ID NO: 178777 - DNA, 483 bp, Homo sapiens
  misc_feature: GYAE6OF02F06L0.44.10.A10.1.454.CMB.1.raw
  modified_base (152)..(152): a, c, t, g, unknown or other
  misc_feature (152)..(152): n is a, c, g, or t
  modified_base (414)..(414): a, c, t, g, unknown or other
  misc_feature (414)..(414): n is a, c, g, or t
  modified_base (421)..(483): a, c, t, g, unknown or other
  misc_feature (421)..(483): n is a, c, g, or t
tcagacagtatatacacgaccggtgctcgatttagcgtcgatctcagggctgtacattctacattggagttgtacagcctcgagatctgacgacacgggcgtctattattgtgcgagagcccaacggaaccctgcttctttctgacttacgngggggccagtggaaccctggtcacccgtctccctcacgccctcccaaccgaacgggcccctatccggttcccttccccccgtggccgccccgtgccctccgaaggacgccacccctccgaagcgacacacggcccggtacccggtcgggccttacgcccgttcgggtacaacggtaaccttacccgtttacctaattaacttacctttcggttacgtaggaccgggccggggtacgtggaaccgaacggcgaccgataggcngactgcnnnnnnnnnnnnnnnnnnnnnnnnnnnnnnnnnnnnnnnnnnnnnnnnnnnnnnnnnnnnnnn

SEQ ID NO: 178778 - DNA, 514 bp, Homo sapiens
  misc_feature: GYAE6OF01BM9EL.49.16.B05.1.454.CMB.1.raw
  modified_base (500)..(500): a, c, t, g, unknown or other
  misc_feature (500)..(500): n is a, c, g, or t
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggcccctgtcttggtggtatataaagacagtgagaggccctcagggatccctgagcgattctctggctccagctcaggacaacagtcacgttgaccatcagtggagtccaggcagaagacgaggctagactattatgtcaatcagcagacaccggtggtacttagtcgggtgttcggcggagggaccagctgaccgtcgtaggtcagcccaaggctcgcccctggcactctcgtcccnccctcctctctccg

SEQ ID NO: 178779 - DNA, 539 bp, Homo sapiens
  misc_feature: GYAE6OF01BE7KJ.49.16.B05.1.454.CMB.1.raw
  modified_base (306)..(306): a, c, t, g, unknown or other
  misc_feature (306)..(306): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctnagggatccctgagcgattctctggctccagctcgaggacaacagtcacgttgaccatcagtggagtccaggcagaagacgaggctgacttattatgtacaatcagcagacgacggtgtacttagtcggtgttcggcggagggaccaagctcggaccgtccgtaggtccacgacccgaaggcctcggccccctcggtccacctcgttccgttccccgccctccctcctcctccg

SEQ ID NO: 178780 - DNA, 518 bp, Homo sapiens
  misc_feature: GYAE6OF01DONBJ.49.16.B05.1.454.CMB.1.raw
  modified_base (305)..(305): a, c, t, g, unknown or other
  misc_feature (305)..(305): n is a, c, g, or t
  modified_base (506)..(506): a, c, t, g, unknown or other
  misc_feature (506)..(506): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggcccctgtcttggtggtatataaagacagtgagaggccctnagggatccctgagcgattctctggctccagctcaggacaacagtcacgttgaccatcagtggagtccaggcagaagacgaggctgactattattgtacaatcagcagacaccggtggtacttagtcgggtgttcgggcggtagggaccaagctgaccgtctaggtcagcccaggctcgcccctcggccactctcgttcccnccctcctctctc

SEQ ID NO: 178781 - DNA, 530 bp, Homo sapiens
  misc_feature: GYAE6OF01AZES7.49.16.B05.1.454.CMB.1.raw
tcagagtcgagagacacgaccggtgctcgatttagagctcacgtaaggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattatgtcaatcagcagacacggtgtacttagtcgggtgtcggcggaggacgaacgcgtcgaccgtccgtaggtcgacgacccgaaggccgtcgccccgtccggtcacctcgtcgttacccaccctcctcctctccg

SEQ ID NO: 178782 - DNA, 517 bp, Homo sapiens
  misc_feature: GYAE6OF01DY3SC.49.16.B05.1.454.CMB.1.raw
  modified_base (441)..(441): a, c, t, g, unknown or other
  misc_feature (441)..(441): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcaggggatccctgagcgattctctggctcagctcaggacaacagtcacgtttgaccatctagtggagtccaggcagaagacgaggctgactattatgtcaatcagcagacaccggtgtacttatcgggtgttcggnggagggaccaagctgaccgtcctaggtcagcccaaggcctgccccgtcggcactcctgttcccgcctcctctctcg

SEQ ID NO: 178783 - DNA, 568 bp, Homo sapiens
  misc_feature: GYAE6OF01AI0E0.49.16.B05.1.454.CMB.1.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctnagggactcccgtgagcgtattctctggctccagctcgaggaccaacngtcacgttgaccatcagtggagtccaggcaagacgacgaggctgaacttattattgtacaatcagacagaccgacggtggtactttagtcgggttgttcgggcgggacgggtaccgaagcgttaggacccgtcgtacggacaccggacccaaggccttccggcccccgtggtccctacgttccgtcggttcccccgcccttccctccttctcccg

SEQ ID NO: 178784 - DNA, 654 bp, Homo sapiens
  misc_feature: GYAE6OF01EO94P.49.16.B05.1.454.CMB.1.raw
  modified_base (214)..(214): a, c, t, g, unknown or other
  misc_feature (214)..(214): n is a, c, g, or t
  modified_base (293)..(293): a, c, t, g, unknown or other
  misc_feature (293)..(293): n is a, c, g, or t
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccgagatcactgctcgtgganatgctagttcgaacccaaaacgatagtgtactttagttcggtaccagcaagaacggccggacacggccctgtgttggtnagttgtaataaacgactacgtaggaggaccggtccctaggagggtactcccgtaggacgcgtattcctcgtcggtcctaccggaggtcgaacgggaacgtaacggtcaactagttccggacctagtcgtaggtggacgtccgaggcaaggacggacgaggctacggtaacttaagtttagttcgtaactaaataccaaacgacgaaccaccttaagttacggttaacttacgtgttaccttacgggaacttcgaccgaaccgtaacggtcctaacccggtcgtacgggtaccaccggtaccccgaaacggacccccaaaccccgtacgttcgtaccctacctcgttcccgtccccgtcccc

SEQ ID NO: 178785 - DNA, 533 bp, Homo sapiens
  misc_feature: GYAE6OF01BEMHS.49.16.B05.1.454.CMB.1.raw
  modified_base (305)..(305): a, c, t, g, unknown or other
  misc_feature (305)..(305): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggatatggtcattggtaccagcagaagacaggccaggcccctgtcttggtggtatataaagacagtgagaggccctnagggatccctgagcgattctctggctccagcctcgaaggacaacagtcacgttgaaccatcaggtggagtccgaggcaagaagacggaggctgacttattattgtacaatcagcagacgacggtggtacttagtcgggtgtcggcggacgggaccaagtctgaccgtcgtaggtcacgcccgaaggcctcgccccgtcgtccactctctccctaccctcctcctctcc

SEQ ID NO: 178786 - DNA, 568 bp, Homo sapiens
  misc_feature: GYAE6OF01A5AK7.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctgagggatccctgagcgattctctggctccagctcgagggacaacagtcacgttgaccatcagtggagtccaggcagaagacgagctgactattattgacaatcagcagacacggtgtacttagtcgggtgttcggcggtagggaccaagtcgtacggaccgtccgtaggtccacgcccgaaaggccgtacggccccccgttcgggtccctaacccgttccgttcccggttacccccgtccccctttcccgtcccttccgtcccg

SEQ ID NO: 178787 - DNA, 533 bp, Homo sapiens
  misc_feature: GYAE6OF01DZU64.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggcccctgtcttggtggtatataaagacagtgagaggccctgagggatcccgtgagcgattctctggctccagctcaggacaacagtcacgttgaccatcagtggagtccaggcagaagacgaggctgacttattattgtacaatcagcgagacgaccggtggtacttagtcgggtgttcgggcggagggaccaagctaggaccgtctacggtcacgcccgaaggcctcgccccctcggtccacctctcgttccccaccctcctctctcc

SEQ ID NO: 178788 - DNA, 514 bp, Homo sapiens
  misc_feature: GYAE6OF01B5IVH.49.16.B05.1.454.CMB.1.raw
  modified_base (306)..(306): a, c, t, g, unknown or other
  misc_feature (306)..(306): n is a, c, g, or t
tcagagtcgagagacacgaccggtgctcgatttagagctcacgtaagggggtgggcccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctnagggatccctgagcgattctctggctccagctcgagggacaacagtcacgttgaccatcagtggagtccgaggcagaagacgaggctgactattattgtacaatcagcagacacggtgtacttagtcgggtgtcggcggagggacagctgaccgtctaggtcagcccaaggcctgcccctcggcactctcgtcccacctcctctctcc

SEQ ID NO: 178789 - DNA, 519 bp, Homo sapiens
  misc_feature: GYAE6OF01AD7GB.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggcctcagggatccctgagcgattctctggctccagctcaggacaacagtcacgttgaccatcagtggagtccaggcagaagactaggctgactattattgtcaatcagcagacaccggtggtacttagtcgggtgttcggcggagggaccaagctgaccgtctaggtcacgccaaggctgcccccgtggtccactctcgttcccgccctcctctctccg

SEQ ID NO: 178790 - DNA, 561 bp, Homo sapiens
  misc_feature: GYAE6OF01CJWEK.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcgagggactccctgagcgattctctggctccagctcgaggacaacgagtcacgttgaccatcagtgagtccaggacagaagacgagctagactattattgtcaatcagcagacgacggtgtacttagtcggttgtcgggacggtacgggaccaaggcctaggacccgtaccgtaggtaccacgaccccgaagggtcctccgccccccgttcggtaccaccgttcctccgttccccacccttccctctccgttcccg

SEQ ID NO: 178791 - DNA, 748 bp, Homo sapiens
  misc_feature: GYAE6OF01A5QO9.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtcagtcgtccccaggacagacggccaggatcacctgtttggagatacgttaacgaaaggaatatggtcattggaccagcagaagacaggccacggccctgtcttggtgtatataaagacagtgagacggccctcgagggactcccgtgacgcgtattctcgtggcctccagcctcgaacgggaccaaacgtacgtccaacggtttgaaccctagttaccgaggtcgggtaacgtacccgaggaccgaaggaacggaacggagggtccgtagtaaccgttaatttaagttacgtaactaaagttaccgaacgtacgaacgtaaccgtaacccgggttacggttaaccgtttacgggttcggggtttcgggtttaccggggaccggggtaacggggtaacccgtaacggtaccgtaccgggtacccggttacccggtaacgggtacccgaaccggtaccccggaaacgggtcccgtaccccggtcccccccggttcggtacccccgtaacccgttccccgtttacccggtttccccccggtaccccctttaccccttccccgttccccgttaccccg

SEQ ID NO: 178792 - DNA, 553 bp, Homo sapiens
  misc_feature: GYAE6OF01A3OCL.49.16.B05.1.454.CMB.1.raw
  modified_base (439)..(439): a, c, t, g, unknown or other
  misc_feature (439)..(439): n is a, c, g, or t
tcagagtcgagagacacgaccggtgctcgatttagagctcacgtaagggggtgggtccagggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacggttacgaaaggaatatggtcattggtaccagcagaagacaggccaggcccctgtcttgatcatttataaagtactttgagagggcctcgacgggacccctggagcgtattctctggctccagctcagcgacaacacgtcacgttcgacctatacgagtcggacgtccgggcaggacggacgaggctagactattactgtcagtcatacagacagtagnggacacttctcgtacgttagttcgggcggtaggaccaagctagccgtcgtaggtcgacgcccgaaggcctccgccccgtcggtctaccgtctccgttcccctccctccctcccg

SEQ ID NO: 178793 - DNA, 682 bp, Homo sapiens
  misc_feature: GYAE6OF01CNC94.49.16.B05.1.454.CMB.1.raw
  modified_base (345)..(345): a, c, t, g, unknown or other
  misc_feature (345)..(345): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtcccaggacagacggccaggatcactgtttggagatacgttaagaaggaataggtgtcagttcggtaccagacaaggaagacacggccacggcccctggtcgttgggtaggtaataagtaaaagacaggtaggagacggcctagaggactccctgagcgattcncgtcggcctcgacgcgtacgaacgggtaaccaaacgtacggtacctacggtttacgaacctagtacgaaggtagggaacgtaccgaggacgaagaaacggacggacggctagaacttattacgttgtaacatacacggacaacggaccgtaccgggttagttaacgttacggttcggggttcgtcggggacgggtaaccgggaccgaacggtccgtacgggtacccgtcggttaacggtccgaccgtacccgtaacgggtccctacccggtcccccggtaggttccccaccgttcccgttcccgtacccctacccgttcccttccgtcccgttcccg

SEQ ID NO: 178794 - DNA, 551 bp, Homo sapiens
  misc_feature: GYAE6OF01BKWK1.49.16.B05.1.454.CMB.1.raw
  modified_base (319)..(319): a, c, t, g, unknown or other
  misc_feature (319)..(319): n is a, c, g, or t
  modified_base (411)..(411): a, c, t, g, unknown or other
  misc_feature (411)..(411): n is a, c, g, or t
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggccctgtcttggtggtatataaagacagtgagaggccctcgagggactcccgtgancgattctctggctccagctcaaggacaacgagtcacgttgaccatcagtggatccaggcaagagacgtagctagactatattgtcaatcgancagacacggtgtacttagtcgggtcgttggcggagggtaaccaaggtcctagaccggtcgtacggtcacggtacccaaggcctcgacccccttcggaccaccgttccgtcttccccaccccgtttcctccctcgttcccg

SEQ ID NO: 178795 - DNA, 606 bp, Homo sapiens
  misc_feature: GYAE6OF01DUA4H.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaggacagacggccaggatcacttgtttggagatacgttaacgaaaggatatggtacattggaccagacagaagacaggccaggcccctgtcttggtgtataataaagacagtgagacggccctgagggactcccgtggacgcgtattctcgtggcctccgagctacgaacgggaacaacgagtcacgtttcgaacctatacgaggtggacgtaccgagggacaaggaacggacgaggtctagtacttaattatagtacaatcaagacagacgtaccggtagttacgttacgtcggggttgttacgggcgggaacgggaaccaggtctacggtaccgtacgtaggtacacgacccacggtcctaccgccccgtcgtacctactcccgttccgttccccctacccttccctcttccgtcccg

SEQ ID NO: 178796 - DNA, 535 bp, Homo sapiens
  misc_feature: GYAE6OF01CU73X.49.16.B05.1.454.CMB.1.raw
  modified_base (359)..(359): a, c, t, g, unknown or other
  misc_feature (359)..(359): n is a, c, g, or t
  modified_base (510)..(510): a, c, t, g, unknown or other
  misc_feature (510)..(510): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaaagacagtgagaggccctgagggactcccgtgacgcgattctcgtggctccgagctcgagggaccaaacgngtacacgttagaccagttcagtggacgtccgaggcagaagacgaggctgactattattgtacatcagtcagacaccggtgtacttagtcgggtgttcggcggtaggaccaagctgaccgtcgtagtcacgccaggcctcgcccctcggtcncgtctcctcccaccctcctctctcg

SEQ ID NO: 178797 - DNA, 515 bp, Homo sapiens
  misc_feature: GYAE6OF01C4NI6.49.16.B05.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (336)..(336): a, c, t, g, unknown or other
  misc_feature (336)..(336): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtgtccccaggacagacgccaggatcactgtttganatacgtagaagatangtcatgacagcagaagacagccagccctgtcttggtgtatataaagcagtgagaggccctgaggactccctgagcgtattctctggcctcgagctcgaggaacaaagngtcagttgaccagtcagtggactccgaggcaagaagacgagctagacttatatgtacaatcagcagacacggtgtactagtcggtgtcggcggagacaagctcgacgctagtcacgccaaggtctaccgccccgtcggtccacgttcgtcccgttaccccacccttcctcctcctcccg

SEQ ID NO: 178798 - DNA, 632 bp, Homo sapiens
  misc_feature: GYAE6OF01BKVLH.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggccctgtcttggtggtatataaagacagtgagaggcccctgagggactcccgtggacgcgtattctctggctccagcctgaggacaactagtccacgttcgaacctatcaggtggacgtccgaggacaagaacgacgaggctagtacttattagttatacaatcagacgagtaccgaccgggttaggttacctttaggttcggggttgttaccggggacgggaacggggtaaccgaacggtccgtacggtacccggtccgtaagggtccaccggaccccgaagggtcccgtacccggccccccgttcggtccctaccgttcccgttcccggttacccccgtccccctcccgtttcctcccgttcccg

SEQ ID NO: 178799 - DNA, 783 bp, Homo sapiens
  misc_feature: GYAE6OF01C7OAP.49.16.B05.1.454.CMB.1.raw
  modified_base (216)..(216): a, c, t, g, unknown or other
  misc_feature (216)..(216): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggccctcctatgagctgacacagcccaccctcggtgtcagtcgtccccaggacagacggccaggatcactgtttganatacgtaagaagatatgtcattggtacagcagagacaggccaggccctgtcttggtggtataataaagacaggtgagacggccctgagggactcccgtgagcgattctctggcctccagctacgacgggtaaccaaactagtccgtaacgtttacgaacctagtaccgtaggttcgggacgtaccgaagggtaccgaaaggaaacggaacggaacgggtaccgttacggtaaacctttaagtttaacgtttaggtaaccgtaaacgtaccgtaaggaaccgaacggaacccgtaccggggtttacgggtttaacgtttacgggtttaccgggggttacgggtttaccggggtaccgggggaacggggtaacccgtaacggtaccggttaccgggtacccggttacccggttaacgggttacccgaaccggtaaccccggtaacgggtccccgttacccggtcccccccggttaccggggttaccccttaacccggttccccgtttacccggtttacccccccttaccccccgttttacccccttcccgtttcccccgtttaccccgg

SEQ ID NO: 178800 - DNA, 668 bp, Homo sapiens
  misc_feature: GYAE6OF01EPGF9.49.16.B05.1.454.CMB.1.raw
  modified_base (361)..(361): a, c, t, g, unknown or other
  misc_feature (361)..(361): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaggacagacggccaggatcactgtttggagatacgttaacgaaaggatatggtcattggtaccagcagaagacaggccacggcccctgtcttggtgtataataaagacagtagagacggccctgagggactcccgtgacgcgtattctcgtggcctccagctcgaaggacaacgngtacacgttcacctatacgagtggactcccgagggacaaggaacgacggaggtcgtagtaacttagtttatacgtacaatcgaagacgacgtaaccgtacggttagttacgttacggtcgggttcggtaccgggacgggtaacggtaaccgagtcggtaccgtaccgttaccgtaacgggtaccgaacccggtaccggtaaccgggtcccgttaccccggtcccccggttaccggtacccgtacccgttcccggtttcccccggttcccccgttacccccgtttcccttccctcccgtttaccccgg

SEQ ID NO: 178801 - DNA, 630 bp, Homo sapiens
  misc_feature: GYAE6OF01BGDUZ.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgtttggagatacgttacgaaaggatatggtcattggtaccagcagaagacaggccaggccctgtcttggtggtatataaagacagtgagacggcctcgagggactcccgtggacgcgattctcgtggctccagctcgaagggacaacgtagtcacgttcgaccatcgagtggaagtccgagcagaacgacgaggctgaactattagttgtacagtcagacgagaacgaccggttaggttaacttagttcgggtgtttccggggacgggaacggggtaccgaaaggtccgtacggtacccgttaccgtacgggttacgacggtaccccgaagggtccgttaccggaccccccggttcggttacccgtacccttcccggttcctttaccccccggtaaccccttccccgtcctttcccgttaccccg

SEQ ID NO: 178802 - DNA, 589 bp, Homo sapiens
  misc_feature: GYAE6OF01A36JL.49.16.B05.1.454.CMB.1.raw
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtcgtccccaggacagacggccaggatcacctgtttggagatacgttaacgaaaggatatggtcattggtaccagcagaagacaggccaggcccctgtcttggtggtatataaagacagtgagacggccctcgagggactcccgtgacgcgtattcnctcggctccgagctcgaggacaacgngtacacgttcacctatcgaggtcggacgtcccgagggaccaaggaacggacggacggcgtagtaacttattaattacgtacaagtcagcagaccgacggtagtacttagtcgggtagttcgggacgggaggtaccagctacgaccgtcgtacggtcacgacccgaaggcctacggccccctcggtacctaccgttccgtccgttcccccgacccttccttcctcccgtccg

SEQ ID NO: 178803 - DNA, 593 bp, Homo sapiens
  misc_feature: GYAE6OF01EQO2C.49.16.B05.1.454.CMB.1.raw
  modified_base (214)..(214): a, c, t, g, unknown or other
  misc_feature (214)..(214): n is a, c, g, or t
  modified_base (355)..(355): a, c, t, g, unknown or other
  misc_feature (355)..(355): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctggtgtcagtcgtccccaggacagacggccaggatcacctgtttganatacgttacgaaaggatatggtcagttggaccagcagaagacaggccaggcccctgtcttggtgtataataaagacagtgagacggcctgagggactcccgtgagcgtattcgtctggcctccgagctcgaaggacaaacngtaccacgttcgaccatacgagtcggagtaccgaggcaaggaagacgaggctagaacttaattattgtaacatcagacacgtaccgtacggttagtacgttagtcgggtggttccggagggacggtacagcgttacggaccgtcgtacggtcgaccgaccgaacggtcctccggacccccgttcggtcctaaccgtccttaccccgttacccgtaccccttccgttcctcgttacccg

SEQ ID NO: 178804 - DNA, 547 bp, Homo sapiens
  misc_feature: GYAE6OF01B2ITW.49.16.B05.1.454.CMB.1.raw
  modified_base (398)..(398): a, c, t, g, unknown or other
  misc_feature (398)..(398): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttgagatacgttacgaaaggaatatggtcattggtaccagcagaagacaggccaggcccctgtctggtggtatataaagacagtgagaggccctcgagggactcccgtgagcgattctctggctccagctcgaggacaaacagtcacgttgaaccatcagtggagtcaggcagaagacgagctgactatnttagactaatcagcagacacggtgtacttagtcgggtgttacggcgggtaggacgaagtcgtacgtaccgtccgtaggtcacgacccgaacggcctaccgcccccgtcggtacctactccgtcgttccccgaccctccctctccttccg

SEQ ID NO: 178805 - DNA, 622 bp, Homo sapiens
  misc_feature: GYAE6OF01CUSKS.49.16.B05.1.454.CMB.1.raw
  modified_base (214)..(214): a, c, t, g, unknown or other
  misc_feature (214)..(214): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagccaccctcggtgtcagtgtccccaggacagacggccaggatcactgtttgganatacgttacgaaggatatggtcattggaccagcagaagacaggccaggcccctgtcttggtgtaatataaagacngtgagacggccctgagggactcccgtagacgcgtattctctggctccgagcctacgaggaccaaacgngtacacgttcgaccatacgagtacggacgtcccgaagggacaaggaaacgacgaggtcctagtaacttaagttttagttcgtaacaatccgaagccgaagtaccgtaccggttaggttacgttacgttcgggttggttccggcgggaacgggacaagcgtacgaccgtacgtaggtccgtacgcccgtaacggcctacccggcccccgttcggtccctaccttccgttccttccccccgtaccctttccctccgttccgttcccg

SEQ ID NO: 178806 - DNA, 656 bp, Homo sapiens
  misc_feature: GYAE6OF01CV8C1.49.16.B05.1.454.CMB.1.raw
  modified_base (338)..(338): a, c, t, g, unknown or other
  misc_feature (338)..(338): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtcgtccccagacagacgccaggatcacctgtttgagatacgttacgaaaggaatagtggtcagttggtaccagcagaacgacgaaggccaggcccctgtcttgggtggtataagtaaagacagtgagacggccctacgaggactcccgtgaagcgattctcnggctcgagctcgacggacaaacgagtcacgttcgacatcagtggactccgagacaagaagacgaggacgtagaacttaattacgttagtacgtaatacgaagaccgaagaacgtaaccgggtggttaaccttaacggtcggggtttggtaccgggtaccggggtaagggaacccgaacggcgttaacggtacccggtccgtacgggttaccgacggacccgaaacgggtcccgtcccggaccccccgttcgggtcccgtaacccgttcccgttcccgtttacccccgaacccctttcccttccgtacccgtttccccg

SEQ ID NO: 178807 - DNA, 557 bp, Homo sapiens
  misc_feature: GYAE6OF01DEMPE.49.16.B05.1.454.CMB.1.raw
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtcagtgtccccaggacagacggccaggatcacctgtttggagatacgttacgaaaggaatatggtcattggtaccagcagaagacaggccaggccctgtcttggtgtatataaagacagtgagaggccctagagggactccctgagcgattctcgtggctccacgctacgaggacaacagtcacgtttgaccatcgagtgagtcaggcagaagacgaggctgactattatgtanaatcancagactacgggtgtacgttagtcgggtgttcggcggaaggaccagctacgtacgtcgtacgtacgacgacccgaacggtcctaccgcccccgtcggtcccgtacttccgttccgttaccccctacctccccttctccgttcccg

SEQ ID NO: 178808 - DNA, 713 bp, Homo sapiens
  misc_feature: GYAE6OF01C3K2G.49.16.B05.1.454.CMB.1.raw
  modified_base (290)..(290): a, c, t, g, unknown or other
  misc_feature (290)..(290): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggccctgtcttggtgtatataaaganagtgagaggccctgagggtatcccgtagacggcgtatttccgttcgtcggtcctaccgacgtctacggaacggaacaaacgtacgtccgtaacggtttcgaacctatacgaggtcgggacgtccgaggacaaggaaggacggaggtactaggaacctttaagtttagttacgtaacaagttcaaggtaccgaacggaacccgtaccggggtttgttaaccgtttaaggttcgggggtttacggttaccggggaccggggtaacggggtaacccaagggtcccgttaacggacccggttaccggtacggtaccgacccggacccggaacggtcccgtacccgtccccccggttacgggtaccctaccgtttacccgtttcccgttacccccccacccttttccccctcgttccccgttccccgg

SEQ ID NO: 178809 - DNA, 704 bp, Homo sapiens
  misc_feature: GYAE6OF01CMLDC.49.16.B05.1.454.CMB.1.raw
  modified_base (378)..(378): a, c, t, g, unknown or other
  misc_feature (378)..(378): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagccaccctcggtgtcagtgtccccaggacagacggccaggatcactgtttggatatacgttacgaaagatatgtcattggacagcagaagacaggccacggtcccctgtcgttggtggtaataagtaaaagactagtgagacggccctagaggggtactcccgtagacgtcgtactttccgtcgtggcctccgaagtcctacggaagggaaccaaacncggtacctaacggttacgaacctaagtccgtaggtacggacgtaccgaaggacaaggaacggaacggagtacgtagaacgttaatttacgttagtaactaacgtcgaagacaacgtaccgtaccgggttaggttacgtttaggttcgggttacgggttccgggaacgggtaccgggacgaaggtcccgttacggtacccggtaccgttacgggacctaccggacccggtaaacggtcccgtaccccggtccccggttccggtacctacccgtttacccttcccggtttacccccctaccctttaccccttccgttccctaccccgg

SEQ ID NO: 178810 - DNA, 737 bp, Homo sapiens
  misc_feature: GYAE6OF01CO2LM.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtcagtcgtccccaggacagacggccaggatcactgtttgatatacgtacgaaagatagtgtcagttcggaccagacagaacgacgacggccacggccccttgtccgttgggtaggtaataagtaaagactaggtagaggacggccctgacgggtactcccgtagacgcgtactttcgtcgtacggcctaccgacgtctacggaacggaaccaaacgtacgtaccgtaacgttacgacctagttacgagggtcggtaacgtaccgaggaccgaaggaacggaccgggagtaacgttagtaaccgttaagtttgttacggaactaacgtacgaaacggaccgtaacggtaaccggttaaccgggtttaggttaacgtttaaccgggtcgggtttaccggttaccggggaccgggtaaccgggtaccgtaacggtccgttacgggtaccccgttacggtacggttacccaaccgggtcccgtaaacggtccccgtacccgttaccccggtcggttacctaccgtccgttccccgttacccccgtaccctcccttcgtcccgtacccg

SEQ ID NO: 178811 - DNA, 730 bp, Homo sapiens
  misc_feature: GYAE6OF01CU399.49.16.B05.1.454.CMB.1.raw
  modified_base (206)..(206): a, c, t, g, unknown or other
  misc_feature (206)..(206): n is a, c, g, or t
tcagagtcgagagacacgaccggtgctcgatttagagctcacgtatttggggtttgggggaggaactgctcagttaggacccagacggaaccatggaagccccagcgcagcttctcttcctcctgctactctggctcccagagaccactggagaaatagcgatgacgcagtctccagccacctgtctgtgtcctccgaggggaaancgccaccctctcctgcagggccagtcagagtgtagcagcattacgcctagtacagcaacgtaaaccgtgaccgagtcctaccgagtcctctactacgttcgtagtcggtcgacctacgtacccgaacggaccgggtacccctaagtggttaccctcccgacggtaccgttacggttcgaacggtcggcgtaggttcgggtacgacggacgtagtacgtctactcgtaccactctacgacgcgtacgccgttagcgtacggtacgttaaggtaacgtttacgttttacggtaacggtttaacgtttttacgttaccgtttaggtaacctaagttaaccgttaaagtttaaaccgttttaaacggtttaccgttacggggttttacccgtttttacggggttttaccgggaccgggttaaaccggggttaacctaaacggttcggtaagggtacgttaacgttaacggaacggtacgttaacggttcggtacgtaccgtcgtaaccgtaactcgtttaccgttccg

SEQ ID NO: 178812 - DNA, 657 bp, Homo sapiens
  misc_feature: GYAE6OF01CHWB9.49.16.B05.1.454.CMB.1.raw
  modified_base (220)..(220): a, c, t, g, unknown or other
  misc_feature (220)..(220): n is a, c, g, or t
  modified_base (437)..(437): a, c, t, g, unknown or other
  misc_feature (437)..(437): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaggacagaccggccaaggatcacctgttttgganatacgttaacgaaaggaatagtggtcattaggtaccagcagaagacaggccacggtcccctgttcttggaggtaataagtaaagacagtgagacggccctcgagggactcccgtggacgtcgtattccgtctcggctccacgtctaccgagggaaccaacgtaggtacctaacgttcgaaccatcgaggtggacgtccgaaggctaaggaagacggngtctacgacttatttattcgtactaatcgaagtcaacgccgtaccgggttagttaacttaggtcgggttacggttcgggaccggggtaggtacccgagccgttaccggaccgttcgtacggtccgacgtcccgtaacggccgtacccggtcccccgttcggacccttaccttcccggttccctaccccccgtacccctcccgttcccttccgttaccccg

SEQ ID NO: 178813 - DNA, 624 bp, Homo sapiens
  misc_feature: GYAE6OF01DAHDU.49.16.B05.1.454.CMB.1.raw
  modified_base (171)..(171): a, c, t, g, unknown or other
  misc_feature (171)..(171): n is a, c, g, or t
  modified_base (210)..(210): a, c, t, g, unknown or other
  misc_feature (210)..(210): n is a, c, g, or t
  modified_base (286)..(286): a, c, t, g, unknown or other
  misc_feature (286)..(286): n is a, c, g, or t
tcagagtcgagagacacgaccggtgctcgatttagagctcacgtaagggggtgggtccaggaggcagaactctgggtgtctcaccatggcctggatccctctacttcctcccctctcactctctgcacaggttctgagcctctatgagctgacacacgccacccgtcggtntcagtcgtcccaggacaggacgcagactcacttgttganatacgtaagaagatatgtacattcgacagcagagacaggccacggtccctagtcgtggtgtaataagaaagacagngagaccgacctggaacggtacttccgaggacgtcgtacttactcgtacgctaccgagtaccgacggaacggaaccaaacgtacggtactacggttagaaccagtacgaggtacggacgtaccgaggaacagaaggacggagtacagtaactatttacgtaagtacaacgtacagacctagaccgtcgggttagttactacggtcgggtacgtcgggacggaacggtacaagcgtacgtaccgtcgtaaggtaccacggaccctaggtcccgacccgtaccccggtggtaccctcttacccgttcgttaacccccgtccctttactcccgttacgtacg

SEQ ID NO: 178814 - DNA, 843 bp, Homo sapiens
  misc_feature: GYAE6OF01CMW52.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagccaccctggtgtcagtcgtccccaggacaggacggccaggactcaccttgtttggatatacgttaacgaaaggtatatggtcagttggtaccagcaagaagcaggccaggccctgtcgttggtcggtataagtaaacgacaggtgagacggcctagacgggtctcccgtgacgacgtactttccgtcgtcgggccttccgacgcttacggaagggaactaaacgacggtcctaacggtttacggaaccctagttacgtaaggtcggaaacggttcccgaagggaccgtaaggaaaccgggtaacggaacgggtcccgttaaggtaaaccctttaaggttttaaacgtttcgggttaaacctaaagttacccggaaacggtacgtaaaccggtaaaccgtaccccgggggttttaaggttaaccgtttaaaccggggttcggggtttaccgggttaaccgggggtacccggggtaaacgggtaaccccgtaaacgggtccgttaccgggtaaccccgttccgggttaaaccgggttaccgaaaccgggtaccccgtaaacggggtcccgtaccccgggttacccccccgttcgggttaaccccgttacccgtttacccgtttaccccgggtttaccccccctaaacccccgttttccccgttcccgtttaccccgtttcccgg

SEQ ID NO: 178815 - DNA, 708 bp, Homo sapiens
  misc_feature: GYAE6OF01C6YTG.49.16.B05.1.454.CMB.1.raw
  modified_base (180)..(180): a, c, t, g, unknown or other
  misc_feature (180)..(180): n is a, c, g, or t
  modified_base (642)..(642): a, c, t, g, unknown or other
  misc_feature (642)..(642): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctggaggcctcctatgacgctgacacacgcccacccgttcgggtntcgagtcgtaccccgagggacaggaccggtccaggactccgtacctttgggttttaggagtaacgttaacggttaaacggaaaaggtaatagttggtactagtttcggaaccagacgaaggaagaccgacggccgaccggtcccgtgttcgttggtaggtaactaataaacgctaggagacggaccgtccgtagacgggtcctcccgtaggacggtctacttctcgtccggtacctaccgacggtacctacggacggaaaccaacgtaccgtacgtacggttacgacctagtcgaggtcgacgtcgaaggtacaagggacggacgtaggtacgtagtacttatttaagtcgtaactatcgagtaccgaacgtaccgtacggttaggttaccgttacgggttcgggttacgggtcgggacgggacggtacgacgtcgtaccgtcgtacgtcgacgcgtaccgngtccgtcccgccggttcgacctaccgttccgtaccccttcccctacccgttccctcgtccctaccg

SEQ ID NO: 178816 - DNA, 1081 bp, Homo sapiens
  misc_feature: GYAE6OF01BD7VU.49.16.B05.1.454.CMB.1.raw
tcagagtcgagagacacgaccggtgctcgatttagagctcacgtaagggggtgggtccgaggaggcagaactctgggtgtctcaccatggcctggatccctctacttctcccctcctcactctctgcacaggttctgaggcctcctagtcgagctgaccacgacgcccaccctcggtgtccacgttcgtccccagggacaggacggccaggacttcaccttggttttggagtacttaaccggttaacggaaaaggtaacttaagtcgggtacaagtttcgggtaaccctaggccgtaagaaaggaccaacgggcccaacgggcccccttaggtcctttggggtcggtaaactaacgttaaaaagaaccgaacggttagaacggaacggtcccccgttacgtaacggggggtaacttcccccgtttaggaacggtacccggtaaagttttcccgttaccgttcgggggtaccctttaccccgaaaggtcccgtttaccgaacgggggtaacctaaaccgtacggttacccgtaacggtttacgggaaaccctaagttacccgaacgggttcgggtaaccgttacccgaacggggtaccgtaaacgggaaacgggtaaccgggtaacgggtacccgttaacgggtaacccgttttaaagttttaacgttttacggggttaaccctaaaaccggtttaccgtaaacggttacccggtaaacgggttaaaccccggtaaccccggggggtttttaacgggtttaaacccggtttttaaaccgggtttaccggggggttaaccgggtttttaaccccggggggaaaccggggtaaacccggggggtaaaccccgtaaacggggttaccccgttaaccggggttaaccccggtttaacccgggtttaaccggggttaccccggtaaaccggtaccccccgggtaaaacggggttccctttaccccggggtaaccccccccggtttcggggttaccccctaacccggtttaacccccgtttccccggtttaccccccccgggtaacccccttttcccccggtttacccgttccccgttttacccccgg

SEQ ID NO: 178817 - DNA, 719 bp, Homo sapiens
  misc_feature: GYAE6OF01DOHQU.49.16.B05.1.454.CMB.1.raw
  modified_base (216)..(216): a, c, t, g, unknown or other
  misc_feature (216)..(216): n is a, c, g, or t
  modified_base (676)..(676): a, c, t, g, unknown or other
  misc_feature (676)..(676): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaaggacagacggccaggatcactgtttganatacgttaagaaagaatatggtctagttggtaccagcaagaagacaaggccaggcccctgtcgttggtaggtataataaaagcagtggagaggccctagagggactcccgtagaagcgtattcctactggcctccgagctacgaagggacaaacgcgtacacgttacgaaccctgtagacggtggtaactccgaggaccaaaggtaacggacggacgtacgtacggtaacttaagtttacgttacgttacaaacgttacgtacgtaaccgaaacggtaaccgtaacccggggtttaggttaacccgttttagggttcggggtttacgggttacggggtaaccggggaacgggtaaacccaaacgggtaccgtaccggtaccccggttaaccgtacgggtaccgtaaccggtacccgaaacgggtcccgtacccggtccccccggttcggtacccgtaccnccgtttaccccgtccccgtaccccttcgttccctcgttccccg

SEQ ID NO: 178818 - DNA, 601 bp, Homo sapiens
  misc_feature: GYAE6OF01CJ7NC.49.16.B05.1.454.CMB.1.raw
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaggacagacggccaggatcactgtttggagatacgttacgaaagaatatggtcattggtaccagcagaagacaggccaggccctgtcttggtaggtaataagtaaagacagtgaagacggccctcgagggactcccgtagacgcgatttctgtcggctaccagctcaggacaaacngtcacggtnaccatcgagtggacgtaccaaggcaaaggaagacgacgtactagaaatagtttaattgtacaaatcaagcaacgaccaccgggttgtaactttagcgggttagtcggggcggaagggaccaagcgtagtaccgtctagggacacggacccgaaagggccctacggccccccgtcgggtacctacgttaccgttcggtttaccccccacccttcccttccgttctacccgg

SEQ ID NO: 178819 - DNA, 743 bp, Homo sapiens
  misc_feature: GYAE6OF01B6Z7I.49.16.B05.1.454.CMB.1.raw
  modified_base (379)..(379): a, c, t, g, unknown or other
  misc_feature (379)..(379): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtcagtcgtccccaggacaggacggccaggatccgaccttggttttggagattaacgttaacgaaaggatatggtacagttaggtaccagacaagaagacacggccacggcccctgtcgttggtgtatagtaaacgcagtgagacggccctacgaggctcccgtgacgtcgattccgtgtcggcctaccgaagtcggtacggaaccnccggcccaccgtcgccgtaccgagtccgaggggtacgaacgggcggagtacggacgggaccgtatagtactcgtgtacgtaggtcggtagggtagtaggtagttggtcggtaccgttcgggttaccgggggttggttaccggggacggggtacgggtaaccgtaacgggttacgggtacccgggtttacggtttcgggtaacccgtcgggtacccccggaaacgggtcccgttaccccggtccccccggttaccgggttaccctaccgttcccgtttacccccggttaccccccttaccccgtccccctttaccgttcccgttaccccgttaccggttaaccctccgggttacggacccggggg

SEQ ID NO: 178820 - DNA, 810 bp, Homo sapiens
  misc_feature: GYAE6OF01AQXZR.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacacgcccaccctcggtgtcagtcgtccccaggacagacggccaggatcactgtttggagatacgttaacgaaaggaatatggtcagttggtaccagcaaggaagacgacggcccacggtccccgtagttccgttgggtaggtaataagtaaaagacgaggtaggaacgacggccctacgagggacctcccgtagacgcgtatttcctcgtggcctccagtccgtacgacgggaacaacgacgtaccgtaacggttacgaacccgaagttccgaagggttacgggtaccgtaacccgagggaccgaaagggaaaccgggaccgggaaggtaccgttaacgtaacgtttaaagtttacggtttaagtaacctaaacgttaccgaaacggtccgaaaccgtacggttaacccggggtttaggtttaaccgtttaacgggttcgggggttaacgggttccggggaccggggtaaacggggtaacccgtaaggtccgttacgggtaaccccggttacgttaaccgggtacgaccccggtaacccggtaaccgggtcccccgttacccggtccccccggttcggttaccccgttacccgttcccggtttccccggttaccccccgttccccgtccctttcccgttccctttaccccgg

SEQ ID NO: 178821 - DNA, 749 bp, Homo sapiens
  misc_feature: GYAE6OF01D5ELJ.49.16.B05.1.454.CMB.1.raw
  modified_base (172)..(172): a, c, t, g, unknown or other
  misc_feature (172)..(172): n is a, c, g, or t
tcagagtcgagagacacgaccggtgctcgatttagagctcacgtaagggggtgggtccaggaggcagaactctgggtgtctcaccatggcctggatccctctacttcctccccctctcactctctgcacaggttctgaggcctcctatgagctgacacagccaccctcggtntcagtcgtccccaggacagacggccaggactcaccgttggttttggagtatacgttaacgaaaggtaatatggtctagttggtaccagacagaagacaggccgacggtccctgttccgttggtagtaataataaagacagtaggacggacggccctaggaaggggtacctccgtaggacgtccggtatttcgtccgtcggctaccaggtcctacggaacgggaacaaacgtagtaccgtaacgtttccgaaccgtactacgtagggttacggaaccgttacccggaaggtacccgaaaggaaccggaacggtacggtaaccgttagtaaacttaagttttacgttacggtaactaaacgttcgaacgtacgaacgaaccggttaccgggtttaggttaactttcggtacggggttcgttaccgggggacggtaacgggaaccgtacggtcgttaacccgaccgtacgtacggtaccgaccgtaaccgacgggtaccctcccggcccccggttcggtacccgtcctttacccggtcccggttacccccgtcccccgtcttccccgttccgttaccccg

SEQ ID NO: 178822 - DNA, 778 bp, Homo sapiens
  misc_feature: GYAE6OF01CLNMX.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctctcactctctgcacaggttctgaggcctcctatgagctgacacagcccaccctggtgtcagtcgtccccaggacagacggccaggatcactgtttgagatacgttaacgaaaggatagtggtcagttgaccagcagaagacacggccacggcccctgtcttggtaggtataataaagacaggtgaggacggccctgaggactcccgtgacgcgtattcgtcgtacggtcctaccgacggtcttacggaacgggaacctaaacgtacgttaccgtacggtttacgaacccgtaagttaccgaagggttacgggtaacggttaccccgaagggtaacccgaaggggaaacggaaccgggaacgggtacgtttaacggtaaacctttaaagttttaacgtttacggtaaaccgtaaacgtaccgaacggtccgaaaccggtaaccggtaacccggggtttacggtttaaccgtttaaccgggttcggggttacgggttacccggggacgggtaaccgggtaccgtaacggtccgtacggtacccgttaccggtacggtccgaaccggtacccgtaacggtcccgtcccggtaccccccgttcggtaccctaccgttaccccgtcccgtttaccccccacccctttcccgttcccgtcccgttacccg

SEQ ID NO: 178823 - DNA, 715 bp, Homo sapiens
  misc_feature: GYAE6OF01BHZIL.49.16.B05.1.454.CMB.1.raw
  modified_base (214)..(214): a, c, t, g, unknown or other
  misc_feature (214)..(214): n is a, c, g, or t
tcagagtcgagagacacgaccggtgctcgatttagagctcacgtaagggggtgggtccaggaggcagaactctgggtgtctcaccatggcctggatccctctacttctccccctctcactctctgcacaggttctgaggcctcctatgagctgacacagccaccctggtgtcagtcgtccccaggacagacggccaggactcacttgtttgganatacgtacgaaaggaatatggtcattggtaccagcagaagacgaggccacggcccctgtcgttggtgtatataaagacagtgagcggcctcgagggactcccgtggacgtccgtattcctcgtcggcctccagcctacgaacgggaaccaacgtacgtaccgacggtttacgacctagtacgaggtcggacgtccgaaggacgaaggaacgacggtacggtcttacgtaacgttaatttagttcgtaataaacgttcaacggaccgaacgtacccgtaaccgggtttagttaaccgtttagggttacggggttcggttaccgggggaccgggtaacggggtaacccgtaaggttacccggttacccgggacccggttaccgtaacgggtccgtaccggaaccccgtaacgggtccctccccgggtacccccgttcgggtaccctcccgttcccgttccccgttaccccctaacccccgttccttccccgttccgttccccg

SEQ ID NO: 178824 - DNA, 798 bp, Homo sapiens
  misc_feature: GYAE6OF01CE1K0.49.16.B05.1.454.CMB.1.raw
  modified_base (668)..(668): a, c, t, g, unknown or other
  misc_feature (668)..(668): n is a, c, g, or t
  modified_base (764)..(764): a, c, t, g, unknown or other
  misc_feature (764)..(764): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacacgccaccctcggtgtcagtcgtccccaggacagacggccaggtactcctaccttggttttaggagtacttaacggttaacgaaaaggtattagtggtactagtttcgggaaccagacaaggaacgacgacggcccgacggtccccttgttcgttgggtaggtaataaataaaaggctaaggtcggaaggtaccggtacccctaggacggggtaccttcccgtaggacggtcgtactttccgtcgtacggtcctaccgacgtctaacggaacggaactaaacgtagtaccgtacgttcgaacctagtcgagtacggtacgtaccggaggaccgaaggaacgacggaggtactaacgtactttaatttgtacgtaacttaacgacgacgaccgaacgtaccgtaaccgggttggttaacgttcggttacgggggttccggttacgggaccggggtaaacgggtaccgtaacggtcccgttacgggtccccgtacgggttaccgggaaccncccggtaaccccgggtcggttacccccgttcccgggaccccccgtttccgggaacccttaccccgtttcccggtttacccccgtttaacccccccnccccgttttacccttcccgtttccccgttaccgg

SEQ ID NO: 178825 - DNA, 848 bp, Homo sapiens
  misc_feature: GYAE6OF01CRG77.49.16.B05.1.454.CMB.1.raw
  modified_base (217)..(217): a, c, t, g, unknown or other
  misc_feature (217)..(217): n is a, c, g, or t
  modified_base (463)..(463): a, c, t, g, unknown or other
  misc_feature (463)..(463): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctggtgtcagtcgtccccaggacagacggccaggatcacgttgtttgganatacgttaacgaaagatagtggtctagttacggtaccagacgaagtaagacgacggacccgacggtcccccgtgttccgttgggttaggttaataataaaggaacgtaggtaggaaggaccgggccccttacggacggggtaaccttcccgtaggacggtccgtatttccgtcgtacggtccttaccgacggtcttaccggaacggtaaccaaacgtacgtccgtaacggtttcgaaccagtacgnggtaggacgtaccgaggacgaaggaacggacggtaggccgtaataacgtttaagtttacgtttagtaaccgaacgttcgaacgtaaccgtaaccgggtaaaccgttcccgggggtttaaacggtttaaccggtttaggggtttaccgggggtttacggtacccgggggtaacggggaaccggggttaaccgaaccgggttacccgttaccgggtacccggttaacccggttacggtaacccgacccgggtaaccccgtaacggggtccccctacccggtttacccccccgggttcggtaccccgttacccgtttcccccgttacccccggttttacccccccttaaccccgttttcccccggttacctttcccgttaaaccccgg

SEQ ID NO: 178826 - DNA, 660 bp, Homo sapiens
  misc_feature: GYAE6OF01BBML4.49.16.B05.1.454.CMB.1.raw
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaggacagacggccaggactccacttgtttggagtatacgttaacgaaaggtaatagtggtactagttcggtaaccagacaagaagacgacggccacggccctgtcgttggtacgtatagtaaagctagtgagacgcctcgaggtacctcccgtggacgcgtacttcctcgtcggcctcgagtcacgacggacaacgngtacacggttacgaactntcgaggtcggacgtcgaggacaagagacggagctagtaacttaattacgtagtaacctaaattaccgaaacgacgaaccgtaacccgttagtttacggttaacctttagtacgttacgtaacggtaacgtcggaccgtaacgtaacggttcccgaccgttccgggaggtccgaccgaccccgaacggtaccccaaccctcggtcctacctccgttccctcccggttccccctacccgttccttacccgtccgttacccg

SEQ ID NO: 178827 - DNA, 722 bp, Homo sapiens
  misc_feature: GYAE6OF01A60Q5.49.16.B05.1.454.CMB.1.raw
  modified_base (216)..(216): a, c, t, g, unknown or other
  misc_feature (216)..(216): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtcagtcgtccccaggacagacggccaggatcactgttttgganattacgttaacgaaaggatatggtctagttggtaccagcagaagacacggccaggcccctgtcgttgggtgtataataaagacagtgagacggccctgagggactcccgtgacgctattcctcgtcggcctccgagcctacggaacgggaaccaaacggtacgtaccgtaacgtttcggaaccctagtaccgtagggtcgggtacgtacccggaaggtacgaaggtaacggaacgggtacgggtacgttaacggtaaccttaagttttaacgttacgtactaaacgtacgacgtaacgaacggtaccgtaccgggttacggttaacgtttacgggttcgggttcggtttaaccgggacgggtaacgggaccgtaacggtcgtaccgggtacccgttacggtaacggtaccgaccgtaccggaaccggtccgtaccccggtccccgttcggtaccctaccttcccgttacccgttccccgttacccctcccttccttcccgttaccg

SEQ ID NO: 178828 - DNA, 756 bp, Homo sapiens
  misc_feature: GYAE6OF01B26T3.49.16.B05.1.454.CMB.1.raw
  modified_base (341)..(341): a, c, t, g, unknown or other
  misc_feature (341)..(341): n is a, c, g, or t
  modified_base (391)..(391): a, c, t, g, unknown or other
  misc_feature (391)..(391): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctggacggccctacctatgagctagaccacacgcccacccgtcggtgtacagtccgtccccgaggacacggacggccaggactccgtaccgtttggtttcggaagtaacgttaacggttaacggaaaaggtaattaggtcggtactagtttcggacagacaaggaagacgacggccaccggtcccttggtcgttggtagtaataanaagcagtgagaccgccgtagacgggcctccgtgacgtctacttctacggnggtcccacgtacgcgtacgaacggactaacgacggttcgaccggttacaacccgttagtacggtagggttaccgggacctaccggaacggtacgaacggaacggtacgggaacgtcgttaacgttacgtttaatttagtccgtaactaacgtcgtaacggcgtaacggtaccggttaccggttagttaccgttacggggtcgggttaccgggtcggggaacccggtaagggtaccaaggttcccggtaacgttcccgggtaagtacggtacacccgggtacccggtacggtccgtaccccccggtacccggttcgacccgtcttccccgttaccggaccccctcccttcgttcccgttctacccg

SEQ ID NO: 178829 - DNA, 696 bp, Homo sapiens
  misc_feature: GYAE6OF01C2RAU.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaggacaggacggccaggatcacctgttttggagtatacgttaacgaaaggaatatggtactagttggtaccagacaagagacaggccaggccctgtcttggtgtatagtaaagacagtgagaacggcctagacgggtactcccgtagacgtcgtactttcctacgttcggccttaccgaagccgttacgaacgggtaaccaaacgtacgtaccgtacgtttacgaacctataccgagggtacggacgtaccgaaggacgaacggaacggacggaggtactaggtaacttaagtttagtagtaacaatcgaagacgtaagaccggtacgggttacggttactaggttcggggttacgttcggggaaccggtagggtaacccaggtccttaacggcccgttacggtaacggtaccaccgggacccgtaacgggtcctacccggtcccccggttacggtaccctacgttccgttaccccgttaccccaccccgtttacctccgtcccttaccg

SEQ ID NO: 178830 - DNA, 783 bp, Homo sapiens
  misc_feature: GYAE6OF01DNDVJ.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgacggcctcctatgagctgacacacgcccacccgtggtgtcagtcgtcccaggacagacgccagatcacttgtttggagtatacgttaacgaaaggtatagtggtactattacggtaccagcaagaagacgacggccgacggtcccctggttcgttggtacggtaataagtaaacgacgtaggtcggaaggaccggtccccgtacggacgggtaaccttccccgtaggtacggtacggtacttttccgtccgtacggtccctaccgacgtcgtaccggaaggaaccaaacgtacgtaccgtacgttacgaccattcgaggtcggtacgtaccggaagacgaaggaacggaacggacggtacgttaagtaacctttaaagtttacgttacgtaaccgtaaacgttaccgaacgtaaccgtaaaccgggtaccgttaaccggggtttaacggtttaacccgtttaggggttccgggttacgggtttacggggaaccgggtaacgggtaaccgaacggttccgtaaccgttaccggtaccggttacgtacgacccgtaacccgacggtcccgtcccgtacccccggtcggttacccctcgttaccccgttcccgttacccccgcccctttcccgttccgtcccttacccgg

SEQ ID NO: 178831 - DNA, 712 bp, Homo sapiens
  misc_feature: GYAE6OF01A0LMN.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggcgtcagtgtccccaggacagacggccaggatcacctgtttggagatacgttacgaaaggaatatggtcagttggtacagcagaagacaggccaggccctgtcttggtgtatataaagacagtgagacggccctcgagggtactcccgtgacgcggtattctcgtggctccgagctacgaagggaaccaaactacggtctacgttacgaaccatcgtaggtcggacgtccagggacaggaagtacggaggtctaggtaacttattagttgtacaaagtcacgtacgaagtacccgtacgggttacggttacgttacggttacggggtcggtttaccggggacgggaaccggggtaaccgaacggtccgttaccgggaccccgtttaccggttaacgggtacccaaaccgggtaccccggtaacgggttaccccgtcccgggtaccccccccgtttaccgggggttaccctaacccgtttcccgggttccggttttaccccccccggtcccccttaccccgtttcccgttcccctttacccggg

SEQ ID NO: 178832 - DNA, 935 bp, Homo sapiens
  misc_feature: GYAE6OF01B277D.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacacgcccaccctcggtgtcacgtcgtccccgaggacaggacggccaggatcgaccttggtttgagattacgtaacgaaagtatatggtctagttcggtaaccaggcaagaacgacgacggacccacggtccccttggttcgttaggggtgttaataagtaaaagacctacgtggacgaccggccctacggacgggtactcccgtgacgtcgtattcctcgtggcctacgtagggtacgaggggaacctaaccgggtactaacgtacggttacggaccctaagtccgtaaggggttcgggaaaccgttcccggaaggggtaccgtaaagggggaaccgggggtaaccggacggggtaccgttaacggtaaccgtttaagttttaacggtttacggtaacctaaaccgtaaaccgaaaccgaaacgttaacccgtaaaccgtttaacgttttacgggtttaaaccttttacggttacccgtttaccgggtttaaccggtaaaccggtttccggaaacccccgggttaaacccggttaaccgggtaccccgttaacccccggggtttacccgggtaccggggttaaaccccgaacccgggttaaaccccccggaaaaaccccggggttcccccccctaaaaacccccccgggttaacgtttacccccggttaccccgttaaccccgttttaccccgtttacccccggttaccccccccctttaaccccccgtttccccttttaacccccgttttccccttaacccccggtttaccccggg

SEQ ID NO: 178833 - DNA, 815 bp, Homo sapiens
  misc_feature: GYAE6OF01BAGKL.49.16.B05.1.454.CMB.1.raw
  modified_base (794)..(794): a, c, t, g, unknown or other
  misc_feature (794)..(794): n is a, c, g, or t
tcagagtcgagagacacgaccggtgctcgatttagagctcacgtagttggggtttgggggaggaactgctcagttaggacccagacggaacatggaacgcccagcgcagcttctcttcctcctgctactctggcctccgagacgacctacgtagggaagaaacgtacggacgaagtcggaccggactacgttccctaccgacggcccctacccgttggttccttggttaccgttaccgtaccgggaaagggggaaaacgccgcccctaacccttccgtccgtacggaccggaccggggtacctaaggtccgaggtaggtcgttaacgctacgtactaaacgttcggtccgtacggtaaccacgaacgtaaccgtaaccgtcggaccgtaccggacccgtacccgcggttacccctaccgtacgttaacgttccgttagggtccggacctaccgtaccgacccgtaaccgggtaccggtccccttaagttccgggtaacctaccggacgggtaccggtacgtacggtcggtacgtcgggtacggttcgggtacggacggtacgtaacgttccgtacccgtacgtccgtaacctacggtaccgcgtacgtaccgtccgtccgtacggtactacggttacgaacgtttaggtttaccttcggttacgtttaacgtttacgttaccgtacgtaggtaactagttaattaacgttcgttacggttcgtttacggtttcggtacggacgtaccggtaatcggtaggtagtagtacgtagtacggacgtacgtgacccgtntacccagtacgtcgtgttacc

SEQ ID NO: 178834 - DNA, 873 bp, Homo sapiens
  misc_feature: GYAE6OF01BLC8I.49.16.B05.1.454.CMB.1.raw
  modified_base (858)..(858): a, c, t, g, unknown or other
  misc_feature (858)..(858): n is a, c, g, or t
tcagagtcgagagacacgaccggtgctcgatttagagctcacgtaagggggtgggtccagggaggcagaactctgggtgtctcaccatggcctggatccctctacttcctccccctcctcactctctgcactaggttcgtaggacggtcccttcctaagtgtagttagaacaccgacgccccacccgttcggtgtcacgttccgaccccgaggtaccgacggaccggtaccgaggtactcctaccgtttggttttaggaagtacgttaacggttaaacggtaaagtaagttagtcggtacttaaggtttaccggacgaagacgaaagaacgaccgacggacccacgggtccccttgttacggttaggttaggtaataaaggtaaagactaggtacgtaacgggaccggtccccgtaagggaacggtacccgttcccgaggtacggtaccgttacgtttacccgttccggtaccgtaccgttaaccgccgtacgtaaccgggaaccgtaacctaaaccggtacgtaccggttaaacctcggtaaccctacgtaacggtacgggtacgtaccggtaacgtaacgggaaaccgtaagggaaacccggtaggtaccggtcgtaaccggttaaactttagttaaagttcttaacgtaagttcggaaccgtaacgaacggttaccggttaaccggttacggtttacgtttacggggtacggggttccggtaacggggaccggaaaccggtacctaaggttccggttaaccgtaccggttacgacggtaccacccgtacgaccggttccgtcccgttcccggtacctccgtacccgttccgttaccccgtccctcccttaccctnttcccgtcgtacccg

SEQ ID NO: 178835 - DNA, 728 bp, Homo sapiens
  misc_feature: GYAE6OF01D8KDQ.49.16.B05.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagagtcgagagacacgaccggtgctcgatttagagctcacgtagttggggtttgggggaggaactgctcagttaggacccagacggaaccatggaacgccccagcgcagcttctcttcctcctgctactctggctcccagagaccactggagaaataggcgatggacgctagtcctccagcccaccctggtctggtntccgtaccgaaggggaaacncgcccacccgtctcctgcgacgggccagtcagtacgttgtagcacgctaactcgcgtgaccagcaacgaaccgtcggccaggccncccgaggtcctccgtcactcgtagtcggtcgcacgtccacggacggcctacgtcggtaccnccgacgtccgtaggtcaggtcgacgtaggtcgggtacggaggggactaggtaccgttacgtaacctccgttaccgaccgtacgtccgtaaacggcccctaacgggtcccttaacggtaaccgtacgttacggttaaacgtaaggttttccttttaaggtacccgtttaagttttacgttaccgtcggttaacgtaacggttacttaacgtttaaacgttaacgtttcgggttaccggtttaccgttttccgggttaagggaccccgggttaagggaacccgtagggtacgtacgggtacttaaccggaacgaggttaccgtacggttggaccgtacgaccgtaccaccttggtcccgtttacg

SEQ ID NO: 178836 - DNA, 813 bp, Homo sapiens
  misc_feature: GYAE6OF01CS3FM.49.16.B05.1.454.CMB.1.raw
  modified_base (180)..(180): a, c, t, g, unknown or other
  misc_feature (180)..(180): n is a, c, g, or t
tcagagtcgagagacacgaccggtgctcgatttagagctcacgtaagggggtgggtccaggaggcagaactcgtgggtgtctcaccatggcctggatccctctacttcctccccctctcactctctgcactaggttctggacggtcctctatgacgctcgacacacgcccacccgtggtntcagtcgtcccgaggacgacgaccggcgaggtactccgtacgttggtttacggagtaacgttaacggttaaacggaaaggtaacttagtacggttactacggtttacggtaaccaacggacgaaggaacggacgacggaccgaccggtcccgttaggttacggttaggttacgtaagtaaagtaaacggacgtaaggtaggacggacggtacccgtacggtacggtaccgttaccgagtacggtacgttacgttaccgtcgtcggtaccgtaccgacgtacgaaccggaacggtaactaacggtacgtacgtaacgtacgacgtaacgtcggtacgggtacggtacgacggaacggaacgtaacggaacggtacggtacgtacgttaagttaactttagttacgttacgtaacacgtacgacgtacgtaacgtaccggttacggtttacgttacggttacgggttcgggttacgggtaccgggacggtacgggtacgtacgtaccggttaccgtaccggtaccggtaaccggtacgtacccggaccgtacggtcccggtacccggtacccggttaccgtacccttacccgttccccgttacccgtaccccttccgttccctccgttccgtccg

SEQ ID NO: 178837 - DNA, 860 bp, Homo sapiens
  misc_feature: GYAE6OF01DFH66.49.16.B05.1.454.CMB.1.raw
  modified_base (172)..(172): a, c, t, g, unknown or other
  misc_feature (172)..(172): n is a, c, g, or t
tcagagtcgagagacacgaccggtgctcgatttagagctcacgtaagggggtgggtccaggaggcagaactctgggtgtctcaccatggcctggatccctctacttctccccctctcactctctgcacaggttctgcggcctctatgagctgacacacgcccacccgtggtntcagtcgtcccagacagcggccaggacctctgttgtagatacgtaacgaaagtaatagtgtgactagtacacgagagaagacgaggaccgaccgaccgtccgttgttcggttaggttaataaagttaaacgaaagtacggtaggaacggtacgggaccccggtaccggtaacggaccggtttacccgtacggaaggtaccggttactttaccggttttcccgttcgggtacccggttaccccaaccggtccgttaaccggaaacggggaaacccggttaaaacctaaccggtttaacccgtacggtttaccggtaaacctaaccgttaacgttacgggtcggggttaaaccgggtacccgaacgggaccggaaacggttaaacgggaaccgggtaacgggtaccggttaagttaacggtttaacttttaacggtttataaccgttaaagtacgtaacggtacggaaccggtaaccgtaaccgggtttaacgggtttaccggtttaacgggtttccgggttacggggttacgggtacgggaccggggtaacgaccggtacgtccgtaaccgtacccggttacggtaccgaccgtaccggaccgtcccggtacccgtccccgttcgtaccgcccgttacccttacccgtaccccgttccccgttcccttaccgttcccgtccttacccgg

SEQ ID NO: 178838 - DNA, 875 bp, Homo sapiens
  misc_feature: GYAE6OF01CJR5S.49.16.B05.1.454.CMB.1.raw
  modified_base (169)..(169): a, c, t, g, unknown or other
  misc_feature (169)..(169): n is a, c, g, or t
tcagagtcgagagacacgaccggtgctcgatttagagctcacgtatttggggtttgggggaggaactgctcagttaggacccagacggaaccatggaacgccccagcgcagcttctccttcctcctgccttactcgtcggcctcccaagacgaacccacgtagggaaanaaaagtagcgaatacggaaccgctaacgtcctaccgaccgcccctaacccgttgtcgtgttcgttaccgaaccgggaagggggaaaactaccgcccctaacccgttccgtacccggttagggtaccgggacccgttaagtacgaaggttacggtttagtaacgcgaacgtaccttaaacggttcggaccgtaggtaccaacgaccgaaacggtaaccgtcggaccgaccggtccgtacccgaggtccttccgtactacgtttacgtacggtcggttaccacctaccgtaccccgaacggtaccggacccgttacggtaccggtacctacccgaacggtaccgtaggttacgacggtgtacgggtaggttccggtggaacgtagtacgtacctcaccgtcgacactacgcgaacgcctacgtccgttgacgtaagtacgtagttaaagttcgtttacgtagtttaacgttttagtacttcgaacgttactaaccggtttattaaagtttacgttccggtttaaggttttcccgggttttacccggttaacggggaacccgggttaaacgggtaacccggtagggtttaacccggtaacgggacttaaaacccgggtaaacggttaccggaacgttaaccggtagggtccccgtttaaaccgacccggttactaacgggttttacccttccgggttttaacccgtacc

SEQ ID NO: 178839 - DNA, 853 bp, Homo sapiens
  misc_feature: GYAE6OF01AT3PC.49.16.B05.1.454.CMB.1.raw
  modified_base (444)..(444): a, c, t, g, unknown or other
  misc_feature (444)..(444): n is a, c, g, or t
tcagagtcgagagacacgaccggtgctcgatttagagctcacgtaagggggtgggtccaggaggcagaactcgtgggtgtctcaccatggcctggatccctctacttcctccccctcctcactctctgcacaggttctggacggccctcctatggagctgacaccacgcccacccgtcgggttgtcgaggttccggtcccccgaagggaccaagggaccgggaccgaaggtactcctaaccgtttggttttagggaagtacttaacggtttaaaccggaaaagggtattagttcgggtctagtttcggtaaccaggacgaaggaacggacgacgggccgaccggtccccgtgtcgttagggtgttaataagtaaagacgtaggtagaggcggtccctaggacgggtacctccgtaggacgtcgtacttccgtcgtcgcctaccngtctacggacggaaccaacgtaccgttacgaccgttcgaaccgtactacggtagggtacggtacgtaccggacgggaccgtaagggaacggaacgggacggtacgtacgttaactttaagtttacgtttcgtaacttaaccgtacgacggaaaccgtacggtaacccggtacgggtttacgggttaacgggtttggttacccgggggtttcggggttaaccggggaccggggtacgggttaaccgggacggttaccggttaccggtaccccggtacggttacggaacccgtaccggaaccccggtacggtccccggtacccgtccccccgggttccgtacccgttcccgtttcccgttacccccgtttcccccgtacccccgtttcccttccccgttcccggttccccg

SEQ ID NO: 178840 - DNA, 497 bp, Homo sapiens
  misc_feature: GYAE6OF02JO6CP.49.16.B05.1.454.CMB.1.raw
  modified_base (347)..(347): a, c, t, g, unknown or other
  misc_feature (347)..(347): n is a, c, g, or t
tcagagtcgagagacacgaccggtgctcgatttagagctcacgtaaggggtgggtccaggaggcagaactctgggtgtctcaccatggcctggatccctctacttctccccctcctcactctctgcacaggttctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagctttgagaggccctcagggacccctgagcgattctctggctccagctcagggacaacngtcaccttgaccatcagtgagtccggcagaggacgaggctgactattactgtcagtccgcagacagcagtgcagttatgtcgtattcggcggaggactacgctgaccgtctaggtcacgccaaggcctacgcccctcggtcactcttccg

SEQ ID NO: 178841 - DNA, 526 bp, Homo sapiens
  misc_feature: GYAE6OF02H5W14.49.16.B05.1.454.CMB.1.raw
  modified_base (348)..(348): a, c, t, g, unknown or other
  misc_feature (348)..(348): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggcccctgtcttggtggtatataaagacagtgagaggccctcagggatccctgagcgattctctggctccagctcagggacaacngtcacgttgaccatcagtggagtccaggcagaagacgaggctgactattattgtcaatcagcagacaccggtgtacttagtcgggtgttcgggcggagggaccaagctgaccgtcctaggtcacgcccgaaggctcgccccctcggtccacgtctcgttccccgccctcctcctctcc

SEQ ID NO: 178842 - DNA, 561 bp, Homo sapiens
  misc_feature: GYAE6OF02GG1GU.49.16.B05.1.454.CMB.1.raw
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgtttggagatacgttacgaaaggatatggtcattggtaccagcagaagacaggccaggcccctgtcttggtggtatataaagacagtgagaggccctcagggatccctgagcgattctctggctccagctcaggacaacagtcacgttgaccatcagtggactacgngagagagagagngacgtactattatgtatananancgagacgtacggtagtactagtcgggttgtcgggacggacggtaacgacgtcgtacgtccgtacgtacgtacgaccgaccgacggtccgtcccgtccccgtcgtaccgtaccgttccgttccggttcccctcccgttcccttcctcccttcccg

SEQ ID NO: 178843 - DNA, 533 bp, Homo sapiens
  misc_feature: GYAE6OF02IZQKP.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcgagggactccctgagcgattctctggctcagctcaggacaacagtcacgttgaccatcagtggagtccaggcagaagacgaggctagactattattgtcaatcagcagacaccggtggtacttagtcgggttgttcgggcggagggaccaagcgtgaccgtcctaggtcacgcccgaaggcctcgccccgtcggtccacgtctcgttccccaccctcctcctctcccg

SEQ ID NO: 178844 - DNA, 530 bp, Homo sapiens
  misc_feature: GYAE6OF02GQGL9.49.16.B05.1.454.CMB.1.raw
  modified_base (351)..(351): a, c, t, g, unknown or other
  misc_feature (351)..(351): n is a, c, g, or t
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgttttggagatacgttacgaaaggaatatggtcattggcaccagcagaagacaggccaggcccctgtcttggtggtatataaagacagtgagaggccctcgagggactcccgtgagcgattctctggctccagctcagggacaacngtcacgttgaccatcagtggagtccaggcagaagacgaggctgactattactgtcagtccgcagacagcagtgctagttatgtcgtagttcgggcggaggactacgcgtagaccgtcgtaggtcacgacccgaaggcctccgccccgtcggtccaccgttcgtccgttcccctaccccg

SEQ ID NO: 178845 - DNA, 534 bp, Homo sapiens
  misc_feature: GYAE6OF02IMWL9.49.16.B05.1.454.CMB.1.raw
tcagagtcgagagacacgaccggtgctcgatttagagctcacgtaagggggtggggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcgaggacaacagtcacgttgaccatcagtggagtccaggcagaagacgaggctgactattattgtcaatcagcagacaccggtgtactagtcgggtgtcggcggagggaccaagctggaccgtcgtaggtcacgcccgaaggctccggcccccgtggtccaccgttcgtcgttccccaccctccttcctctcccg

SEQ ID NO: 178846 - DNA, 528 bp, Homo sapiens
  misc_feature: GYAE6OF02HOVXD.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcaggacaacagtcacgttgaccatcagtggagtccaggcagaagacgaggctgactattattgtcaatcagcagacaccggtgtacttagtcgggtgttcggcggagggaccgaagctggaccgtcctaggtcagcccaaggcctcgccccctcggtccacgtcgtcgttccccgccctcctcctccttcc

SEQ ID NO: 178847 - DNA, 522 bp, Homo sapiens
  misc_feature: GYAE6OF02HA2JG.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgtttggaaatacgttacgaaaggatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattatgtcaatcagcagacaccggtggtacttagtcgggtgttcgggcggagggaccaagctgaccgtctaggtcagcccaaggcctcgcccctcggcacctctcgttcccaccctcctcctctcctccg

SEQ ID NO: 178848 - DNA, 519 bp, Homo sapiens
  misc_feature: GYAE6OF02JB1P9.49.16.B05.1.454.CMB.1.raw
  modified_base (306)..(306): a, c, t, g, unknown or other
  misc_feature (306)..(306): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctnagggatcccgtgagcgattctctggctccagctcagggacaacagtcacgtttgaccatcagtggagtccaggcagaagacgaggctgactattattgtacaatcagcagacaccggtgtactagtcgggtgttcggcggaggaccaagctgaccgtcgtagtcagccgaaggctcgccccgtcgtcacgtctcgtcccacctcctcctctcc

SEQ ID NO: 178849 - DNA, 497 bp, Homo sapiens
  misc_feature: GYAE6OF02HKV17.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcgagggacccctgagcgattctctggctcagctcagcgacaacagtcacgttgaccatcagtggagtccgggcagaggacgaggctgactattactgtcagtcatcagacagtagtggctacttctgtcgtagttcggcggaggaccaagctagacccgtcgtaggtcacgcccgaaggctcgcccctcgg

SEQ ID NO: 178850 - DNA, 540 bp, Homo sapiens
  misc_feature: GYAE6OF02H837Q.49.16.B05.1.454.CMB.1.raw
  modified_base (215)..(215): a, c, t, g, unknown or other
  misc_feature (215)..(215): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagccaccctcggtgtcagtgtccccaggacagacggccaggatcacctgtttgganatacgttagaaaggaatatggtcattggtaccagcagaagacaggccaggcccctgtcttggtggtatataaaagacagtgagaggccctcagggatccctgagcgattctctggctccagctcaggacaacagtcacgttgaccaatcagtggagtccaggcaagaagacgaggctagactattatgtacaatcagcagacaccggtgtactagtcgggtgtcggcgagggaccaagctggaaccgtccgttaggccacggcccgaacggcgtcgtcccccgtcggtccacgttcgtcggttccccgccctccttcgccttccg

SEQ ID NO: 178851 - DNA, 531 bp, Homo sapiens
  misc_feature: GYAE6OF02FMH9M.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagagacgaggctgactattattgtacaatcagcagacaccggtgtacttagtcgggttgtcggcggacgggaccaagcgtgaccgtcgtaggtcacgcccgaaggctccgccccgtcggtccaccgttctcgttccccgccctcctcctctccg

SEQ ID NO: 178852 - DNA, 552 bp, Homo sapiens
  misc_feature: GYAE6OF02HGQ6Y.49.16.B05.1.454.CMB.1.raw
  modified_base (414)..(414): a, c, t, g, unknown or other
  misc_feature (414)..(414): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctgagggatcccgtgagcgattctctggctccagctcagggacaacagtcacgttgaccatcagtggagtccaggcagaagacgaggctgactattattgtacataaaacngacagacgaccggtgtacttagtcgggtgttcggcggagggaccgaagcgtcgaccgtccgtaggtccacgacccgaaggccgtcgcccccgtcggtcctaccgttcctccgttccccaccctcccttcctcctcccg

SEQ ID NO: 178853 - DNA, 520 bp, Homo sapiens
  misc_feature: GYAE6OF02FU886.49.16.B05.1.454.CMB.1.raw
  modified_base (348)..(348): a, c, t, g, unknown or other
  misc_feature (348)..(348): n is a, c, g, or t
  modified_base (507)..(507): a, c, t, g, unknown or other
  misc_feature (507)..(507): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggatatggtcattggtaccagcagaagacaggccaggcccctgtcttggtggtatataaagacagtgagaggccctgagggactcccgtgagcgattctctggctcagctcgaggacaacngtcacgttgaccatcagtggagtccgaggcagaagacgaggctgactattattgtacaatcagcagacaccggtgtacttagtcgggtgtcgggcggagggaccagctgaccgtcgtagtcacgcccaggcctcgccccgtcgtcactctcgttccccncctcctctctccg

SEQ ID NO: 178854 - DNA, 515 bp, Homo sapiens
  misc_feature: GYAE6OF02HT76R.49.16.B05.1.454.CMB.1.raw
  modified_base (305)..(305): a, c, t, g, unknown or other
  misc_feature (305)..(305): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttgtggtatataaagacagtgagaggccctnagggatccctgagcgattctctggctcagctcaggacaacagtcacgttgaccatcagtggagtccaggcagaagacgaggctgactattatgtataatcagcagactacgtgtacttagtcgggtgttcggcggaggaccaagcgtagaccgtccgtagcacgcccaaggctcgcccctcgtcacgtctcgtcccacccgtctctctcc

SEQ ID NO: 178855 - DNA, 551 bp, Homo sapiens
  misc_feature: GYAE6OF02IDEII.49.16.B05.1.454.CMB.1.raw
  modified_base (473)..(473): a, c, t, g, unknown or other
  misc_feature (473)..(473): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtcagtcgtccccaggacagacggccaggatcacctgtttggagatacgttagaaaggaatatggtcaattggtaccagcaagaagacaggccaggcccctgtcttggtggtaatataaaagcagtgagaggccctcagggactcctgagcgattctctggcctccagctacaggacaaacagtccagttgaccatcaaggtggagtccgaaggcaaggaagacgaggctagactattatgtacaatcaagcaagacacggtagtactagtcggttggtacggcggagggaaccaggtacncgtaccgtcgtaggtcacgacccgtaaggctaccgccccgtcggtacacgttctccgttcccgcccttctcctctccg

SEQ ID NO: 178856 - DNA, 544 bp, Homo sapiens
  misc_feature: GYAE6OF02GYWIO.49.16.B05.1.454.CMB.1.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (435)..(435): a, c, t, g, unknown or other
  misc_feature (435)..(435): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctnagggatccctgagcgattctctggctccagctcaggacaacngtcacgttgaccatcagtgagtccaggcagaagacgaggctgactattatgacatcagcagacacggtgtacttagtcggtgtcggnggaggacagcgtgacccgtcgacggtcacggacccagggccttccgcccccgttcggtccctaccgttccgtccggtttcccccgtccccttcccttccttcttccccg

SEQ ID NO: 178857 - DNA, 557 bp, Homo sapiens
  misc_feature: GYAE6OF02GK8XT.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtcccccaggacagacggccaggatcacctgttttggagatacgttaacgaaaggaatatggtcattggtaccagcagaagacaggccaggcccctgtcttggtggtatataaagacagtgagaggccctcgagggactcccgtgagcgattctctggctccagctcaggacaacagtcacgttgaccatcagtggagtccgaggcagaagacgaggctagactattattagtcaatcaagcagacaccgggtagttacttagtcgggttgttcgggcggagggaccaagctggacctcgtacgtcacgcccgaaggccgtccgcccccgttcggtacctaccgttcgttccgttccccgcccttccctctcccttcccg

SEQ ID NO: 178858 - DNA, 522 bp, Homo sapiens
  misc_feature: GYAE6OF02GKY7C.49.16.B05.1.454.CMB.1.raw
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
  modified_base (507)..(507): a, c, t, g, unknown or other
  misc_feature (507)..(507): n is a, c, g, or t
tcagagtcgagagacacgaccggtgctcgatttagagctcacgtaagggggtgggtccgaggaggcagaactctgggtgtctcaccatggcctggatccctctacttctcccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtgtatataaagacagtgagaggccctnagggatccctgagcgattctctggctccagctcgaggacaacagtcacgtttnaccatcagtggagtcaggcagaagacgaggctgactattatgtcaatcagcagacacggtgtacttagtcgggtgttcggcggaggaccaagctcgacgtctaggtcacggaccaacggctacgcccctcggtcacgtctcggttcccnccctacctctctccg

SEQ ID NO: 178859 - DNA, 562 bp, Homo sapiens
  misc_feature: GYAE6OF02JKD1V.49.16.B05.1.454.CMB.1.raw
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggcccctgtcttggtggtatataaagacagtgagaggccctnagggatcccngagcgattctctggctccagctcgaggacaacgagtcacgtttgaccatcagtggacgtcaggcagaagacgaggtctaggactagttatcggtacaatcagcagacctacggtgtacttagtcgggtgttcgggacgggaggtaaccaagtcgtacgccgttaccgtgtaccacggacccaagggccttccggccccgtcggtcctaccgtccttcgggttccccacccgttccctcgttcctccg

SEQ ID NO: 178860 - DNA, 537 bp, Homo sapiens
  misc_feature: GYAE6OF02HATI6.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggcccctgtcttggtggtatataaagacagtgagaggccctcagggactcccgtgagcgattctctggctccagctcagggacaacagtcacgttgaccatcagtggagtccaggcagaagacgaggctgactattattgtacaatcagcagacaccggtgtacttagtcgggtgttacggcggagggaccagctcggaccgtcgtagcacgacccgaaggcctccgcccctcggtccacttccgttcgttccccgccctccttcctcttcccg

SEQ ID NO: 178861 - DNA, 848 bp, Homo sapiens
  misc_feature: GYAE6OF02FFD27.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctggtgtcagtcgtccccaggacaggacggccaggatcaccttgtttaggagatacgttacgaagatatggtacagttggtaccagacagaacgacacggccacggtccctgttcttggtagtaataagtaaagctaggtgacggacggtccctagagggtacctccgtagacgtcgtacttctacgtcggcctaccgagtccgtacggacgggtaacctaacgtagttaccgtaacggttcggaacctacgtacgtagggttacgggaaccggtacccggaagggaacgaaacggggaacggtaccgggacgttaccgttaaggttaaaccttttaacgtttacgttacgtaaccgtaaacgtacggtaaccgggtaaccgtaaccggttaacccgggttaacccgggggtttacgggttttaaccggttttacgggggttaaccggggggtttacgggttacccgggggaaccggggaaacccgggtaacccgtaacgggttcccgtaaccggttacccccgttacgggtaaccgggtacccgacccgggaacccggtacccgggttacccgtacccccggtaccccccgggtttccggttaccccgttaccccggtttcccgtttcccccgggttaccccccgttccccgtttccccgttaccgttcccgtttaccccggg

SEQ ID NO: 178862 - DNA, 563 bp, Homo sapiens
  misc_feature: GYAE6OF02JKTX5.49.16.B05.1.454.CMB.1.raw
  modified_base (359)..(359): a, c, t, g, unknown or other
  misc_feature (359)..(359): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagagtcgagagacacgaccggtgctcgatttagagctcacgtaagggggtgggtccgaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggatatggtcattggaccagcagaagacaggccaggcccctgtcttggtgtatataaagacagtgaggaggccctcgagggactcccgtgacgcgattctctggctccagctcaggacaacagtcacgttnaccatcagtgacgtccaggcagaagacgaggctgactattatntanaatcagnacgacaccggtgtactgtcgggtattcgggacggacggaccgaagtcctaggacccgtacgtagggcacggacccgaacggtcgtaccgtccccgtcggtactacccgtccgttaccgttcccctaacccctcccttccgtacccttcccg

SEQ ID NO: 178863 - DNA, 573 bp, Homo sapiens
  misc_feature: GYAE6OF02JAUW9.49.16.B05.1.454.CMB.1.raw
  modified_base (237)..(237): a, c, t, g, unknown or other
  misc_feature (237)..(237): n is a, c, g, or t
  modified_base (452)..(452): a, c, t, g, unknown or other
  misc_feature (452)..(452): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtctgtgtcctcaggacagacggccaggatcacctgctcgtggacgatgcattcgaccaaaaanatatgcttactggtactagcagacggccaggccacggcccctgtcttggtgtatttagtaaagtctttagagacgccctcgacggtaccctgacgcgattcgtctggctcgagctcgaggacaacacgtcaccttcgacctagtcgtagtggcgtaccgcgaagacggaacgaggtccagtacttacttacgtgtacgacgtcgacagacagacngtaggctaggttatcgtacgtagttcgggacggtaacggactacggctacggaccgtcgtaacggtgaaccgccgtaacggtcgtcccggtaccccgtcggtcctaccgttccgttacccg

SEQ ID NO: 178864 - DNA, 520 bp, Homo sapiens
  misc_feature: GYAE6OF02FK6LD.49.16.B05.1.454.CMB.1.raw
  modified_base (350)..(350): a, c, t, g, unknown or other
  misc_feature (350)..(350): n is a, c, g, or t
  modified_base (482)..(482): a, c, t, g, unknown or other
  misc_feature (482)..(482): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggatatggtcattggtaccagcagaagacaggccaggcccctgtcttggtggtatataaagacagtgagaggcccctgagggactccctgacgcgattctctggctccagctcaggacaacngtcacgttgacatcagtgagtccagcagaagacgaggctgactatatgtcaatcagcagacaccggttggtacttagcggttgttcggacggagggaccaaggctgaccgtcgtaggtcacgcccgagtccncgccccgtgcactccgtcgttcccgcctcctctcctcg

SEQ ID NO: 178865 - DNA, 520 bp, Homo sapiens
  misc_feature: GYAE6OF02GMOCM.49.16.B05.1.454.CMB.1.raw
  modified_base (494)..(494): a, c, t, g, unknown or other
  misc_feature (494)..(494): n is a, c, g, or t
  modified_base (517)..(517): a, c, t, g, unknown or other
  misc_feature (517)..(517): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttaacgaaaggaatatggtcattggtaccagcagaagacaggccaggcccctgtcttggtggtatataaagacagtgagaggccctcagggatcccgtgagcgattctctggctccagctcgaggacaacagtcacgttgaccatcagtggagtccaggcagaagacgaggctgactattattgtacaatcagcagacacggtgtacttagtcgggtgttcggcggagggaccaaggctgaccgtcgtagtcagcccaggctcgcccctcggcncgtctcgttcccacctcctcctntcc

SEQ ID NO: 178866 - DNA, 619 bp, Homo sapiens
  misc_feature: GYAE6OF02I03HL.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggatatggtcattggtaccagcagaagacaggccacggcccctgtcttggtggtatataaagacagtgagacggccctgagggctcccgtgagcgattctctggctccagctcgaggacacgagtccacgttgaccatcgagtggagtccgaggcaagaacgacgacggctagacgttattattcggtactaactcagtacaagacccgtacgggttacgttacgttacgtacggggttgtaccgggacgggtacggaaccgaagtccgttacgacccgttaccgtacgggtccacggtacccgtaacggccgttaccggtacccccggtcggtaccctaccgtttcccgttccgttcccccctaccccgttcccttcccgtcttaccccgg

SEQ ID NO: 178867 - DNA, 676 bp, Homo sapiens
  misc_feature: GYAE6OF02ITW0N.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggccctcctatgagctgacacagcccaccctcggtgtcagtcgtccccaggacagacggccaggactccaccgttggttttggatacgttaacgttaacggaaaggtatatggtacagtttggtaccaggcaaggaagacgacggccacggcccctggtcgttggtggtatataaagacagtcgaagcggcccgtgagggactcccgtagagcgtattccgcgtcggtctccgagtccgtcgaacggacctaacgagttccaacggtttacaacccgtagtccgaaggttacggacgtacccgaagggaccgaggaaacggaccggaggactaaggtacgttaattagtttaccggtataacgttcaaggacccgaagtaccgtaccgggttagttacgttaggtacgggttcggttaccgggaacggtacggaccgtaacggcgttacggacccgtcgtaacggtccaacgtcccgaaggtcccgtcgaccccggtcgtacgtcctcgtccgtacccgtccctccttacgtcctccg

SEQ ID NO: 178868 - DNA, 538 bp, Homo sapiens
  misc_feature: GYAE6OF02GYPNM.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttaacgaaaggaatatggtcattggtaccagcagaagacaggccaggcccctgtcttggtgtatataaagacagtgagaggccctcgagggatccctgagcgattctctggctccagctcagggacaacagtcacgttgaccatcagtggagtccaggcagaagacgaggctagactattattgtacaatcagcagacaccggtgtacttagtcgggtgttcggcggagggaccaagctgaccgtcgtaggtcacgccgaacggctccgccccgtcggtaccacctcgttccgttccccaccctcccttcctcctccg

SEQ ID NO: 178869 - DNA, 513 bp, Homo sapiens
  misc_feature: GYAE6OF02FJMAG.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtctggtggtatataaagacagtgagaggccctcagggatccctgagcgattctctggctccagctcagggacaacagtcacgttgaccatcagtggagtccaggcagaagacgaggctgactattattgtcaatcagcagacaccggtgtacttatcgggtgttcggcggagggacaagctgaccgtctagtcagccaggctcgcccctcggtcactctcgttcccgccctcctctctccg

SEQ ID NO: 178870 - DNA, 527 bp, Homo sapiens
  misc_feature: GYAE6OF02F4DJY.49.16.B05.1.454.CMB.1.raw
  modified_base (514)..(514): a, c, t, g, unknown or other
  misc_feature (514)..(514): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggccctgtcttggtggtatataaagacagtgagaggcctcagggatcccgtgagcgattctctggctccgagctcaggacaacagtcacgttgaccatacgagtggacgtccgaggcagaacgacggaggctgacttattattgtacaatcagcaagacgacgtggtacttagtcggtgtcggcggagggaccagcgtcgaccgtcgtaggtcagaccgaggctcgcccccgtgtcacctcgtcgttcccnccctcctctctcc

SEQ ID NO: 178871 - DNA, 546 bp, Homo sapiens
  misc_feature: GYAE6OF02GYTHB.49.16.B05.1.454.CMB.1.raw
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggactcacctgtttggagatacgttacgaaaggatatggtcattggtaccagcagaagacaggccaggcccctgtcttggtggtatataaagacagtgagaggccctgagggatccctgagcgattcnctggcctcagctcgagggacaacngtacacgttcgaccatcaacggtggacgttccagggccaagaacgacgaggactggtaacttattattgacctaatcagacagaacgccggtgtacttagtcggtgtcgggtggaggaccagctaggcctctaggcagaccgaaggtcctacgccccgtcggtctcgtcttccgtcccgtccctctcctacttcccg

SEQ ID NO: 178872 - DNA, 550 bp, Homo sapiens
  misc_feature: GYAE6OF02G1HX4.49.16.B05.1.454.CMB.1.raw
  modified_base (204)..(204): a, c, t, g, unknown or other
  misc_feature (204)..(204): n is a, c, g, or t
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
tcagagtcgagagacacgaccggtgctcgatttagagctcacgtagttgggtttggggaggaactgctcagttaggacccagacggaaccatggaagccccagcgcagcttctcttcctcctgctactctggctacccagagaccactggagaaatagcgatgacgcagtctccagccaccctgtctgtgtctccaggggaaangccaccctctcctgcagggccagtcagagtgttagcagcaacttgcctggtaacngcagaacctggccaggctcccaggcctcctcatctatggtcncactccaccgagggccacgtggtactcccagccaggttcaggtggctaggtcgggtctgggacaggtacgtttccacgttctacacctatcacgcacgcctgcagtctagaacgtatttgctagtttattactgtcacgtctagttattaagttacgtcggtcttcggttttcggaccgtagggtacctagtcgtaggtacgtagtacaacggtacgtacgtggtacggtcgtcgacgtacctatctcg

SEQ ID NO: 178873 - DNA, 539 bp, Homo sapiens
  misc_feature: GYAE6OF02HPT7J.49.16.B05.1.454.CMB.1.raw
  modified_base (508)..(508): a, c, t, g, unknown or other
  misc_feature (508)..(508): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatcccgtgagcgattctctggctccagctcgagggacaacgagtcacgttgaccatcagtggagtccaggcagaagacgaggctgactattatgtcaatcagcagacaccggtgtacttagtcgggtgttcgggcggagggaccaagcgtggaccgtcgtaggtccacgcccgtaaggcctccgccccgtcggtaccncttcgtcgttcccctaccctccctctctccg

SEQ ID NO: 178874 - DNA, 792 bp, Homo sapiens
  misc_feature: GYAE6OF02IHO8V.49.16.B05.1.454.CMB.1.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
tcagagtcgagagacacgaccggtgctcgatttagagctcacgtaaggggtgggtccaggaggcagaactctgggtgtctcaccatggcctggatccctctacttctcccctcctcactctctgcacaggttctgaggcctcctatgagctgacacagccaccctcggtgtcagtgtccccaggacagacggccaggatcaccttgtttggagatacgttacgaaagatatggtcattggtaccagcagaagacnggcaggccctgttttgctttancgatcttcaatccggcccgctgggactcccgagacgcgatttcctcgtggcctaccgacggtcgggggaacacgggcccaacgttcctacggaacctacgtacacgttaccggacgggaccccgaaggggcccggaacgaacggttcgggaacgggtccgttaacggtaaccttaacgttttaaccggttggtaaccggttaacggggtacgtaaaacgggtacccgaacccgttaaaacgtttcgtaacctaagtttaccgggttaccggggaacgggtaaccgggtaaacctaaaaggttccggtaaccccggtttcccggtaggggttaacccaaccggtaaccccgaaacgggtttcccgtaccccgtacccccccggtttaggtcccgtaaccggttttcccgtttaccggggttaccccccttaccccgttcccgtttaccttacccggtttcccggttaccctaaccccgttcccggtaacggggtacccgggttcccgggtaaccgg

SEQ ID NO: 178875 - DNA, 892 bp, Homo sapiens
  misc_feature: GYAE6OF02GY4GD.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtcgtccccaggacagacggccaggatcaccttgtttggagatacgttaacgaaaggaatatggtcattggtaccagcaagaagacaggccacggccctgtcgttggtgtataataaagacagtgagacggccctagagggactcccgtaggagcgtatttccgtcgtggcctccgacggtctaccgaaggggaaccaaacgtacggttaccgtaaccggttttacgaaccctaacgttacgaagggttcggggtaacgttacccggaaggggtaccgaaagggaaaacgggaaccggaacgggtaccgttaaggtaaaccgttttaaagttttaaacgtttacggttaaacctaaaagtttacccgaaacggtaccggtaaaacggtaacccggttaaacccggggtttaggggtttaaacccgttttaaagggtttcccggggggtttacgggttttacccggggaccgggggtaaaccgggggtaacccgtaaaacgggtccggttaaccgggtaaacccccggtttacccggttaacggggtaccccggtaacccgggtaccccggtaaacggggttcccccggttaacccccggtccccccccgggtttacccgggttaccccgttaaccccgtttccccggtttaccccggttttaccccccctaacccccccggttttcccttttccccgttaccccgtttaacccccgg

SEQ ID NO: 178876 - DNA, 548 bp, Homo sapiens
  misc_feature: GYAE6OF02ICQOW.49.16.B05.1.454.CMB.1.raw
  modified_base (529)..(529): a, c, t, g, unknown or other
  misc_feature (529)..(529): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcagaagacaggccaggcccctgtcttggtggtataataaagacagtgagacggccctgagggactccctgagcgatttctcgtggctccagcctcgaacgggacaacagtcacgttagaccatcgagtggacgtaccgaggacaaggaagacggaggctagacttattatgtacaatcagcagacacggttgtactagtcgggtgttcgggcgacgggacagctgaccgtcgtaggtcacgacccgaggcctccgccccgtcggtctacgtttcgtcccncccttcctcttcctctccg

SEQ ID NO: 178877 - DNA, 553 bp, Homo sapiens
  misc_feature: GYAE6OF02HGRIE.49.16.B05.1.454.CMB.1.raw
  modified_base (427)..(427): a, c, t, g, unknown or other
  misc_feature (427)..(427): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtccagtgtccccaggacagacggccaggatcacctgtttggagatacgttagaaaggatatggtacattggtaccagcagaagacaggccaggcccctgtcttggtgtatataaagcagtgagacggccctgagggactccctaggagcgtaattctcgtggcctcagctcgaggaacaacagtcctaagttcgaccatcaggtgagtccaggcaagaagacgagctgaacttattatgacaatcaagcagacncggtagtactagtcgggtgtcggaggaggaccgaagcgtacgccgtacgtcggtacgacgaccgaacggtctaccgccccgtcgacctacgttcccgtccgacccctaccctccctcctccctccg

SEQ ID NO: 178878 - DNA, 735 bp, Homo sapiens
  misc_feature: GYAE6OF02H0DWO.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggactcacgttggtttggagattaacgttaacgaaaggaatagtcggtatagttcggtaaccagacaaggaacgacgacggaccgacggcccctggtcgtttgggtaggttaattaaagtaaaagacgtaggtagaggacggtcccgtaggaacgggtactacccgtaggacgcgtactttcctcgtggtcctacgagtcctacggaacgggaaccaacgacgtcctaacggtttcgaaacctacgtacgaaggtacggtaccgtaccgaagggtacgaaggaacggaacggacggtctaacggtaacttaagtttacttagaactaacgtacgacgtaacgaacgaccggttaaccgggttaggttaaccgttacgggttcggggttaggttaccgggacgggtaacggaaccgaacgtcgtacggtacccgtacgtacggaccgaccgacccggaacgtccgttccccggcccgttcggtaccctcccgttccttcccggttaccccctaaccccgttccttccttacccgttccg

SEQ ID NO: 178879 - DNA, 770 bp, Homo sapiens
  misc_feature: GYAE6OF02G5DVA.49.16.B05.1.454.CMB.1.raw
  modified_base (304)..(304): a, c, t, g, unknown or other
  misc_feature (304)..(304): n is a, c, g, or t
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctggtgtcagtgtccccaggacagacggccaggatcacctgtttggagatacgttaacgaaaggatatggacattggaccagcaagagacaggccaggcccctgtcttggtggtactataaagacagtgagaggtccctnaggggactcccgtagacgcgtatttaccgtcgtcggtacctccgaacggtccttacgacggggtaaccaaaccggacgttaccgaaccggttttggaaccccagttacgaagggttacgggaacggttacccgagggtaccaacgggtaaacggtaaccgggaacgggtaccgttaacggtaccgttaaagttttaacgtttacgggttaacctaaacgttactaaccggttaacgacggtaacccggtaccgggtttacgggttaaccttttagggttaccgggggtttagttccggggtaccgggaacgggtaaccggtaacgtaccgttacggtaccccgttaacgtacgggtaccacgggtaaccccgtaagggtcctaccggtcccccttacggggtacctacccgtttaccgttacccggtttacccccgccctttacccgttacccttccttaccccgg

SEQ ID NO: 178880 - DNA, 584 bp, Homo sapiens
  misc_feature: GYAE6OF02I8XO1.49.16.B05.1.454.CMB.1.raw
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (538)..(538): a, c, t, g, unknown or other
  misc_feature (538)..(538): n is a, c, g, or t
tcagagtcgagagacacgaccggtgctcgatttagagctcacgtaagggggtgggtccgaggaggcagaactctgggtgtctcaccatggcctggatccctctacttctccccctcctcactctctgcacaggttctgaggcctcctatgagctgacacagcccaccctcggtgtcagtcgtcccccaggacacgacggccaggatcacctgtttggagatacgttaacgaaaggaatagtggtctagttggtaccagcaagaagacgaggccacggcccctgtcttggtggtataagtaaagacagtgagacggccctgagggactcccgtgagtcgattcgtctggcctacgagcctcgagggtaaccaacgnggtaccacggttcgaacntcgagtcggactcgagcaagaacgacggagcgtagtactattagttagtactaatacagacacgacgtacgttcggtactaggtcggtgttcgggcggacgggacaggtctcggtacgtcgtagacgacgaccgacggtcgaccncccgtacgtccacgtcgtcccgttcccgccctaccctcgtccctcg

SEQ ID NO: 178881 - DNA, 625 bp, Homo sapiens
  misc_feature: GYAE6OF02F88JB.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagattacgttaacgaaaggaatatggtcattggtaccagcagaagacaggccacggcccctgtcttggtggtatataaagacagtgagacggccctagagggactcccgtgacgcgtattctctggcctccgagctcgaggacaacagtcacgttgacctatctagtcggagtccagggacaaggaaacgacggacggcctagtaacttattagttactaactacgtacgagacgaacgaccgtacgggttagttacttacgggttcgggttacggtacggggacgggacggaacgtacgtccgtacggtacccgtcgtacgtacgaccgaccggacggtccgtaccccggcccggttacgtaccgtacccttccggtacccttacccccacccgttcccttcctccttccg

SEQ ID NO: 178882 - DNA, 599 bp, Homo sapiens
  misc_feature: GYAE6OF02GNHE2.49.16.B05.1.454.CMB.1.raw
  modified_base (341)..(341): a, c, t, g, unknown or other
  misc_feature (341)..(341): n is a, c, g, or t
  modified_base (415)..(415): a, c, t, g, unknown or other
  misc_feature (415)..(415): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccacggccctgtcttggtggtatataaagacagtgagaggccctcgagggatcccgtgagcgtattctcgtggcctccgngctcgagggaccaagagtcacgttcgaccatcagtggagtcgaggacagaagacggaggctgacttattagttntacaatcagcagacgaccggtagtacttagtcgggttggttcgggacgggagggaaccgaggcgtacgacccggtaccgtaggtccgacggacccgaacggtcccgtccggtcccccgttcggttccctaccgttaccgttccggtttccccggtacccccttcccgttcccttacccttcccg

SEQ ID NO: 178883 - DNA, 648 bp, Homo sapiens
  misc_feature: GYAE6OF02JRPZO.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtcgtcccaggacagacggccaggatccacctgtttggagatacgttaacgaaagatatggtacagttggtaccagcaagaagacaggccacggcccctagtcgttggtgtatataaagacagtgagacgcctgagggactcccgtgagcagttctgtgcctacagctcgaggacaacatcgacgttcaaccatacgagtggtacgtccaaggcaagaacgacggacgcgtagaacgttattaagtcgtaactaactacgagcgaacgacgtaccggtgtaactttcgggtacgggttcgttaccgggcgggaaccgggtaccgaacggtccgtacggtacccgttaccgtacgggtaccgtacggaaccggtaaccgggtccgtaccccggtaccccggttccgttacccgaacgttttccccgtaccggttacccccttaccccgtccctttacccgtcccgtttaacccg

SEQ ID NO: 178884 - DNA, 828 bp, Homo sapiens
  misc_feature: GYAE6OF02H9P3U.49.16.B05.1.454.CMB.1.raw
  modified_base (404)..(404): a, c, t, g, unknown or other
  misc_feature (404)..(404): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggccttcctatgagctgacacacgccacccgtcggtgtcaggtcgtcccccaggacaggaccggccgaggactcaccgttggtttggagtactacgttaacggaaaggtaactagtcggtactagttcggtaaccaggtacaaggaaagacgacggaccgacggtccccgttggtccgttagggtggtatactaaaagcgaggtgaacggacggtaccctacgacgggtactcccgtaggacgcgtattcctcgtcgcctaccgngtccgtacggacggaaccacacggtacctaacggttcggaacctataccgtaggtcggtacgtcccgagggtaccgaacggtaacggtacggacgggtacctacggtaacttattaggtttaacgtacgtaacgtccgacggtaacgtaacccggtaacggtacccggggtttaacgttaacggttcggggtttacccggggttacggggtttccggggaaccggggtaaccgggtaaccggttaaccggaccgtttaccgggggacccctttaaccgggtagggttacccgaccgtacccgggtaccgtcccggggttacccgtccccccgggtttaccggtaccccgttaaccgtttcccgggttaccccggtttaccccccggtcccccgtttcccttaacccggttcccgtttaccccgg

SEQ ID NO: 178885 - DNA, 684 bp, Homo sapiens
  misc_feature: GYAE6OF02JYKZQ.49.16.B05.1.454.CMB.1.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (439)..(439): a, c, t, g, unknown or other
  misc_feature (439)..(439): n is a, c, g, or t
  modified_base (573)..(573): a, c, t, g, unknown or other
  misc_feature (573)..(573): n is a, c, g, or t
tcagagtcgagagacacgaccggtgctcgatttagagctcacgtaagggggtgggtccgaggaggcagaactctgggtgtctcaccatggcctggatcctctacttctcccctcctcactctctgcacaggttctgaggcctcctatgagctgacacacgccaccctcggtgtcagtcgtccccaggacagacgccaggancaccttgtttgagatacgttacgaaaggaatatggctagttggtaccagcagaagacagaccacggtccctgttcgttaggtaggtactaaataaagacgaggtagaacggaggtaccctacggtaaacgggtcttacccgaggaacncggtaactttcgtacgtggtaccttacgaacgtccgttaagaacggaaccaaacgtcgtacgtaacgtttgaaaccctagtaccgtaggnggtaacgtaccgaacggcgaaaggtaacggacggtaggtcgtaagtaacgttattacgtttacgactaagtacctagggaactaacggaccgtacgggtagttactacgggttacggttaggtcggtacggganaccggtaagccttaacggcctacggtatccggactaacgaccgttccgacgttccccgaacggtttctacccgtttccggtacccgtcctaccgttcctccgttctaccgg

SEQ ID NO: 178886 - DNA, 602 bp, Homo sapiens
  misc_feature: GYAE6OF02I1S5D.49.16.B05.1.454.CMB.1.raw
  modified_base (219)..(219): a, c, t, g, unknown or other
  misc_feature (219)..(219): n is a, c, g, or t
  modified_base (488)..(488): a, c, t, g, unknown or other
  misc_feature (488)..(488): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccaccctcggtgtcagtcgtccccaggacagacggccaggatcacctgctcgtgganatgcattcgaccaaacgatatcgtacttagttacggtaccagcaaggaacggccgggaccaaccggcccttggtggttggtagagttaggtaataaaacgacgtaaccgtggaacgacggcccctaggaacgggtacctcccgaggtacgtcggtacttcgtcgtcggcctcgaggtcgagggaacacggtacacgtagttcgctagtcgagtcggacacgaggtacaggtacggacgtggtctagacttattagtatacaaattcaanacgacactagtagtacttagtagtctacgtatccgacaccgtaagccgacgtcgtcgactaccgaccgaaccgaccacccgtgtaccgtctacctccgttccgtcccccgtccc

SEQ ID NO: 178887 - DNA, 704 bp, Homo sapiens
  misc_feature: GYAE6OF02HCJFT.49.16.B05.1.454.CMB.1.raw
  modified_base (233)..(233): a, c, t, g, unknown or other
  misc_feature (233)..(233): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagccaccctcggtgtcagtcgtccccaggacagacggccaggatcactgtttgagatacgtagaagatatggtnattggtacagcaagaagacaggccaggcccctgtacttggtagtatataaagacagtagagacgcctagagggactccctgacgtcgtattctctacggccttccagcctacgaacggtacaaacgtaggttaccacgtttgaaccctgtacaaggtggacgtcccggaggtcgaaaggaaggtacggacggctaaggtacctttaaagttcgtttacgtacgtaatacgaacgtacgaacgttacgaaccgggttaggttaaccttacggttacggggttacggttaccggggacggggtaacgggtaaccaaggttccgttacggaaccccgttacggtaggttaacccgaccggacccggtaaccgggtccctttaacccggcccccggttaccggtaccgttacccggtttcccgttacccggtttacccccctaccccggtttcctttcccgtacccggttccccg

SEQ ID NO: 178888 - DNA, 871 bp, Homo sapiens
  misc_feature: GYAE6OF02HNYCM.49.16.B05.1.454.CMB.1.raw
tcagagtcgagagacacgaccggtgctcgatttagagctcacgtaagggggtgggtccaggaggcagaactctgggtgtctcaccatggcctggatcccctctacttcctccccctcctcactctctgcacgtaggttctggacggccctcctatggacgctagacacacgccccacccgtcggtgtcaggtccgtcccccgaaggaccaggaccggccaggtactcctaccgttggtttaggagtagttaacggttaacggaaaggtaatagtggtactagttacggtaccagacgaaggaacgaccgacggaccgacggtccccgttggttacgtttgggtaggttaattaaagtaaaacggacgtaggttaggaacggaccggtacccctaggaacgggtactcccgtaggacgcgtactttccgtcgtcgggtcctaccgacgtcgtaaccggaacgggtaaccaaaccgtacggtaccgtaacggtttacgaaacctacgttaccggtaaggtacgggtaaccggtacccggaagggaaccgtaaacgggaaacggaaccgggtaacgggtacgttaacggtaaacctttaaaggttttaacgttacggtaactaaacgtaccgaaaacgtaacgtaaccctaaacgtaagttttacgggttaaacctttagttccgttacggttaaccgggaactcggaacccgtaaaccgtaccgggtacccgtacccggttaccggttcgggtaaccacccggtaaccccggaacccggtaaccccctaaacccccggtacgttacccgtaacccgtaccgtttcccgttaccccgttacccctaaccccctttcgtccccgttactccccgg

SEQ ID NO: 178889 - DNA, 648 bp, Homo sapiens
  misc_feature: GYAE6OF02GXX0G.49.16.B05.1.454.CMB.1.raw
  modified_base (234)..(234): a, c, t, g, unknown or other
  misc_feature (234)..(234): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtccagtgtccccaggacagacggccaggatcacctgctctggagatgcattgaccaaaccgntatgcttagttcggtaccagcagaagccgggccacggcccctgtgttggtgatgtataaagacacgtgagcggccctcgagggtactccccgtaggacggtcgtatttcctacgtcggtccgtaccgacggtaccgaaggggaacctaacgggtaccgacgtacgtttcggaccctagtcgtaggtggacgtccgtagggaccgaggagggaacgagggctacggacttagttagttagttacaacttacgaacgtacgaccaaccttagttacggttactttacgtttacgttaccgtttacggaacgttcgaccgtaacccgtaacggtccgtaccgttccggtggtccgacgaccccgaaccgacccgtaacccctacgtacgtccctacgtccttcccgtcccgtacccc

SEQ ID NO: 178890 - DNA, 938 bp, Homo sapiens
  misc_feature: GYAE6OF02G34CG.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggccttcctatgagctgacacacgcccaccctcggtgtcagtcgtccccgaggacaggaccggccaggactcaccttggtttaggaagtacttaacggttaacgaaaaggtaattagtcggtactagtttacggtaacccaggacaaggaacgaccgacggaccgaccggccccttggttccgtttagggttacggttaattaaagtaaaacgtacgtaaggtaggaacggtaccgggtcccgtaccgggaacgggtaccttcccgtaggacggtacgttaactttccgtccgttcgggtccttaccgacggtccgtacggaacgggtaacccaacggttacggttaccgtaaccggtttacgaaccctagttacgtaacgggttgggaacccggttaccggaacgggaacgaaacgggaacgggtaaaccgggacgggtaccggttaacggttaacctttaagttttaacgttacggttactaaacgttccgtaaacggacgtaaccggtaaccggttaccggggttaacgggtttaccctttaaaggggttccgggggtttaccgggttaccggggtaccggggtaaacggggttaacccgtaaacgggtccgttaacccgggtacccggttaaaccggttaccgggtaaccgggaccccgttaaaccggacccggggttaacccctacccgggttaccccccgttaccgggtttaaccctaaccccggtttcccgttttaccccggttacccccttaccccccgttttcccgtttccccgtaccgtttacccccgg

SEQ ID NO: 178891 - DNA, 627 bp, Homo sapiens
  misc_feature: GYAE6OF02FLEWY.49.16.B05.1.454.CMB.1.raw
  modified_base (363)..(363): a, c, t, g, unknown or other
  misc_feature (363)..(363): n is a, c, g, or t
tcagagtcgagagacacgaccggtgctcgatttagagctcacgtaaggggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcaccttgtttggagatacgttaacgaaaggaatatggtcattggtaccagcgagaagacaggccaggcccctgtcttggtagtatagtaaagacagtgagcggcctacgagggactcccgtggagcgtattcctcgtggcctccagctcgacggacaacgngtccacgtttgaacctagtcgaaggttgaacggtccagggacaaggaacgacggacggtcttagaactttagttagttcgtacaagtccaagcaacgaccgaccgggttgtactttaggtcgggttagtcgggcggaagggaccaagtcgtcgtacccgtcgtacggtcacgacccgacggtacctccggacccccgttaccggtacctaccgtccgttacccggtttcccccgacccgtttccccttccgtccctttccccgg

SEQ ID NO: 178892 - DNA, 742 bp, Homo sapiens
  misc_feature: GYAE6OF02JP4QD.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagcccacccgtcggtgtcagtcgtccccaggacaggaccggccaggactcaccttgtttggagattacggttaacgaaaggtaatatggtctagttggtaaccagcaagaacgacgacggccacggcccctgtcgttggtacgtataataaagactagtagagacggcctacgagggtactcccgtggacgtcgtattcctcgtggcctacgagccgtacgacggtaacaaccgtggtacctaggttacaacccgtaataccgtagggttacggacggtaccgtaacgggacgaacgggaaacggcggtaaggaccttaaggtacttaagtttgttacgtaaccgtaaacgttcgaacggtacgtaaacggacccgggtaacgggttagttaacccgttaaggggttcggggtttacggttaccgggggaaccggggaaccggacccgttaaggtccgtaccgggttaaccctaaccgggttacggacccgaccgtacccggtaaccggtccgtacccccggtccggtacccgtccctaacggttcccttacccggtcccctccctaccttccgtccctacgg

SEQ ID NO: 178893 - DNA, 728 bp, Homo sapiens
  misc_feature: GYAE6OF02IJF3M.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctggtgtcagtgtccccaggacagacggccaggatcacctgtttgagatacgttaacgaaggaatatggtacattggtaccagcaagaagtacaggccaggcccctgtcttggcggtaatataaagacagtgagacggccctagagggactcccgtgagcgaattctacgtggctcacgctacgacgggaaccaaactaggtccaacggtttcgaacctaacttccgaaggttacggaacgttacccgaagggtaccaaaggaaacggacggaagggcctaggaaacttaagtttagttacggttaccaaagttacgaagacgtaaaggacccgttaaccggggttacggttaaaccttaacgggttcggggttacggtttaccgggacgggtaaccggggaaccaaggtaccgttacggtaacccggttaccgtttaacggtaccgacgtaccccggtaacgggtcccgttacccggtaccccccgttcggttaaccgtaacccgtttccgttacccgttaaccccccgtaccccgttaccctttcccgtacccttaccccgg

SEQ ID NO: 178894 - DNA, 709 bp, Homo sapiens
  misc_feature: GYAE6OF02GVDRT.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtcgtccccagtacagacggccaggatcacctgtttggagatacgttacgaaaggatatggtcattggtaccagcagaagacaggccaggcccctgtcttggtggtatataagacagtgagaggccctcgagggactcccgtgacggcgtattcctcgtggcctccagctacgaggacaactagtcacgttcgacctatccgagtcgggacgtccgaggacaaggaagacggaggtacgtagtaacttagtttagttacgtactaactacgtagacgaacggtaccgaaccgggttacgttaaccgtttaagggttccggggtttacggggttccggggacggggtaacggggtaacccgtaacgggtccttaccggggtaccccgttaccggttaacggttacccgaccggtaccccggtaaacgggtccccgttacccggtaccccccggttccgggtacccctacccggttacccgttccccggtttaccccctaccccccggtttccctttacccctcccgtttaccccg

SEQ ID NO: 178895 - DNA, 909 bp, Homo sapiens
  misc_feature: GYAE6OF02GS43U.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacacgccaccctcggtgtcagtcgtccccaggacagacgccaggatccaccttgtttcggatacgttaacgttaacggaaaggaattagtggtactagtttcggaccagacgaagaagacgacggccaccggcccttgtcgttaggtggtaacttaagtaaacgaacgtaggttacggaacggacggtccccttaggaacgggtaccttccccgttagggaaccggtcggtaacttttccgttcggtccgggtacctccggtacgtcccgttaacgggaacggaaaccgtaaacgtacggttacctaacggttacaaccgtatacgtaggtacggtacgtacgaggtaccaaagggaacggacgtaacggacgtacgtaaagtttaacggtttacttcgtaaaccgtaattcaacgggtaaccgtaaccgggtaaccggttaaacccgggtttagggtttaaacccgtttaccgggggttaaccgggttttccggggtaaccggggggttaccccggggttaaacggggaacccgttaaaccgggtacccgggttacccgggtaaacccggtttaacccgggttaaccggtaaccgggtaaccccgggttaccccggtaaacccggggttcccttacccccggggttcccccggtaaccgggttaacccccgtttacccgtaaccccgggttttccccgtttaaaccccccggcccccttttaccggtttcccccgtaccgtttacccccggg

SEQ ID NO: 178896 - DNA, 874 bp, Homo sapiens
  misc_feature: GYAE6OF02HY45S.49.16.B05.1.454.CMB.1.raw
  modified_base (174)..(174): a, c, t, g, unknown or other
  misc_feature (174)..(174): n is a, c, g, or t
tcagagtcgagagacacgaccggtgctcgatttagagctcacgtaaggggggtgggtccaggaggcagaactctgggtgtctcaccatggcctggatccctctacttctccccctcctcactctctgcacaggttctgaggcctcctatgagctgacacagcccaccctcggtntcagtcgtccccaggacagacggccaggatcaccttgttttggagtataacgttacgaaaggatatggtcattggtaccagcagaagacaggccacggcccctgtcgttggtggtaataataaagacagtgagacggccctcgagggactccgtagacggaccgtattccgttacgttcggtccctccgacgtaccttaccggaagggtaacccaaacgtcgttaccgtaacggtttacgaaccctaagtaccgtaagggttacgggtaacgttacccggaagggaacgaaacgggaaacgggaccgggtaacgggtaccgttacggttaaacctttaagtttttaaacgtttacgtaaccgtaaaccgttacgaaacggtaccgtaaaccgggtaaacccgttaacccgggggtttaacgggttaacccggtttttaacgggttccgggggggtttaccgggttacccgggggggtaaccgggggtaaaccggggtaaacccggttaaacgggtcccgggttaaccgggttaaaccccgggttacccgggtttaacggggtacccggtaacccgtacccccggtaaccggggtcccgttaccccccgggtccccccgttacggggtcccctaacccgtttccgttaacccggtttccccccttacccccgtttcccgtttaccccttccgttaccccgg

SEQ ID NO: 178897 - DNA, 733 bp, Homo sapiens
  misc_feature: GYAE6OF02HMOMG.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagcccaccctggtgtcagtgtccccaggacagacggccaggatcacctgtttggagatacgttacgaaaggatatggtcattggtaccagcaagaagacaggccagcccctgtcttggtgtataataaagacagtgaggaggccctgagggtactcccttgaagtcgaatttccgtcgtaggtcttaccaggtctaccggaacggggaaccaaacgtaggttccaacggtttacgaaccctaagttaccaaggttacggacgtaccgtaacgggcaaggaacgacggtacggaccgtagaacttaatttaattgttactaaactcgaagcaacggtaacctaacgggtcgttaacgttacggtcgggttacggttccggggtaacgggacggggtaaccgaacgttaccgttcggaaccccggtttacgtaacgggttaccgaccggttacccgtaaaccggggtcctccccgggttacccccgtacccgggttacccgttaacccgtcccgttttaacccgtttaccccccggtaacccccgttttcccttaccccgtaacccggttttcccccg

SEQ ID NO: 178898 - DNA, 620 bp, Homo sapiens
  misc_feature: GYAE6OF02GSMBG.49.16.B05.1.454.CMB.1.raw
  modified_base (433)..(433): a, c, t, g, unknown or other
  misc_feature (433)..(433): n is a, c, g, or t
tcagagtcgagagacacgaccggtgctcgatttagagctcacgtaaggggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttgagatacgttaacgaaaggaatatggtcattggtaccagcagaagacagccagccctgtcttggtgtatataaagacagtgagacggccctcgagggactccctagagctattctctgctccagctcaaggacaaacagtcaacgttgaccaatcaggtggacgacgagagaagagacggacgtagtacgtaacttaattacggttataacgtaatacgtanaacgaaccgtaacggtacggtaacggttactacggggttcggttacgggtacgggaaccgggtacgaaccgtaacgtcggaccgttacgtaccgttacggactaccggaaccggagtccggcccccgtccggtacccgtactaccgttccgttccccgttccccgtcccttacccttcctcctcccg

SEQ ID NO: 178899 - DNA, 764 bp, Homo sapiens
  misc_feature: GYAE6OF02G0P66.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctctatgagctgacacagccaccctcggtgtcagtgtcccaggacagacgccagatcactgtttggagatacgttacgaaggatatggtcattggtaccagcagagacaggccaggcccctgtcgttggtgtataataagacagtgagacggccctagacgggactccgtggagcgtattctctggtctccgacgctcgacgggtacaaacgagtaccacgtttgaacccgtattccgaaggtttggaacgttcccgaagggtcctaaaggaacggaaccggacggaccgttacggtaaccttaaagtttactttacggtacctaaacgttaccgaacggaccgtaaccggaaaccgtaccggggttacggttaaaccgttttacggtacccgggggtttaggtttaccgggggaccggggtaacgggggaacccctaaagggtccctttaacgggaacccggtttacccgtaacggggttccctaaccgggtcccccggaaacgggttcccgttaccccggtcccccccgttagggttaccccgtaaccgttccccgtttacccggttttccccccccccgttacccggtttacccctttacccggttccccgttaaccccgg

SEQ ID NO: 178900 - DNA, 763 bp, Homo sapiens
  misc_feature: GYAE6OF02JP527.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgacggcctcctatgagctgacacagcccaccctcggtgcagtcgtccccaggacagaccggccgaggatcaccgttgtttggagtatacggttacgaaaggattagtggtactagttcggtaccagcaagaacgacgacggccacggccccttaggttcgtttgggtacggttataagtaaaacgacgtaaggtggaacggaacggtcccctacggaacggggtaccttcccggtaggaacgccggttaactttccgtcggtagggtccctaccggtagccgttacgaacggtaacaaccgtagtacctaacggtttacgaaccctagttacgaagggttcggacgtaccgaaggcgtaacgaaggaacggacggcgtaggaaactttgtttaacgtcgttaacaagtctagacgaacgtaccgtaccgggttaggtttaaccttacgggttacgggtcggtttacgggggaccgtaaggggaccgtaacgggtccgtaacggtcccggtaactacgggacgaacccggccgtaacggtcccgtaccggtccccggttaccgtaccgtaccgtttccgttccccggtttccccgaccccgttttcccgttccttacccggttcccg

SEQ ID NO: 178901 - DNA, 641 bp, Homo sapiens
  misc_feature: GYAE6OF02HSIOI.49.16.B05.1.454.CMB.1.raw
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacacgccaccctcggtgtcagtgtccccaggacagacggcaggatcactgtttgagatacgtagaaaggatagtggtcattggaccagcagaagacaggccaggcccctgtcttggtgtatataaagacagtgagacggccctagacgggactcccgtaggaacgtccggtaattttccgtcgtgggccttacccgaggtccgttaggaacgggaacaacgtacggtctaccggtttagaacctagtcgaggtacggactcccgaggacgaggaagacggaggctagtactattagtgtacaatcagacagacgtacggtacgttactaacgttcgggttacggttacggacgggtacgggaccgtaacgtacgtacggtaccgtaccgtagtaccgacgtacccgtacggtccgtccgtccccgtcggtcctaaccgttcgttacccgtccccgttcccctccgttcccgttccgttacccgg

SEQ ID NO: 178902 - DNA, 532 bp, Homo sapiens
  misc_feature: GYAE6OF02GS4BY.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctgagggactccctggagcgtattctcgtggctccagctcgaggacaacgagtcacgttgacatcgagtgagtcaggcagagacgagctagactattattgtacaatcagcagacgtacgggtgtacttagtcgggttggttacggcggacgggaccagctgaccgtctagcacgcccaaggcctacgccccgtgtccacgttctcgttcccgccctcctcgtctccg

SEQ ID NO: 178903 - DNA, 834 bp, Homo sapiens
  misc_feature: GYAE6OF02JJQ6D.49.16.B05.1.454.CMB.1.raw
  modified_base (215)..(215): a, c, t, g, unknown or other
  misc_feature (215)..(215): n is a, c, g, or t
tcagagtcgagagacacgaccggtgctcgatttagagctcacgtaagggggtgggtccgaggaggcagaactctgggtgtctcaccatggcctggatccctctacttcctccccctcctcactctctgcacaggttctgaggcctcctatgagctgacacagccaccctcggtgtcagtcgtccccaggacagacggccaggatcactgtttganatacgtacgaagatatggtacattggtaccagcagaagacaggccacggcccctgtcttggtgtatagaaagacagtgagacggcctgacgggactcccgtggacgcggtacttcgtcgtggccttccgaggccttcggaacgggtaacaacgtacgtaccgtacgtttacggaacccagttaacgaaggggttacgggtaaaccggttacccccgaagggggtacaaaacggggtaaaacgggacccggggtaaacgggtaccgtaagggtttaaacccttaaagtttttaacgtttacggttaacccgtaaaacggttacccgaaagggtaccctaaacgggtaaccccggttaaacccggggtttaggtttaaacccgtttttaacgggggtaccggggttttacggggtttacccgggggaaccgggggtaacggggtaaacccccgtagggttaccgttaccggtaaaccccggttaccggttaacgggtccaaccggtaaccccggaagggtccccgttacccgggttccccccgttagggtccccctaaccggtttcccgttaccggttttcccccccgaccccgtttcccttaccttcccggtttaccccg

SEQ ID NO: 178904 - DNA, 718 bp, Homo sapiens
  misc_feature: GYAE6OF02GRW8P.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacacgccaccctcggtgtcacgtcgtccccaggacagacggccaggactctacctgtttggatagtacgttaacgaaaggtatagtggtactagttggtaccagcgaagaagacaggccacgccctgtcgttggtgtataagtaaagactagtaggagacggtccctagagggtactcccgtggacgtcgtactttccgtacgtcgggtcctaccgacggcctcggaacgggtaaccaaacgtcgtacgtaaccggtttcgaacccagtacgagggtaggtacgtaccgaagggacgtaaacggaacggtacgggaacggcgtaacgtaactttagtttatacgtactaaacgtcgaagtacgaacggtacgtaccggggttagttacgttaggtccggggttaggttaccggggaccgggtaacgggaaccgtaaggtccgtaaccggtacccggtacgtacggaccaccggtccggaaccgggtccctcccggacccccgttcggtaccctacgttcccggttacccgtcccccttccctacccgttccccgtcttcccg

SEQ ID NO: 178905 - DNA, 807 bp, Homo sapiens
  misc_feature: GYAE6OF02JVYNZ.49.16.B05.1.454.CMB.1.raw
  modified_base (310)..(310): a, c, t, g, unknown or other
  misc_feature (310)..(310): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacagtcaccctggtgtctgtgtcctcaggcagacggcctaggctacacctgcctcgtggcgattcgactagttcgaaccaaaaactatacgtgtactttaccgtggtaaccagcaaggcggccgacggccaccggccctggttcgttacggtntaatttaataaggttacttgacgtacggccttaccgacgggtacccctgacggtcgtacttcgtcgtcggtcctacctggaccgttcgaacggtaaccgaaacgttaccggtcccttaacgtttacggtaaaccctacgttaccggtagggttaccggtaccgggttacccgggtaacccggtaacgggaaccggggttaacggaccgggtacgttacgtaaccgtttaacggtttaccgttacggttaaccggttacggtttaaccggaccgttaaccggaacgtaacggtaccggttaagggttcccggtacggttagttttacgtaccggtttaggtttccgtttaacggggtacgggttaaacgggtaccgttaccggtaccggttcgttacccgggtaccggttaacgggtcgtaaacccgggtacccgaacggtcccgttacccgggtccccgtttacgggtaacccgttcccgttcccgtttaacccccg

SEQ ID NO: 178906 - DNA, 684 bp, Homo sapiens
  misc_feature: GYAE6OF02FQO8A.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccacggccccttgtaccgttggtggtatataaagacagtgagacggccctgagggactcccgtgacgcgtattctcgtggcctccagcctcgagggaacaacgtagtccgtaacgtttcgaacctagtactaggttagggacgttacccgagggacaacggtaacggaacggacggtacgtacgtaaccgttaatttacgttcgtaactaataccgaagtacaacggtaccgtaccgggttagttaacctttagggttcgggttacggttcggggacgggtacggtaaccgtagtccgtaccgtacccggttacgtacggtcgaccggtacccgtaacggtcccgtcccggtcccccgtacggttccctaccgttcccgttcccgttacccccgttcccctcccgtttccctcccgttacccg

SEQ ID NO: 178907 - DNA, 725 bp, Homo sapiens
  misc_feature: GYAE6OF02IGN02.49.16.B05.1.454.CMB.1.raw
  modified_base (220)..(220): a, c, t, g, unknown or other
  misc_feature (220)..(220): n is a, c, g, or t
  modified_base (324)..(324): a, c, t, g, unknown or other
  misc_feature (324)..(324): n is a, c, g, or t
  modified_base (504)..(504): a, c, t, g, unknown or other
  misc_feature (504)..(504): n is a, c, g, or t
tcagagtcgagagacacgaccggtgctcgatttagagctcacgtaagggggtgggtccaggaggcagaactctgggtgtctcaccatggcctggatccctctacttcctccccctcctcactctctgcacaggttctgaggcctcctatgagctgacacacgcccaccctcggtgtcagtcgtccccaggacagacggccaggatcaccttggtttgganatacgttaacgaaaggatatggtacagttggtaccagcagaagacaggccaggcccctgtcgttggtggtaatataaagacagtgagacggccctagagggacncccgtgacgcgtattctcgtcggtcctccgagtcctacggaacgggtaccaaacgtacggtaccgaacggtttacgaacccgtagtaccgaggtttacggggacgtacccgagggaccgaaggaacggtaccgggaaggtcgttacgtaacgttatttaacgttacggtactaacgttanacggacaaacggtaacccgtaaccggggttagtttaaccgttacgggttacgggggtttcgggttaccggggaccggggtaacgggtaacccgtaacgggtccgtaaccggtaacccggttccgtaacggtaccgaccggtacccgtacggtccgtcccgtaccccgtccggtacctccgttccgtaccgttccccgtcccctaccgtccctaccctcccg

SEQ ID NO: 178908 - DNA, 774 bp, Homo sapiens
  misc_feature: GYAE6OF02HI366.49.16.B05.1.454.CMB.1.raw
  modified_base (459)..(459): a, c, t, g, unknown or other
  misc_feature (459)..(459): n is a, c, g, or t
tcagagtcgagagacacgaccggtgctcgatttagagctcacgtaagggggtgggtccgaggaggcagaactctgggtgtctcaccatggcctggactccctctacttcctcccctcctcactctctgcactaggttctgacgcctcctatgagctgacactacgccacctcggtgtccaggtccgtacccgaggacaggacggtccgaaggtactcacggtttggtttacgggaagtacttaacggtaacgaaaaggtaatgtgtacgtagttgaaccagcaaaggaagacgagaccgtacggccttcgtcgttagggtcgtaataagaaacgtacaggtagaaggccgacgtacgaacggtctacccgtagacggactacgttctacgtcgtactccgtagccgttacggacggaacgaaacgagtacctacggtttacgaccaacgtccgttaagngggaccgggttaccgcgtaaccgggagggaaccggacgggtactacggtaaacttactttacggacttaccggacggttaccacggtaacggaaccggaaacgcggtaaacggtggtaaaccgtggttaaagttccgtttagggtaacggtacccgggggagggtaaccgggtaacggtaccggtacggttaaccggtacccggtttacgggacgttaaccgggacctaccggtaacgggtcctaccccggggtacccgtcggttacccgtacgttcccgtcccgggtttacccctccccggttccctttcccgg

SEQ ID NO: 178909 - DNA, 775 bp, Homo sapiens
  misc_feature: GYAE6OF02I3FZB.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagcccaccctggtgtcagtgtccccaggacagacggccaggatcacctgtttggagataacgttacgaaaggaatagtggtacattacggtaccagcaagaacgacgaggaccacgcccgtagtcgttaggtgtaataataaagacagtgagacggccctagagggactcccgtagacgacgtatttccgtcgtggcctaccgacgtccttacggaacgggaaccaaaccgtaacgttccgtaacggtttacgaacctacgtacgtaggtacgggacgtacccgaggacgtaacggaaacggtaacggaacggtacttaacggtactttaaagtttacgtttagtaactaacgtacgaagtaccaacggtaaccgtaccgggttaacggtttaccgtttaaggttaccggggtttcggttaccggggtacgggaaccggggtaaccgtaacgggtaccgtacgggtaaccccgttaacgtaacgggttaccgtacgggaaccccgtaacgggttcccgtaccccgggtccccccgttacggttaccccgtacccgttaccggttacccggtttcccccgtaaccccgtttccccggtacccttcccgttaaccccgg

SEQ ID NO: 178910 - DNA, 746 bp, Homo sapiens
  misc_feature: GYAE6OF02HB1TV.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttctgaggcctcctatgagctgacacagccaccctggtgtcagtgtccccaggacagacgccaggactcacctgtttcggagatacgttaacgaaaggtaactagtggtcaagttcggtaaccagaccaagaagacaaggccaggcccctgtcttggtaggtataactaaagctagtgacgaacgggccctgacgggactcccgtaggacgtcggtaatttccgtacgttcgggaccttaccgtaaggtccttacgaacggggaacaaaaccgtaggttacctaacggtttacgaacccagttaccgaaggttcgggaacgttacccgtaaagggcctaaagggtaaacggaacccgggagggttacctagggtaaacctttaagttttaacgtacgtaacgtaaagttcccgaaggtaacgaacgtaaccgacgggtttacgttaaccgttaaggttccggggttagggttaccgggacgggtaacgggtacctaagccggtttacggaacccgtttccgaacgggtcacggtacccgtaacggtcgtcccggtacccgttccggactaccgttaccttccggttaccccaccgttcccttacgtaccttccgg

SEQ ID NO: 178911 - DNA, 605 bp, Homo sapiens
  misc_feature: GYAE6OF02GNE1T.49.16.B05.1.454.CMB.1.raw
  modified_base (237)..(237): a, c, t, g, unknown or other
  misc_feature (237)..(237): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttaagaaggaatatggtnagttggtaccagcaagaagacaggccaggcccctagtcttggtggtatataaagacaggtgagaggccctacgaggactcccgtggagcgtattcgtctggtcctccgagcgtcgaagggaaccaacgacgtacctaacgtttcgaccatacgaggtagggacgtacccgaggaccacggaagacggaggcgtgacttattattagtacaatcagcacgacgaccggtaggtacttagttcgggttcggttcgggacgggacgggaccgacgtacgtcgaccgtcgtacgtcgacgtaccgacggcctccgcccccgtcggtacctaccttccgtccgttcccctacccgtttccctccttcgtcccg

SEQ ID NO: 178912 - DNA, 799 bp, Homo sapiens
  misc_feature: GYAE6OF02G5RBR.49.16.B05.1.454.CMB.1.raw
  modified_base (132)..(132): a, c, t, g, unknown or other
  misc_feature (132)..(132): n is a, c, g, or t
tcagagtcgagagacacgaccggtgctcgatttagagctcacgtaagggggtgggtccaggaggcagaactctgggtgtctcaccatggcctggatcccctctacttcctccccctcctcactctctgcacnggttctgaggcctcctatgagctgacacacgccaccctggtgtcacgtcgtccccaggacacggacggccaggtactccaccttggttttggagtacttacggttaacgaaaggaattagttggtactagttcggtaccagcaagaacgacgaggaccacggtccccctgttcgttggtaggtaataagtaaacgacgtacggtagacggacggtaccctgacgggactcccgtggacgtcgtacttcctcgtcggcctccgacgtccgtacgaagggtaacccaaacgtacggttacccgtaacggtttaccgaacccgtaagtccggtaagggttacggtaaccggtaccccgaagggacgtaacggaaacggtaccggaagggtccgttaacgtaacgtttaaagtttcgttaacgtaacctaaacttccgaaggtaacccgaaccggtaacccgggtaacccggggtttacggttaacctttaaccgggttccggggttacgggttcggggaccgggtaaccgggaacgtaaccgtcgtacggtacccgtaaccgtaggtcccgaccgtaccgaccgggtccgtacccccgtacccgttccggacccgttaccttcccgtacccggtttccccctccccgttacccgttccttcccgtacccg

SEQ ID NO: 178913 - DNA, 607 bp, Homo sapiens
  misc_feature: GYAE6OF02HGVE8.49.16.B05.1.454.CMB.1.raw
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgtttggagatacgttacgaaaggaatatggtcattggtaccagcaagaagacaggccacggcccctgtcgttggtggttataagtaaagactagtagaggacggccctcgagggactcccgtgacgcgatttcctcgtcggctccgagtctacggaagggaacaacgagtccacgtttagacctatcgagtggacgtaccgaggcaagaacgacggaggctgtaacttattatgtacaatcagcgagaccgacgttgtacttacgttgggtcgttacgggcggtaggacgtacgcgtcggacccgtcgtacgtcgacgaccgtacggccgtccgtcccccggtcggtacctaccgttccgttccggttcccccgtaccccttcccgttcctccgttacccg

SEQ ID NO: 178914 - DNA, 850 bp, Homo sapiens
  misc_feature: GYAE6OF02I0MSV.49.16.B05.1.454.CMB.1.raw
  modified_base (135)..(135): a, c, t, g, unknown or other
  misc_feature (135)..(135): n is a, c, g, or t
  modified_base (245)..(245): a, c, t, g, unknown or other
  misc_feature (245)..(245): n is a, c, g, or t
tcagagtcgagagacacgaccggtgctcgatttagagctcacgtaagggggtgggtccaggaggcagaactctgggtgtctcaccatggcctggatccctctacttctcccctcctcactctctgcacaggttcngaggcctcctatgagctgacacagcccaccctcggtgtcagtcgtccccaggacaggacggccaggactcaccttggtttggatatacggttaacgaaaggaatatggtnattcggtaccagcaagaagacgacggccgacggcccctgtcgttggtaggtataataaagacgagtgaaggacggcccctgaggggtactcccgtgacgcgtattcgtcgtggtcctccgacgtccgtcgaacgggaaccaaacgaccgttacctaaccggtttcgaaccctacgttacgacggttacggggtaccttacccggagggtacgagggaaaccgggaacggtacgggtacgttaacggtaaccttaagttttacgttaggttaacctaaattaacccgacggtaaccgtaaggtaacccggtaccggggtttacggtttaaaccggttttacggtttaccgggggtttcgggttacccggggacgggggtaaaccggggggtaaacctaacggggttacccggttaaccggtaccccggtttaaccggttaaccgggttaccgtaacccggtacccccgggtaaaggggtcccccgttaaccccgggtaccccccggttcccgggttacccttaccccggtttccgtttaaccccccggtttaccccccgttaacccccccgttttcccgtttacccccgtttaccccgttccccgg

SEQ ID NO: 178915 - DNA, 908 bp, Homo sapiens
  misc_feature: GYAE6OF02HEOYN.49.16.B05.1.454.CMB.1.raw
tcagagtcgagagacacgaccggtgctcgatttagagctcacgtaagggggtgggtccaggaggcagaactctgggtgtctcaccatggcctggatccctctacttctcccctcctcactctctgcacaggttcgtgacggccctcctatgagctgacacacgccacccgtcggtgtcagtcgtacccaggacaggacggccaggactcaccttgtttaggacgtagtacgttaacgaaaggtaatacgtcggtactagttcggtaaccagacgtaagaacgaacgacggggaccaccggtacccccgtggttaccgttagggttacggtaagtaacgtaaacgtaccggtaaggtaggtaacggaccgggtcccctacggtaacggggtacccgttccccggtaggaaccggtccgttaacgtttcccgttaccggttccgggacccttaccccgaggttccctaaacgggacccgggtaaactaaacgtccgggttacccggtaacctttaccggaaccttaaggtacccgtaagggtacggtaccggtacccggagggtaccaaaggggaacgtaaccgggagtaccgtacgtacgtttaacgtttaagttacgttaccgaacgttacgaacggtaccgaacgggtaccgtaccggggttacggttaaccgtttacgggtcggggttaccggttacgggggaccgggtaaccggggtaaccgtacgggttacccgttacgtacccccggttaccggtaacgggtaccctacccgggtacccggtaaccggggtccccgttaccccggtacccccggttaccggttaccctaccccggtttacccgtttccccggggttacccccgttccccggttaccccgtttacccttccccggtttaacccc

SEQ ID NO: 178916 - DNA, 689 bp, Homo sapiens
  misc_feature: GYAE6OF02G13TX.49.16.B05.1.454.CMB.1.raw
  modified_base (248)..(248): a, c, t, g, unknown or other
  misc_feature (248)..(248): n is a, c, g, or t
  modified_base (594)..(594): a, c, t, g, unknown or other
  misc_feature (594)..(594): n is a, c, g, or t
tcagagtcgagagacacgaccggtgctcgatttagagctcacgtaagggggtgggtccaggaggcagaactctgggtgtctcaccatggcctggactccctctacttcctccccctcctcactctctgcacagctctggaggcctcctatgagctgacacagcccaccctcggtgtcagtcgtccccgaggacaggaccggccaggactcaccgtgctcgtggagagtgcattcgaacccgaaacgtntatgtactttattacggaccagccaaggaacggcccgggccaccggcccctggttggttacggtgtaacgtagtaaataaacggactacgtaggaacggaccggtccctacggacgggtacctcccgtaggacgccgttaacttcggtcgtcgtccgttaccgaggtaccgacgggactaacggtcactagttcgacctaatcggaggtacgtcgtacgaggacgaagtacgggacgtagcttaacgaactttagtttaacgttgaactaactacgaaactacgacctacgttatttacgtaaattttcgcggttaacgtaccggtaacgtccaacgggtaaaccncggttacccctacggtaccggttcggactacccggacccaacccggtacccaacccttacggttccggaccctacgttcccgttacccgaccccc

SEQ ID NO: 178917 - DNA, 732 bp, Homo sapiens
  misc_feature: GYAE6OF02FUIBK.49.16.B05.1.454.CMB.1.raw
  modified_base (305)..(305): a, c, t, g, unknown or other
  misc_feature (305)..(305): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctccgtatgagctgacacacgccaccctcggtgtctagtcgtccccaggacagacggccgaggactcaccttgtttggagtagtacggttaacgaaaggaatagtggtcagttcggtaccagtacaagaagacacggccgacggccctgtcgttggtgtataanaaagacagtgagtcgcccctagagggtctcccgtaggacgtcgtacttccgtctcggcctccgagtccgtacgacgggacaactacgtaccgtaacggtttcaaccgtagtaccgaggtacggtaacggttcccggaaccgtaaggggacggtacgggaacgggtccgtacggtaaacgtttatttaaccgtcggttacgtaccgtaccgcgtaacgacgtagacgtggtacggtacttagttacgttacggttacgttacggttacggggtacgggtacgggttaaccgtacggtccgtaaccgggtaccgttaccgacgggttaccgaacccggtaccgtaaacggccccgttacccggtcccccggttacgttaccctccggttcccgttacccggttacccccgtccccgttccctttacccg

SEQ ID NO: 178918 - DNA, 690 bp, Homo sapiens
  misc_feature: GYAE6OF02FK06G.49.16.B05.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (327)..(327): a, c, t, g, unknown or other
  misc_feature (327)..(327): n is a, c, g, or t
tcagagtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtcgtcccccaggacagacggccaggatcacctgttttgganataccgttacgaaggaatntggtcagttcggtaccagtcagaagacaggccacggcccctgtcgtggtggtataagtaaagacacggtgagacggccctgagggactccngagcgtattcctcgtcggctccgacgtctacgacggaacgtaaccaggtcctaggtttacgaacctacgtacagtaggacgtccgaacgggtcgaaggaaagaccggaacgacggtagtaacccgttagtttacttggtacgtaaactacaacggttacgaacggtaacgtaacccgggtcggttaacttttacgggttacggggttggttaccggggaccggggaacgggtaccggaaagacctacggtaacccggtacgttacggtccacggaccggtaacggtccgtacccgtcccccggttcgaccgtcccgttccgttccggttcccctaccccttcccgtacccttcccgttcccgg

SEQ ID NO: 178919 - DNA, 961 bp, Homo sapiens
  misc_feature: GYAE6OF02IM0C4.49.16.B05.1.454.CMB.1.raw
tcagagtcgagagacacgaccggtgctcgatttagagctcacgtaagggggtgggtccgaggaggcagaactctgggtgtctcaccatggcctggatccctctacttctccccctcctcactctctgcacaggttctgaggcctcctatgagctgacacacgccaccctcggtgtcagtcgtccccgaggacagacggccaggatcaccttgttttggagattacgttaacggaaaggtaattagtggtactagttacggtaaccacggacaagaaggacgacgggaccacggtcccccgttaggttcgttgggtaggttaaataaacgtaaaacggactaaggtacggtaacggtaccggggtacccccttacgggaacgggggtaccttaccccgtagggaccggtaccgttaactttccgttacgttcgggtaacccttccccgaagggtcccttaagggaacgggtaaacctaaacggtacggttaaccgttaaccggttttacaacccggttaagtaccgtaaaggggtcgggtaaaccggttacccggaagggtaacccgaaacggggtaaaccggggaaccgggtaacgggtacccgttaagtaaaccgtttaaacgtttttacgtacggtttaaaccgtaattaccggtaacggtacctaaaccggtaaccggttaacccggggtttaacggtttacccgtttaacggggtttcgggggttaaccggggtttaccggggtaacccgggggtaaccgggtaaacccggtaagggttacccgtttaaccggggtaaccccggtttaacggttaccgggttaacccgaacccgggtaacccgtaaccggttccccggtaaccccggttcccccgttaacccggtcccttaaccgtttccccgttaccggttttaaccccccaccgttttaccccgttcccttacccggttaccccg

SEQ ID NO: 178920 - DNA, 788 bp, Homo sapiens
  misc_feature: GYAE6OF02JWX1L.49.16.B05.1.454.CMB.1.raw
  modified_base (177)..(177): a, c, t, g, unknown or other
  misc_feature (177)..(177): n is a, c, g, or t
  modified_base (731)..(731): a, c, t, g, unknown or other
  misc_feature (731)..(731): n is a, c, g, or t
tcagagtcgagagacacgaccggtgctcgatttagagctcacgtaaggggggtgggtccaggaggcagaactctgggtgtctcaccatggcctggatccctctacttcctccccctcctcactctctgcacagttctgacggcctcctatgagctgacacacgcccacccgtcggtntcgtagtcgtaccccgaggacaggaccggccgtaggactcgtaccgttggttttaggagtactttaacgtaaaccggaaaggtaacttagttcggtatacgttacggtaaccgagaccgtaaggaagacgacggaccgaacggtcccctggttcgttagggtacgtaaacttaagtaaacgacggtacggaggtaccggtaccggtccgtaaccggtacgggtaccgttacccgtaggttacggaccgttaccgtttaccgtacggttaccgttccgtaaccgacggtacccgttaacggaaacgggaccctaaacgtagttaaccccggttaacgttcgaaccccgtaagtaccggtacggtaccggtaccgtccggaaggacgtaaacggacggtaccggtaaggtccgtaacggtaacttaacgttatacgttactaacgacgtaccgacgtacgtaacccggtaccggttcgtaccgtaggttaggtcggtaccggacgggtacgacggtacgacgtccgtaccgtccgcgtcggaccgtccgacgtccnccggtaccgtcccttacgaccgttccgtaccgtcccacccgttcctcctacgttccg

SEQ ID NO: 178921 - DNA, 494 bp, Homo sapiens
  misc_feature: GYAE6OF01CHAGZ.15.81.H04.1.454.CMB.1.raw
  modified_base (299)..(299): a, c, t, g, unknown or other
  misc_feature (299)..(299): n is a, c, g, or t
tcagtctacgtagccacgaccggtgctcgatttagtagtgtagattcgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttangaggtcagtaatcggccctcaggggtttctaatcgcttctctggctccaagtctggcaacactgcctccctgaccatctctgggctccaggctgaggacgagggtgattatactgcagctcatatagaagtggcagcactctcgtatcggcggtggaccaagctgaccgtctaggtcagcccaaggctgcccccg

SEQ ID NO: 178922 - DNA, 508 bp, Homo sapiens
  misc_feature: GYAE6OF01DCHRH.15.81.H04.1.454.CMB.1.raw
  modified_base (476)..(476): a, c, t, g, unknown or other
  misc_feature (476)..(476): n is a, c, g, or t
  modified_base (503)..(503): a, c, t, g, unknown or other
  misc_feature (503)..(503): n is a, c, g, or t
  modified_base (506)..(508): a, c, t, g, unknown or other
  misc_feature (506)..(508): n is a, c, g, or t
tcagtctacgtagccacgaccggtgctcgatttagtagtgtagattcgcggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgagtcactaatcggcctcaggggtttctaatcgcttctctggctccaagtctggcaacacggcctccctgaccatctctgggctccaggctgaggacgaggctgattattattgctatctcatatacaaccaaacagcactctcgactggtattcggcggaggaccaagctgaccgtcctagtcagcccaaggctgccccctcggtcacctctcgttcccaccctcctcgctaccgtanacgtgagcgggctcgggcaaggcacanagnnn

SEQ ID NO: 178923 - DNA, 506 bp, Homo sapiens
  misc_feature: GYAE6OF01BKY1H.15.81.H04.1.454.CMB.1.raw
  modified_base (505)..(506): a, c, t, g, unknown or other
  misc_feature (505)..(506): n is a, c, g, or t
tcagtctacgtagccacgaccggtgctcgatttagtagtgtagattcgcgggggggtctcaggaggcagcgatctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggaggaccaagctgaccgtcctaggtcacgcccaaggctcgcccctcggtcactctcgtcccaccctcctcgccttacgacgactgagcgggctggcaaggcacatagnn

SEQ ID NO: 178924 - DNA, 508 bp, Homo sapiens
  misc_feature: GYAE6OF01D505U.15.81.H04.1.454.CMB.1.raw
  modified_base (318)..(318): a, c, t, g, unknown or other
  misc_feature (318)..(318): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttatgaggtcagtaatcggcctntaggggtttctaatcgcttctctggctccaagtctggcaacacggcctccctgaccatctctgggctccgaggctggaggacgnggtgattatactgcagctnataagtagaagtggacagcactctcgtattcgggcggtgggaccaagctagcccgtcgtaggcacgacccaaggcctcgcccctcgg

SEQ ID NO: 178925 - DNA, 730 bp, Homo sapiens
  misc_feature: GYAE6OF01C1E1S.15.81.H04.1.454.CMB.1.raw
  modified_base (209)..(209): a, c, t, g, unknown or other
  misc_feature (209)..(209): n is a, c, g, or t
tcagtctacgtagccacgaccggtgctcgatttagtagtgtagattcgcgggggggtctcaggaggcagcgctctcaggacatctccaccatggcctgggctctgctgctcctcaccctctcactcagggcacagggtcctgggcccagtctgccctgactcagcctgcctccgtgtccggtctcctggacagtcgatcatcatcttcngcactggatccagcagtgacgttgtagttatattatgtctctggtaccaactagtacccaggacaaacgcccccaaactcatgatttagtgaggtactaagtaacgtccgtacccctgtacggggtttctaactcgtctttctcgttcggcctaccgtaagtctcggacctaaccgaccggtcccttacccgtacgtaacccatttccgtccgttcgggtcccttaccggacggtcccgttaggaacgggtaaccggtaaggggttagttaacgttttaacgtttaacgttacggtaagtccgtacgtaattaagtaaggtaacggttagggaccgtaacggtcctaaccgttccgttacggtttacggttaccggggtacgggttaccgggaacccgtaaacgggtcccgttacccggtaacccggttacccggttacgggtaccccgtaaccggaccccggtaaacgggtccccgttaccccggaccccccccggtttaggtccccgtttaacccccgg

SEQ ID NO: 178926 - DNA, 509 bp, Homo sapiens
  misc_feature: GYAE6OF01EPHUU.15.81.H04.1.454.CMB.1.raw
  modified_base (424)..(424): a, c, t, g, unknown or other
  misc_feature (424)..(424): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttatgaggtcagtaatcggccctcaggggtttctaatcgcttctctggctccaagtctggcaacacggcctccctgaccatctctcgggctccaggctggaggacgagggtgattattactgcagctnatagtagaagtggcagcactctcgtattcgggcggtggaccgagctaggccgtctaggtccagcccaaggcctcgcccccgtcgg

SEQ ID NO: 178927 - DNA, 562 bp, Homo sapiens
  misc_feature: GYAE6OF01B15NI.15.81.H04.1.454.CMB.1.raw
  modified_base (434)..(434): a, c, t, g, unknown or other
  misc_feature (434)..(434): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtaccaggcaaacgccccaaactcatgatttatgaggtcagtaatcggcctcgtagggtttactaatcgtcttctctggctacaagtctggcaacaccggcctccctgacctatcctcgtcggctccaggctggaggacggtagggtagtattacttactgcagctanatatagaagtgacagactacctgtacgtacgttcgggtaccggtagggaaccgtaacggtctacggtaccccgttcgtaacgggtcctacggaccccgaagggtcccgtccggtccccccggttacgg

SEQ ID NO: 178928 - DNA, 531 bp, Homo sapiens
  misc_feature: GYAE6OF01B0X3T.15.81.H04.1.454.CMB.1.raw
  modified_base (301)..(301): a, c, t, g, unknown or other
  misc_feature (301)..(301): n is a, c, g, or t
  modified_base (403)..(403): a, c, t, g, unknown or other
  misc_feature (403)..(403): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcacgtggactccagcagtgacgttggtagttataattatgtctcctggtaccaacagtaccaggcaaacgccccaaatcatgtatttangaggtcagtaatcggcctcgagggtttctaatcgtcttctctgcctacagtctgacacacggcctcctgaccatctctcggctcgagctggaggacgaggtntattagtctgcagctacatagtagagtcggacagctacgtcgtacgttacgtcgggcggtacggaaccgacggtcctacggacccgttcgtaggtacgacgacccgaaggcctccggtcccccgtcgg

SEQ ID NO: 178929 - DNA, 501 bp, Homo sapiens
  misc_feature: GYAE6OF01CDWCD.15.81.H04.1.454.CMB.1.raw
  modified_base (299)..(299): a, c, t, g, unknown or other
  misc_feature (299)..(299): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaccaggcaaagccccaaactcatgatttangaggtcagtaatcggcctcaggggtttctaatcgcttctctggctcaagtctggcaacacggcctccctgaccatctctgggctcgaggctgacggacgagggtgtattattacgtgcagctacatatagaagtgacagcatcgtgtattcggcggtggacaagctgccgtctaggtcacgccaaggcctcggcccctacgg

SEQ ID NO: 178930 - DNA, 603 bp, Homo sapiens
  misc_feature: GYAE6OF01A7TQ9.15.81.H04.1.454.CMB.1.raw
  modified_base (265)..(265): a, c, t, g, unknown or other
  misc_feature (265)..(265): n is a, c, g, or t
  modified_base (340)..(340): a, c, t, g, unknown or other
  misc_feature (340)..(340): n is a, c, g, or t
tcagtctacgtagccacgaccggtgctcgatttagtagtgtagattcgcgggggggtcgtcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcatcttctgcactggatccagcagtgacgttggtagttataattatgtctctgtaccaanagtacccaggacaaacgacccccaaatcatgtattatgaggtcagtaactcgcctgagggtttcaatcgctttcncgtggctccgatcgtcggacaaacgccgtcccttccagacctatccgttcgtcgggctcccgaggtccgtagacgggaccggtagggtacgtatttagtaacgtgacgtcgtctacgtaattaagttaacggaaagtcgggtaccaagttcgaacttccgtaacggtacgttcggaccgggtaggtacccgaagtcgtaccggtacccggtacctagggtaactcggaaccccgtaaggtccttcccggtccccccgtaccgg

SEQ ID NO: 178931 - DNA, 521 bp, Homo sapiens
  misc_feature: GYAE6OF01ANINB.15.81.H04.1.454.CMB.1.raw
tcagtctacgtagccacgaccggtgctcgatttagtagtgtagattcgcgggggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaaagcccccaaatcatgtatttatgaggtcagtaatcggccctgaggggtttctaatcgctttctctggctcaagtctggcaacacggcctccctcgaccatctcgtcggctccaggctgaacggacgagggtgtattattactgcagctcatatagaagtgcaagcactctcgtgttcggcggtacggaccgtagctacggccgttccgtaggtccacggaccccaaggcctcgcccccgtcgg

SEQ ID NO: 178932 - DNA, 516 bp, Homo sapiens
  misc_feature: GYAE6OF01CJI5Q.15.81.H04.1.454.CMB.1.raw
  modified_base (302)..(302): a, c, t, g, unknown or other
  misc_feature (302)..(302): n is a, c, g, or t
  modified_base (422)..(422): a, c, t, g, unknown or other
  misc_feature (422)..(422): n is a, c, g, or t
  modified_base (503)..(503): a, c, t, g, unknown or other
  misc_feature (503)..(503): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacaggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaaactcatgatttangagtcagtaatcggccctcgagggtttcaatcgcttctctggcctccaagtctggcaacacggcctccctgacccatctcgtggcctccgaggctggagacggaggtgatttattactgnagctcatataagaagtgcagctactctacgttagtcggcggtggaaccgagctcggacccgtcgtaggcacggcccaagcnccgcccccgtcgg

SEQ ID NO: 178933 - DNA, 609 bp, Homo sapiens
  misc_feature: GYAE6OF01DR99F.15.81.H04.1.454.CMB.1.raw
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
  modified_base (432)..(432): a, c, t, g, unknown or other
  misc_feature (432)..(432): n is a, c, g, or t
  modified_base (606)..(606): a, c, t, g, unknown or other
  misc_feature (606)..(606): n is a, c, g, or t
tcagtctacgtagccacgaccggtgctcgatttagtagtgtagattcgcggggggggtctcaggaggcagcgctctcaggacatctccaccatggcctggctctgctgctcctcaccctcctcactcagggcacagggtcctgggtcctccactggaaccagcagtgacgttggtggttataactttgtctcctgataccaacagcacccaggacaaagcaacccaaattcatgtatttangaggtcaactaatccggcctcgtaggggtttctaatcgcttctctggctaccagtctggcaacgcgcctcccngaccatctctgggcctccgaggctacggaggacgaggctagtaatttattattgcatctactataactaacaaaccaacacgactacctcctacgtacgttaggtacgttaccggggnggaacgggaccaacggcgtacgtacccgtaccgtaggtccacggacccaacggtcctccgacccctcggtaccaccttccgtcccgttcccacccttccgtcgtaccgtacgtacgacgttcggacggtaccgggccttacgggaccgtaacgggccgtacgtaacgtaggtcngac

SEQ ID NO: 178934 - DNA, 505 bp, Homo sapiens
  misc_feature: GYAE6OF01CUJHG.15.81.H04.1.454.CMB.1.raw
  modified_base (239)..(239): a, c, t, g, unknown or other
  misc_feature (239)..(239): n is a, c, g, or t
  modified_base (358)..(358): a, c, t, g, unknown or other
  misc_feature (358)..(358): n is a, c, g, or t
  modified_base (461)..(461): a, c, t, g, unknown or other
  misc_feature (461)..(461): n is a, c, g, or t
  modified_base (481)..(481): a, c, t, g, unknown or other
  misc_feature (481)..(481): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaacccaaattcatgattangagtcactatcggcctcgagggtttctaatcgtcttctctggctccaagtctggcaacaccggcctccctgaccatctctggctcgagctgaggacgaggctagattattatgcatctnatatacaaccaacagcactctcgactggtactcggcggaggaccagctgaccgttcagtcacgcccaagctcgccccgtcgtctactctccttcccacctccncgctacgtgcgtgagcgggntcggcgaacggtcganagtagngn

SEQ ID NO: 178935 - DNA, 611 bp, Homo sapiens
  misc_feature: GYAE6OF01BROBQ.15.81.H04.1.454.CMB.1.raw
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcgagggcacagggtcctgggcccagtctgccctgactcagcctgcctccgtgtctgggtctcgtggacagtcgatcatcatcttctgcactggactccagcagtgtacgttaggtagttaataattatgtctctggtaaccaacacgtaaccaggaccaaacgaccccaaatcatgtatttangtagtcagtactcggcctcgtagggtttactagtccncttctntcggtctaccgagtctggaccaacgtacggtccctcccgtacgacctacgttcctcggtcggcctccgagggtctaggagggtacggtagggttagtaatttacttacgtgactcgtcctagtaacttaagtaagtaacggcggtacacgtactaccgttcgtacgttaggtcgggtacgggttacggaccgtaagtcgacgttacccgtacgtacgtcgaccgtacccgaacggtccctccggtcccccgttaccgg

SEQ ID NO: 178936 - DNA, 540 bp, Homo sapiens
  misc_feature: GYAE6OF01AZWN5.15.81.H04.1.454.CMB.1.raw
  modified_base (212)..(212): a, c, t, g, unknown or other
  misc_feature (212)..(212): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcactggatccagcagtgacgttggtagttataattatgtctcctggtaccaacagtacccaggcaaacgcccccaaactcatgatttatgagtcagtaatcggccctcgtagggtttctaactcgcttctctcggctccgaagtctggacaacacggtccttccctgacccattctcgtgggcctccgaggctaggaggacggtagggtgtatttacgtactgctagctacatagtaaggagtgacagctactcgtacgtagttcgggacggtacggacgaagtctacggtccgtcgtaggtcacgacccgagcctccgccccgtcg

SEQ ID NO: 178937 - DNA, 556 bp, Homo sapiens
  misc_feature: GYAE6OF01BFBJ5.15.81.H04.1.454.CMB.1.raw
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (433)..(433): a, c, t, g, unknown or other
  misc_feature (433)..(433): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtattataattatgtctcctggtaccaacagtacccaggcaaacgcccccaaactcatgatttangagtcagtaatcgcctntagggtttctaatcgcttctctggtctcaagtctggcaacncggtcctccctgacctactctcgtgggcctccgaggctaggacgggacgagggtgatttattacgtgcagctanattaagtagtaggtgaccgtagcctactcgtcgttacgttcgggcggttacgggaaccaggtccgtggtacccgtccgttacggccaacggcccgaacggccttcccggcccccttacccggg

SEQ ID NO: 178938 - DNA, 622 bp, Homo sapiens
  misc_feature: GYAE6OF01CSJHV.15.81.H04.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
tcagtctacgtagccacgaccggtgctcgatttagtagtgtagattcgcgggggggtctcaggaggcagcgctctcaggacatctccaccatggcctgggctctgctgctctcaccctctcactcagggcacagggtcctggcccagtctgccctgactcagcctgcctcgtgtcctgggtcctcgtaggacagtcgatcatcatcttngctactgactcagcagtgacgttggtattatatatgtctctggtaccaacacgtaccaggacaaacgaccccaatcatagatttangagtcagtaatcgcctgtagggttcaatcgtcttcgtctcggctcgtaacgtctggacctaacgacggccctacccgtagaccctattccgtccgttggggacccttaccccggaaggtcccgttaagggaacgggtaaccgggtagggttacgttaattttaacgttaccgttacgacgtacgtacctacgtaatttaacgaaggtaaggtcgggacacggtacctactcgttcgtagtcgggcggttacggaaccgtacggcgtaccgccggttaccgtagttaccgacggaccccaagggtccctcccggtaccccgttcccgg

SEQ ID NO: 178939 - DNA, 655 bp, Homo sapiens
  misc_feature: GYAE6OF01CA7B9.15.81.H04.1.454.CMB.1.raw
  modified_base (211)..(211): a, c, t, g, unknown or other
  misc_feature (211)..(211): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcactggatccagcagtgacgttggtagttataattatgtctcctggtaccaacacgtacccaggcaaacgcccccaaactccatgtatttatgtaggtcaagttaatccggcccttcgtagggtttactaatcgcttctctggctcaagtctcggcaacaccggtcctccctcgacctactcgtcgtcggcctccgacggtcgtaggacggacgtagggtacgtaagtttaacttacgtgtaccaacgtccttactaagtaacgtaaggtaaacggttgggacctaacggacctaccgttaccgttacggttacgttccggggtaccgggttacggggaacccgtaacgggtacccgttacggtaacccccggttccgttaacgggtaccgaacccggtaccccgaacgggtccccttacccggtccccccggtttacccggg

SEQ ID NO: 178940 - DNA, 575 bp, Homo sapiens
  misc_feature: GYAE6OF01EW5J4.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcacccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaccaggcaaacgcccccaaactcatgtatttatgagtcagtactcggccctagtaggggtttctaatcgtcttctctcggctacaagtctggacaacgaccggccctcccgtgacctatctcgtcgggcctccgaggctaggacggacggtagggtgtaatttagttactgacagtcctacaattagtaagtaaggtggactagcctactcgtacgttacgttcgggtacgggtacggaccgaggtcctacggtacccgtcgtacggtccgtacggacccgaagggcctcccggccccgttccgg

SEQ ID NO: 178941 - DNA, 667 bp, Homo sapiens
  misc_feature: GYAE6OF01BDQFE.15.81.H04.1.454.CMB.1.raw
  modified_base (315)..(315): a, c, t, g, unknown or other
  misc_feature (315)..(315): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcgagggcacagggtcctgggcccagtctgccctgactcagcctgcctccgtgtcgtgggtctccgtggacagtcgatcatcatcttctgcagtgactccagcagtgtacgttaggtagttataattatgtctctcggtaccaacacgtaccaggacaaacgaccccaaactcatgtatttatgacgtnagtatccggtccgtcgtacgggtttctaagtcgtcttcctacgtcgtcctaccgtacgtcgtacggaccgtaaccgacccggtcccctacccgtacgtaccctacgttcctaccggtcggccttacccggtaggtacccggtacgggaagggtaacgggtacgggttacgttaaacgtttaccgttacgtcggacgtacgtcttaactagttaacgtagaagggtccgacagttaccgactcgtacgttacggttccgggacgggtacggacccgtaggtaccgtacgtacccgggtacgttaccgggacctaaccggacccgaacgggtccctcccgtcccggttccccgg

SEQ ID NO: 178942 - DNA, 508 bp, Homo sapiens
  misc_feature: GYAE6OF01E4FLI.15.81.H04.1.454.CMB.1.raw
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
  modified_base (506)..(508): a, c, t, g, unknown or other
  misc_feature (506)..(508): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcaccaggcaaagcacccaaattcatgatttatgaggtcactaatcggccctcaggggtttctaatcgcttctctggctccaagtctggcaacacggccctccctgaccatctctgggctccaggctgaggacgaggctgattattattgcatctcatatacaaccaacagcactctcgactggtattcggcggagggccaagctgacccgtcctaggtcacgcccaacggctcgccccctcggtccactctcgttccccaccctcctcgctacgnacgtgagcggctggcagcganatgnnn

SEQ ID NO: 178943 - DNA, 600 bp, Homo sapiens
  misc_feature: GYAE6OF01BZJIR.15.81.H04.1.454.CMB.1.raw
  modified_base (242)..(242): a, c, t, g, unknown or other
  misc_feature (242)..(242): n is a, c, g, or t
  modified_base (530)..(530): a, c, t, g, unknown or other
  misc_feature (530)..(530): n is a, c, g, or t
  modified_base (575)..(575): a, c, t, g, unknown or other
  misc_feature (575)..(575): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
tcagtctacgtagccacgaccggtgctcgatttagtagtgtagattcgcgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagccacccaggcaaagcaacccaaattcatgatttangagtcactaatccggccctcgagggtttctaatccgtcttctctggcctcaagtctggcaacgaccggccctccctcgaccatcctcgtgggcctccgaggctggacgggacgaggctagtatttattattgactatctctaataactaaccaaacccaacacgccactctcgtacgtggtacgttcgggacgggtacgggaaccaaggtcctacgacccgtccgtaggtccaacggcccgaaggcctccggcccccgttcggtacctaccttccgtcccgttccccnccccttccgtccgtccgtacgtacgtacgtcggaccggcgggtcncgggacgacggcgtacgagcgncgn

SEQ ID NO: 178944 - DNA, 542 bp, Homo sapiens
  misc_feature: GYAE6OF01DJQAL.15.81.H04.1.454.CMB.1.raw
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
  modified_base (471)..(471): a, c, t, g, unknown or other
  misc_feature (471)..(471): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtccgggtctcctggacagtcgatcatcatcttctgcactggatccagcagtgacgttggtagttataattatgtctcctggtaccaacagtacccaggacaaacgcccccaaactcatgtatttangaggtcagtaactcggtccctacgagggtttctaatcgcttctcgtgctcaagtctggcaacncggcctcctgaccatctcgtcggcctccgaggctggaggacggaggtgattattactgaccactcattatagtaagtactactacgtccgtgttgggttttcggnggtacgggaccaagccgtagaccgtccgtaggtcacgacccgagcctcgcccctggtccacgttcgtcccg

SEQ ID NO: 178945 - DNA, 626 bp, Homo sapiens
  misc_feature: GYAE6OF01A3XB7.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgtacgttggtattataattatgtctcctggtaccaacacgtacccaggcaaacgcccccaaactccatgatttatgaggtcaagtaatcccggccttcgtagggtttctaagtcgtccttcgtctgggcctaccgtaagttccgtggaccaaccgtacggtcccctacccgtcggtaacccacgttccctcggtcgggtacctcccgtacgggccgttacggacggggacggtagggtgtaagtttacgttacgtgacgacgttcctagtattaacgtaaggacggtaggccgaagtccacctcttacgtagtacgacggtcgggtacggaaccaggtccgtcggtaacccgtcgtacggtacaccggacccgacggtccttacccggtcccccgg

SEQ ID NO: 178946 - DNA, 510 bp, Homo sapiens
  misc_feature: GYAE6OF01AWNVD.15.81.H04.1.454.CMB.1.raw
  modified_base (239)..(239): a, c, t, g, unknown or other
  misc_feature (239)..(239): n is a, c, g, or t
  modified_base (491)..(491): a, c, t, g, unknown or other
  misc_feature (491)..(491): n is a, c, g, or t
  modified_base (506)..(506): a, c, t, g, unknown or other
  misc_feature (506)..(506): n is a, c, g, or t
  modified_base (508)..(510): a, c, t, g, unknown or other
  misc_feature (508)..(510): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangaggtcactaatcggcctcaggggtttctaatcgcttctctggctccagtctggcaacacggcctccctgaccatctctgggctccaggctgaggacgaggctgattattattgctatctcatataacaaccaacagcactctcgacttggtacttcggcggaggaccaagctcgaccgtccgtagcagccaagctcgcccctcgtcactctcgttccccgccctcctcgctacgtagaccgtgacgcgggntcggcaaggcgacangnnn

SEQ ID NO: 178947 - DNA, 674 bp, Homo sapiens
  misc_feature: GYAE6OF01ALQAA.15.81.H04.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (423)..(423): a, c, t, g, unknown or other
  misc_feature (423)..(423): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcattcttcngcacgtggactccagcagtgtacgttggtaagttataattntgtctcctaggtaccaacacgtaccaggaccaaaccgacccccaatctatgtatttagtggaacgtcgtaacgtacgtccggccttacggtagggtttactaacgtccgtcttctacgtcggtacctacgtacgtcgtacggacaaccgccgtccctaccgtcgacctntccgtcgtcggtacctcggacggtcgtaggacgggtacggtagggttcgttaacgtttactacgtacgactacgtacctagtaagttaagtacggacggttacggactacgtaccgtaccttaccgtcgggttacgtccggggtaccgggtaccggtaaccgtacggtaccggtaccggtaccccggttacggtaccgtaccgtaaccggacccgtaaccgggtccccgttaccccggtcccccggttacg

SEQ ID NO: 178948 - DNA, 839 bp, Homo sapiens
  misc_feature: GYAE6OF01CG43V.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcgagggcacgagggtcctgggtcctccactggaaccagcagtgacgttggtgttataactttgtctcctgactaccaacacgaccacccaggaccaaacgccaacccaaatttcaattagtatttagtggaacggtacaacttaacgtccggacccttcggtacggggttttacctaaagttccgtctttccttcgtcggtcctaccaagttcctgggacccaaaccgaccggtccccttcccgtacggtaaccctacgttcccgttcggtcgggacccttacccggaacgggtccttaggggaaacgggtaccggtagggtaccttaggtaaatttttaagtttaacgtttcggaccttaacttccctttaaccgtaaatttaaaccctaaacccgtaaaacccctaaacgaaccggtaccctaaccccgtttaccgtaccccggttaacgttacggggtttaaccggtttacccggggaaccggggtaacgggaaccctaaacggtccgtaccgggtaaccccggttaccgttacggtaccgacggacccgtaacgggtcctacccgtccccgtacggtacctaccttccgtacccggtttcccccgcccgttccgtacccggtacccgttaccggtacggtacccggtacggacggttccgggtcgtacccgggtaaccggaacggtccgtacgaagtccggagcgtag

SEQ ID NO: 178949 - DNA, 632 bp, Homo sapiens
  misc_feature: GYAE6OF01BTTTD.15.81.H04.1.454.CMB.1.raw
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (626)..(626): a, c, t, g, unknown or other
  misc_feature (626)..(626): n is a, c, g, or t
tcagtctacgtagccacgaccggtgctcgatttagtagtgtagattcgcggggggggtctcaggaggcagcgctctcaggacatctccaccatggcctggctctgctgctcctcaccctcctcactcagggcacagggtcctgggtcctccactggaaccagcagtgacgttggtggttataactttgtctcctgataccaacagcacccaggcaaagcaacccaaattcatgatttangagtcactaatcggccctgagggtttctaatcgcttctntggctccaagtctggcaacacggcctccctgaccatctctgggctccgaggcctggaggacgaggctgatttattattgcattctacatactaaccaaaccaaacacgccaactctacgacgtaggttagttccggcgggaacggtaaccaacggtcctacggtacccgtccgtacgggtccaccggacccgaagggtccctaccggccccccgttacgggtccctaaccctttccgttcccgttaccccccgtacccccttcccgttcccgtaccgttaaacccggtcgtaccgtcggtaacgggccggggtccgtcgggaccgaaacggggtcccgacgaatcggngtcgcg

SEQ ID NO: 178950 - DNA, 737 bp, Homo sapiens
  misc_feature: GYAE6OF01BK6E1.15.81.H04.1.454.CMB.1.raw
  modified_base (217)..(217): a, c, t, g, unknown or other
  misc_feature (217)..(217): n is a, c, g, or t
tcagtctacgtagccacgaccggtgctcgatttagtagtgtagattcgcgggggggtctcgaggaggcagcgctctcaggacatctccaccatcggcctgggctctgctgctcctcaccctcctcactcagggcacagggtcctgggcccagtctgccctgactcagcctgccctccgtgtccgggtctccgtggacaggtcgatcatcattcttcngcacgtggactccagcagtgacgttggattataattatgtctcctggtaccaacacgtaccgaggacaaacgtccccaaacgtccatcgtaatttatgaggtactaggtaatcggcccgtacgtacgggtttactaagtcgtcgtttacgtcgtcggtacctaccgtaagttccgtacggacctaaccgacccgggtccctacccgtacggaaccctacgttacccgtacggtccgggtaccttaccgtacgggtaccgttaggaaaccgggaacgggtaacggggtagttaacgtttaacgttaaccgttaggtaacgtccgttaacgtaagttaacgtaacggtaaggtacggtacgtaacgtacgtaaccgttaccgtacgggttacgttaccgggcgggttaccggacctaaaggtccgtaccggtacccggttaccggttaacggaccgtaaaccggaccccggtacgggtacccgttaccccggtacccccgtaccgggttcccttaaccccgg

SEQ ID NO: 178951 - DNA, 664 bp, Homo sapiens
  misc_feature: GYAE6OF01DFLJ6.15.81.H04.1.454.CMB.1.raw
  modified_base (239)..(239): a, c, t, g, unknown or other
  misc_feature (239)..(239): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaacccaaattcatgattangagtcatatcggcctcagggttctaatcgcttctctgtctcaagtctggcaacgaccgcctccctcgacctatcctcgtcgggtcctccgaggctaggacggacgaggctagtatttattagttgctatctactattaactaaccaaacctaacacgtacctactctacgtacgttaggtacgttcgggacgggtaacgggaacctacggcgtacggtacccgtccgtacggtaccgtacggaccccgtaacgggtccgtccccgtaccccccgttacggtacccgttccgttccgttcccgtttacccccccgtacccgtttccccgtacccgtaccggttaacccggttacgtacccggtacggtacggggtacccggggtccgttacggggaaccgaacgggtccgaacgtagtcgatggac

SEQ ID NO: 178952 - DNA, 670 bp, Homo sapiens
  misc_feature: GYAE6OF01DIONF.15.81.H04.1.454.CMB.1.raw
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgactaccaacagccacccaggcaaagccaacccaaattcatgatttatgaggtcactatccggcctcgtagggtttactatcgtcttctctggctccaagtctgcaacaccggtcctccctcgacctactctcgtcggctccgaggcctaggaggacgacggtctacggtatttaacttattcgtactactctactagttaactaaccaaaccctaacacggtacctaaccttccgtaccgtacgttagggtaacgtttccggggacgggaaacggggacccaacggtcgtaccggtaacccgttccggtaacggtccgaaccggacccgtaaacgggcccgtacccgtccccccgttcggtaccctacttcccgttacccgttcccccgttccctcccttccggtaccttacgggtacgtaccgacgggtacggcgggtcgtaccgggacggacgggcctacgagtcgntnacg

SEQ ID NO: 178953 - DNA, 620 bp, Homo sapiens
  misc_feature: GYAE6OF01BERT2.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctctcactcagggcacagggtcctgggcccagtctgccctgactcagcctgcctccgtgtctgggtctccgtggacagtcgatcatcatcttctgcactggatccagcagtgacgttgtagttataattatgtctcctaggtaccaacacgtaccaggacaaacgccccaaactcatgatttatgaggtcaagtaactccggtaccctacgtacggggtttactaactcgtctttacgtcgtcggtctaccgtaagtcgtcggacctaacgaccggtccctacccgtacgaccctatccgtcgtcgggccttccgagggtctaggacggacggtagggttagtacttagttacgtcggtacaggtcctacgtaataagtaggaaggtggacacgtaccgtacttcgtaccgttaggttccggcgggttacggaccgaaggtcgttacgaccggtaccctaggtaccgaccggaccgaagggtccctacggtcccccgtacgg

SEQ ID NO: 178954 - DNA, 542 bp, Homo sapiens
  misc_feature: GYAE6OF01A7EF0.15.81.H04.1.454.CMB.1.raw
  modified_base (425)..(425): a, c, t, g, unknown or other
  misc_feature (425)..(425): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcatcatcttctgcactggaaccagcagtgatgttgggggttatcaccttgtctcctggtaccaacaccacccggcacgacgcccccaaactcatgatttatgagccactaacgccgaccctcgagggtcctttctaactcgtcttctcgtgcctaccaagtctggcacgacggtcctcctgtacatctctcggctccgagtctgacgacgagcttaattatactnctgtctcgattgtagtaaggttaataactaacttatactacgtcggacggtaacggacgaacgcgtcgtaccgtcgtcgcgtcacgtcccaacggtcctaccgcccccgtggtaccc

SEQ ID NO: 178955 - DNA, 647 bp, Homo sapiens
  misc_feature: GYAE6OF01BFCXU.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgacgttggtagttataattatgtctcctggtaccaacacgtacccgaggaccaaacgacccccaaactcgatcgtatttatggagtcagtaactcggccctagtagggtttctaacgtcgtacttcgtcgtcggctaccgagtcgtggaccaacgtaccggccctcctacgacctacttcgtcgtcggcctccgaggtctagggacgggacggtagggtacgtactttaacgttacgtcgacgtacgtctactaagttaagtaaggtaaacggtcggacgtaacgccttaccgtcgttacggttacggttccggggtacgggtaacgggaacccgtaacggtcgtacggtaccccgttcggtacggtaccgtaccggaccccgtaagggtcccgttcccgggtccccccgttaccgg

SEQ ID NO: 178956 - DNA, 675 bp, Homo sapiens
  misc_feature: GYAE6OF01DS9PI.15.81.H04.1.454.CMB.1.raw
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (456)..(456): a, c, t, g, unknown or other
  misc_feature (456)..(456): n is a, c, g, or t
tcagtctacgtagccacgaccggtgctcgatttagtagtgtagattcgcggggggggtctcaggaggcagcgctctcaggacatctccaccatggcctgggctctgctgctcctcaccctctcactcagggcacgagggtcctgggcccagtctgccctgactcagcctgcctcgtgtctgggtctcgtggacagtcgatcatcatcttctgcatggactccagcagtgacgttgtagttataattatgtctactgtaccaacagtacccaggacaaacgccccaaactcatgtacttagngagtcagtaactcgcctgtagggttactagtcgtnttctcgtcgctacaagtcgtgacacgtacggcctccgtcgacctactcctcgtggtcctacgcggtctagggacggacgggtagggttagtacttaacttacgtcggactataccgttanaagtttaagtaagggtaacggttggaaccgtacgtacctaaccgttccgtttacgggttaacgttcccgggggtcgggttaaccgggaacccgtaaacgggttcccgtaacccggggttacccgttaccccggggttaaacgggttacccgaaaccccgggtaccgggttaacccgggtcccccggtttcccccggtcccccccggttttaacccgggg

SEQ ID NO: 178957 - DNA, 886 bp, Homo sapiens
  misc_feature: GYAE6OF01AKKYU.15.81.H04.1.454.CMB.1.raw
tcagtctacgtagccacgaccggtgctcgatttagtagtgtagattcgcgggggggtctcaggaggcagcgctctcaggacatctccaccatgcctgggctctgctgctcctcaccctcctcactcagggcacagggtcctgggcccagtctgccctgactcagcctgcctcgtgtctgggtctccgtggacaggtcatcatcgattccgttctgacctaacgtggtactacccgagtcgtacggtgttaaccggtttaggtaagttaacttaattattcgttactccgtacggtaaccaacgacgttaacccgacggacctaaaccgacccctaaacgtctacgttagtacgtttaagtcggtaacgtacgtaacgttaacgtccggtacccgttacggttacggggttttactaacggttcttaccgttacgtcgtacggtacctacgtaacggtcggtacgtaccgtaacgtacccggtaccgttccgtacgtaccttaccgttaccgtccggttccgggtaccgtaaccgggtaccgggttaccgtaacgggggtaaaccgggtaaccgggtttaacggggttacgtttaaaccgttttaaccggttaaccggtccgtaaccggttaaccgttaccgttaaaccgtttaacgtaacgggttaaacgggtaacgggttacggggtaccaacccgggttaccggttacccgtttaccggtaacccgggtttccgggttaacccggggtcgggggttaaacccggtaacccgtaaaggttcccgggttaacccggttacccgtaaccgggtttaccggtaccggtaaaacccgggtcccgttaaaccggggttccccgtaccgggttaccccccggttaccgggg

SEQ ID NO: 178958 - DNA, 665 bp, Homo sapiens
  misc_feature: GYAE6OF01AUJL0.15.81.H04.1.454.CMB.1.raw
  modified_base (211)..(211): a, c, t, g, unknown or other
  misc_feature (211)..(211): n is a, c, g, or t
  modified_base (313)..(313): a, c, t, g, unknown or other
  misc_feature (313)..(313): n is a, c, g, or t
tcagtctacgtagccacgaccggtgctcgatttagtagtgtagattcgcggggggggtctcaggaggcagcgctctcaggacatctccaccatggcctggctctgctgctcctcaccctcctcactcagggcacagggtcctgggcccagtctgccctgactcagcctgcctccgtgtctgggtctccgtggacagtcgatcatcatcttntgctactgactccagcaggtcgacgttggtaagttataattatgtctccgtggtaccaacgacgtacccaggcaaaccgccccctaaactcatagtatttanggtacgtacaagttaactccggtacccttacgtaggggtttactaacgtcgtacttctcggtcggacctaccgtaagtccgttggacctaaccgcggtccctcctgacctactcctacgtcgggtcctacggcgtcgtacggacgggtaacggtggggtataacgtttacgtacgtcgtacgacgtctacctaagttagtaacggacgtacgtacgtaagtccgtacgttccgtacggttacgttcggggtcgggtaccggaaccgtcgtaccgtacggttaccccggttacgtaccgggttaacccaccggtacccggtaacggtccgtccccggtcccccggttacccgg

SEQ ID NO: 178959 - DNA, 733 bp, Homo sapiens
  misc_feature: GYAE6OF01DP4QS.15.81.H04.1.454.CMB.1.raw
  modified_base (319)..(319): a, c, t, g, unknown or other
  misc_feature (319)..(319): n is a, c, g, or t
tcagtctacgtagccacgaccggtgctcgatttagtagtgtagattcgcggggggggtctcaggaggcagcgctctcaggacatctccaccatggcctggctctgctgctcctcaccctcctcactcagggcacagggtcctgggcccagtctgccctgactcagcctgcctcgtgtctggtctccgtggacagtcgatcatcatcttctgcactggactccagacgagtgtacgtttggtaagtttaattaattatcgtctcctacgtaccaacgtacgtaccgagaccaaaccgaccccaaactcatgtactttagngtagtactagtacgtcgtccgtacgtacgggttactactcgtcttcgttcgtacgtcctacgtaacgtcgtcggacaccgtacccgtccctaccgttacacccttacgtccgttacggtcggtacccgtacgtacgggtacgtacgggacggggtaaaccgggtggggttaacgttaacgttttaacgttaaccggtcgaacgtacccttacgtaacgtagttaaacgttacggaagggttcgggtacaccggttacttaccgtttacgttacgggttaacgggttcccggggtaacgggtaccgggtaaccgtaacgtacccgggttacccggtaccccgttaccgggttacgtaacccggtacccggtaaccccggtaaccggtcccggtccccgttaccccccggtaccgg

SEQ ID NO: 178960 - DNA, 713 bp, Homo sapiens
  misc_feature: GYAE6OF01BMY86.15.81.H04.1.454.CMB.1.raw
tcagtctacgtagccacgaccggtgctcgatttagtagtgtagattcgcgggggggggtctcaggaggcagcgctctcaggacatttccaccatggcctgggctctgctgctcctcaccctcctcactcagggcacagggtcctgggcccagtctgccctgactcagcctgcctccgtgtctgggtctccgtggacagtcgatcatcatctcctgcactcggaaccagcagtgagttgggtttgggggttatctaccttgtccttccgtcggtaacccaaccacccgacccggcaacgaccgacccccaaactcatgtatttagcggacggccaacgtaacgccgaccctcgacgggtctttactaactccgtcttcctcgtcgtacctaccaagtcgtacggaccaaccgacccggtccctcccgtacgaacctaacttccgttacggtcgggtcctaccggacggtccgtacgggaaccggaacggtaacggtaactttaaacgtttacgtttacgtgtccgttaccgtcttactaagttaacgtaaggttaaacgtttaactaaacctaacgttaacgttaaccttacgggtaccgggacgggtaacggaacccgtaggtaccgtaccggtcccgtccgtacggccgtaccgaacccggacccgtaaccgggcccgttaccccggtcccccgttcggtcccttaccccgg

SEQ ID NO: 178961 - DNA, 639 bp, Homo sapiens
  misc_feature: GYAE6OF01BW0F7.15.81.H04.1.454.CMB.1.raw
  modified_base (212)..(212): a, c, t, g, unknown or other
  misc_feature (212)..(212): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcgtggacagtcgatcatcatcttcngcactggactccagcagtgacgttggtatatatatgtctctgtacacacgtaccagacaacgccccaatcatgtatttagtgaggtacagttacttcggccctcgtaggggtttactaacgtcgtctttcgtctggtctccaagtctcgacaactacgcctccctcgacctactctcgtccgggctccggaggtctaggacgggacggtagggtagtacttacttacgtgacgtagtctaccgtaataacgtaaggaaggtcggtctacgacctacgttacgtacggttaacgttccgggtacgggtaacgggtaacccgtacgggttacctaccgggttaaccccggtaccggttaaccgggtacccggtaacccggtacccggtaaacgggtccccgtaccccgggttccccccggttacccggg

SEQ ID NO: 178962 - DNA, 813 bp, Homo sapiens
  misc_feature: GYAE6OF01EV8XS.15.81.H04.1.454.CMB.1.raw
  modified_base (217)..(217): a, c, t, g, unknown or other
  misc_feature (217)..(217): n is a, c, g, or t
  modified_base (592)..(592): a, c, t, g, unknown or other
  misc_feature (592)..(592): n is a, c, g, or t
tcagtctacgtagccacgaccggtgctcgatttagtagtgtagattcgcggggggggtctcaggaggcagcgctctcaggacatctccaccatggcctgggctctgctgcctcctcaccctctcactcgaggcacgagggtcctgggcccagtctcgccctgactcagcctgcctcgtgtcgtcggtctcgtggacagtcgatcatctacttcttcngctacgtgactccgagcgtagtgtacggtttagttaagtttaataattagtcgttccgtaccgtacgtaaccaaacgtacgtaacccgaaggaacccaaaacccgaccccctaaactcgtaagttacgttattttacgaagggtacgtaaccgtaaggttaactccccgggtaccttacgggttaacggggtttaccttaacgtccgttaccgtttcgcggttcgtacccgttataaccggttcgtaccggaaccctaacccggtacccggtacccctaccgtacaacccgttctacccggttccggtacggtccgtacggacggtcgtaacgggaccgggtagggtacggttaacgtaacgtttacgttaccgngtaacgacgtacgtaacgtaagttaacgggtaaggtacggttacggaccgtaccgttacccgtaacgttaccgtttaccggtcgggttaaccggggtaccgggtaaccgggaaacccgttacggtaaccggttacccggttaaaccgaccgggtttacaaccccggggttaccgacccgggtaaaccggtccccctcccccggttaccccggttaacccgg

SEQ ID NO: 178963 - DNA, 1009 bp, Homo sapiens
  misc_feature: GYAE6OF01EVWZT.15.81.H04.1.454.CMB.1.raw
  modified_base (211)..(211): a, c, t, g, unknown or other
  misc_feature (211)..(211): n is a, c, g, or t
tcagtctacgtagccacgaccggtgctcgatttagtagtgtagattcgcgggggggtctcaggaggcagcgctctcagacatctccaccatggcctgggctctgctgctcctcaccctctcactcagggcacgagggtcctgggcccagtctgccctgactcagcctgcctcgtgtctgggtctccgtaggactgtcgatcatcatcttcngctacgtggactcccgaagcgaggtttcgtaacggggttttggttaagtttaattaagtttacttcgttccgttacccgttaggtaaccctaaccgtaacgttacccccgaacggacccgtaaaaaccggtacccccccgtaaaacgtacctaacgttttaacggttaaccgttttaaggtacgggttaacgggtttaaccggtaaacggttttaaaccggttacccgggttacccccggtttacggttaaccgggggtttttacctaaaccggttccggttacccgtttaccgttcggttaccgggttacccgttacccgggtaaacggtttaccggttaccgggaacccgtaaaccccggtacccgggttaccccctttacccgtaacccggtaacccttaccggtttcccgttacccgggtttaccgggccccggtttaaccccggacggggttaaccccggtaacggggttaaaccggggggtaaccgggttaacgggggtttaacgttaaacggtttttaacccggttaacgttaccgggtaccttaacccggggttcttaaccgtaaacgttaacggtttaaacgggtaacggttaccgggtaacgttaccgggtacccgttaaccgttaccggttttaacccgggttagggtttccccggggagggtttaacccgggtaccggtaacccggttacggttacccgggtaccccgggttaaccgttcgggaaccccgttaacgggtacccccgtaacggtaccccggtttcccccgtccccgggttaccccgg

SEQ ID NO: 178964 - DNA, 825 bp, Homo sapiens
  misc_feature: GYAE6OF01ELVYJ.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctcgtgtctgggtctctggacagtcgatcatcattcttctgctacgtggactccagctagttcgtacgttggttaagttattaattatcgttcctccttacggtaacccaacgtacgtaccccgaaggaccaaaaccgaccccctaaaactctacgttagaacgttttagtacggtaacggttaccgtaaggtaaccgtccgggtaccttacgggttaaggggtttacctaaacgttccgtaccgtttcgtccgttacggttccctaccgtaacggttccgtacggtaaccgtaaaacccggtcccggtcccccttaacccgtaccggtaaaccctccgtttcccggtccgtaccggggtaccctaaccggtaacggggtacccgtaacgggtaacggggaaccgggtagggtttacgttaagttttacgtaccggtacgaccgttaacgtcccgttaagaacgttaacggtaaagggtaaccgttacgggtacgtaacggtacctaaccgttcggttacggttaacgtccgggggtacccggtaacgggtaacccgacggttacggtaccgttaacccgggttacgttaacggttaccggaacccggttcccccggtaaagggtccccgttcccgggtaccccccggttaccg

SEQ ID NO: 178965 - DNA, 687 bp, Homo sapiens
  misc_feature: GYAE6OF01EZYZQ.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactgatccagcagtgtacgttgtattataattatgtctctcgtacaacacgtaccagacaaacgaccccaactcatgtattatgagtacagtactccggtcctgtacgggtttactaacgtcgtcttctcgtcgtacctaccgtaacgtccgtacggtaccaaacccgtacccggtcccctaccccggtcgtaaccctacttccgtcgtacgggtcctacccgacggtcgtacggaacgggtacggtagggtacgttaagtttaacgtttacgtcggtacctacgttacctacgtaagttaacgtaaaggtaacgggttgggacctacgacctaccgttaccgttacggttaccggttaccggggtcgggtaaccgggtaaccgtaacggttacccgttacccggtttaccggtacggtacgtaacccggacccggtaacggtcccctcccgggtccccccgtggttaccccg

SEQ ID NO: 178966 - DNA, 769 bp, Homo sapiens
  misc_feature: GYAE6OF01BABBT.15.81.H04.1.454.CMB.1.raw
  modified_base (136)..(136): a, c, t, g, unknown or other
  misc_feature (136)..(136): n is a, c, g, or t
  modified_base (216)..(216): a, c, t, g, unknown or other
  misc_feature (216)..(216): n is a, c, g, or t
tcagtctacgtagccacgaccggtgctcgatttagtagtgtagattcgcggggggggtctcaggaggcagcgctctcaggacatctccaccatggcctgggctctgctgctcctcaccctctcactcgaggcacgngggtcctgggacccagtctcgccctagactcagcctcgcctcgtgtcgtggtcctcgtggactgtcatcatctatcttcngactacgtcggactccgagtacaggttcggtacggttaggttaattaacttaattacgttcgtacctccgttaacggtaaccctaaacgtaccgtaaccgaaggtaacccaaaacccggtacccctaaaagtctaacgttaacgttagtttaacggtcggtaacggtacgtaaacgttaccggtcccggtaacccggttaggtttaaccggggtttaactaacgttccgttacctttccgtacgttacggtaccctaaccggtaacgtccgtaacggtaacccgtaaaccggtacccgtccccgtacctaaccgtaccgtacgttccgtacgggtaccggtaccgtacggtacggtacggtacgggtacggtacggtagttacttacgttacgtacgtcgaactcgactacgtaagtacgaggtacggctacgtcgtactccgtacgttacggcggttacgggcggtaacgaccgtacggtaccttaccggtccgttacggtaccgaccgtaccgtacccggtacggttaccccgtcccggtccccggtaccg

SEQ ID NO: 178967 - DNA, 744 bp, Homo sapiens
  misc_feature: GYAE6OF01A7KFU.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcacgtggactccagcgagtggacgttggtaagttaattaattagtgttctccgtaggtaaccaacgtacgtaacccgaggaccaaaccgtacccccaaactcctagttagtactttaagtggtaacggtactaacggttaacgtcccggtacccgtacggtttaaggggtttacctaacttcgtcctttcgttcgtacggtcctaaccgtaagtcgtacggaacaacccgtaccggccccttcccgtacgtacctaccgttccgtccggttacggaccttccggaggtccgtaggaacggggtaacgtaagggtattaactttaaacgtctaggactcggtacctaactaagtaacgtaacgggtaacgttcggaaccgtagtaccttaaccgtccggttaacggtttccgggtaccggggtccgggtaaaccggtaacccggagttcccgaacggttaccccggacggtttaccgggacccgtcggaaaccccggtagggccccgtttaccccggcccccggttaacggg

SEQ ID NO: 178968 - DNA, 631 bp, Homo sapiens
  misc_feature: GYAE6OF01B1WZC.15.81.H04.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (626)..(626): a, c, t, g, unknown or other
  misc_feature (626)..(626): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtccctccactggaaccagcagtgacgttggtgttataacttgtctctgataccangcaccagacaancaccaattcatgattatgagtcatatccggcctcgtagggttctaagtcgtcttctcgtgctacagtctgcacaccggcctcctcgaccatctcgtcggcctcgaggctggaggtacgnggctgtattattntgctatctactatacgtaaccaaaccaacgacgacctactccgtaccgtacgttacggttacggttaccggggaccgggtaacgggaacctaacggtccgtaaccggtaccccggttaccgtaacggtacccgacggtaccctaaccggggtccctacccggtcccccccgttcgggacccttacccgttccgttaccccgtccccgtaccccttcccgtccgaccgttaccgaccgtacgtcggacggtcgggcgtacggccaacgggtcacgtagtacngtgcg

SEQ ID NO: 178969 - DNA, 737 bp, Homo sapiens
  misc_feature: GYAE6OF01CDNHV.15.81.H04.1.454.CMB.1.raw
  modified_base (213)..(213): a, c, t, g, unknown or other
  misc_feature (213)..(213): n is a, c, g, or t
tcagtctacgtagccacgaccggtgctcgatttagtagtgtagattcgcggggggggtctcaggaggcagcgctctcaggacatctccaccatggcctgggctctgctgctcctcaccctctcactcagggcacgagggtcctgggcccagtctgccctgactcagcctgcctcgtgtctgggtctcgtggactagtcgatcatcattcttcngctacgtggactccgagtcaggtcggtacggtttaggtaagttaattaattatcgttcctcgtacgtaccaacgacgtaccacggaccaaaccgacccctaaatcaattcgtatttagtaggtaggtacaaggttaacgtccggtccgtacggtacgggtttactactcgtcttcgtcgtcgctacgtacgtcgtacgacacgccgtcctaccgtcgacctactcgtcgtcggtacctcgacggtcgtagggaacgggtacggtagggttataacgtttacgttacgtgtaactacgtacttaacgaacgttaaggtaacggtaacgggtcgtaccgaacgttacccgttaacgtttccgttaacgggttaccgggttaccggggtaccgggtaaacccggggtaacctaacgggttacccggtaaccgggttaaccccggttccgggtaacggttaaccccggaacccgggtaaccccggtacccggtccccgggttacccccggtcccccggtttaaaccgg

SEQ ID NO: 178970 - DNA, 752 bp, Homo sapiens
  misc_feature: GYAE6OF01C8BIE.15.81.H04.1.454.CMB.1.raw
  modified_base (136)..(136): a, c, t, g, unknown or other
  misc_feature (136)..(136): n is a, c, g, or t
tcagtctacgtagccacgaccggtgctcgatttagtagtgtagattcgcggggggggtctcaggaggcagcgtctctcaggacatctccaccatggcctggctctgctgctcctccaccctctcactcgaggcacnggtcctgggcccagtctgccctgactcagtcctgccctcgtgtcgtgggtctccgtggacctagtcgactcaactctacttcgttctgacctacgtggactccgagcttaggtcgtacgtttggtaattattaattagtcgtctccgttacgtaaccaactacgtaacccaggtaccaaacccgtaccccaaactacagtcgtaatttagagacggtacagttaacgtcccggtccttacggtacgggtttacctaacgttccgttctttaccgttctacgggtcccttaccgtaaagttcgtacggaactaacccgtaccggtccccttacctaacgaccgtacgtccgttcggtcggtacctccgaggtacgtagggaaggtaccgggtggttacgtatttaacgttactgactacgtctacgtaagtaacttaagggacggttacgaccgtacggtacccttattacccggtttagggtaacccgttcggggtaccggggtacggtaaacccggtacgtacccgttacgggttaaaccccggtaccgtttaaccggccgtaaaccggtaaccccggaacggtccccgttacccggtcccccgggttaccccgg

SEQ ID NO: 178971 - DNA, 856 bp, Homo sapiens
  misc_feature: GYAE6OF01COA34.15.81.H04.1.454.CMB.1.raw
  modified_base (126)..(126): a, c, t, g, unknown or other
  misc_feature (126)..(126): n is a, c, g, or t
  modified_base (201)..(201): a, c, t, g, unknown or other
  misc_feature (201)..(201): n is a, c, g, or t
  modified_base (842)..(842): a, c, t, g, unknown or other
  misc_feature (842)..(842): n is a, c, g, or t
  modified_base (852)..(852): a, c, t, g, unknown or other
  misc_feature (852)..(852): n is a, c, g, or t
tcagtctacgtagccacgaccggtgctcgatttagtagtgtagattcgcggggggggtctcaggaggcagcgctctcaggacatctccaccatggcctggctctgctgctcctcaccctctcactnaggcacgagggtcctgggtcctcactggaaccagcagtgacggttggtgttataactttgctcctgactaccaangacacccaggacaaagccaaccaaagttcaatgtaattttagtacggtacggtacctaacgtaacgtcccggtaccctcggttaacgggggttttacctaaacgtccggttccttccgttccgttacggggtcccttaacccgtaaggttccgtacgggtaacccaaacccggacccgggttccccttacccccgtaacggtaaacccctacttacccgttccggtaccggggtacccctttccggaacgggacccggtagggaaccggggaaccggtacggggtccttaaggtttaacgttttaatttaacgttcggaacccttaattccctttaacgtaacttaaaacgtaaacccaaaccgaaactaccggtacctaacccgttccggtaccgtaacgttacgggttacggttacccggggaacgggtaacgggaacccgtaagtcccgtaacgggtaacccgttaccgtaacgggaacctaccggacccggaaacggtcccgttacccggaccccccgttacggtacccttaccttcccggttacccttccccccgtacccgtccgttaacccgacggttaaccgtaccgtacggtaacgggccgggtaccggccggtacggacccgtaggaccgtnttaagacgtncgta

SEQ ID NO: 178972 - DNA, 800 bp, Homo sapiens
  misc_feature: GYAE6OF01D5PMT.15.81.H04.1.454.CMB.1.raw
  modified_base (217)..(217): a, c, t, g, unknown or other
  misc_feature (217)..(217): n is a, c, g, or t
tcagtctacgtagccacgaccggtgctcgatttagtagtgtagattcgcgggggggtctcaggaggcagcgctctcaggacatctccaccatggcctggctctgctgctcctcaccctcctcactcgaggcacgacgggtcctggcccagtctcgccctgactcacgcctcgcctcgtgtcgttcggtctccgtagactagtcgatcatcattctcngctacgtgactccgagctaggtacggtacgttggttaagtttaattaagttctcgttccttaccggttacgtaacccaaacgtaccgtaaccccgaaacggtaccaaaaccccggtaccccctaaaacgtccgtatttaggttaacgttttaacgacggtacggttaccgtaaacggttaccgtccccgggtaccgttacggggtttaaaggtttaccttaacgttccgttccgtttacccgtacggttcgttacctaaccggttaacgttcgaccgggtaaaccctacccggtacccggttccccttacccgttaaccgaccgttacgttccgtacggttccgggtccgtaccggtaggtaccggtacggaacgggttacgggtagggtaccgttacgttaacgttcgtaccgtacgtcgtaccttaagtaacggttagtaacgggtagtaccgtacgtaccgttacgtaccgttcgttaacggtaccgttccgggtaccgggtacgttaacgacgttccgtacggtccgtacgtacggacgtaccggaccgtaccgtcccgttaacccggcccgttaccgg

SEQ ID NO: 178973 - DNA, 615 bp, Homo sapiens
  misc_feature: GYAE6OF01CVI9I.15.81.H04.1.454.CMB.1.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (265)..(265): a, c, t, g, unknown or other
  misc_feature (265)..(265): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (478)..(478): a, c, t, g, unknown or other
  misc_feature (478)..(478): n is a, c, g, or t
  modified_base (487)..(487): a, c, t, g, unknown or other
  misc_feature (487)..(487): n is a, c, g, or t
  modified_base (547)..(547): a, c, t, g, unknown or other
  misc_feature (547)..(547): n is a, c, g, or t
tcagtctacgtagccacgaccggtgctcgatttagtagtgtagattcgcgggggggtctcaggaggcagcgctctcaggacatctccaccatggcctgggctctgctgctcctcaccctctcactcagggcacagggtcctgggcccagtctgaccctgacctcacgcctgcctcgtgtctgggtcctcgtggacagtcgatcgatcattcttcgngcacgtgaatccagcaggtntaacggttgttaacgttaataattacgtntccgtacgtacgtacaacgacgtaccgacgacaaaccgccctaaacnctactatatttaacgnggtagtactaacgtaactccggccgttacggtacgggttttacaacgttcgtctttctacgtcgactagacgtcgacgactaacgcccgtctacgtacacacgtcctggacggtcacgcgacgtggacggacgtaggtagtatcgtacgngacacgtanactaagtagtacggagcgtacacgtcgtcgttacgtacggtcgtccgggacgtcgtaacnccgggttcacggttaccggtcgtaaccggaccgtaccggacccgtaacgtccggcccgtcccggtccg

SEQ ID NO: 178974 - DNA, 609 bp, Homo sapiens
  misc_feature: GYAE6OF01AGHLC.15.81.H04.1.454.CMB.1.raw
  modified_base (124)..(124): a, c, t, g, unknown or other
  misc_feature (124)..(124): n is a, c, g, or t
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctnactcagggcacagggtcctgggcccagtctgccctgactcagcctgcctcgtgtctggtctcctggactagtcatcatcatcttntcgcactggactccagcagtgtacgttgtagttataattatcgtcctctggtaccaactacgtaccaggacctaaaccgccccaaatcatctatttanggtagtcagtactccggcctgtagggttactagtccgtacttcgtctgcctacgagtcgtagaccaacgacgccctccactaccatctacgtcggctacgcgtcgtagacggtacggtaggtatacgtttaanccggttnaacccgtgtactacgtaaagttagtaacggtaggttaccggacgaacgttctaaccgttcttaacggttcgtccggggtacgggtacgaccgtagtccgtaaccggtccttaccggagtccgtaccggacccgtacggtccctacccggccccgttaaccgg

SEQ ID NO: 178975 - DNA, 916 bp, Homo sapiens
  misc_feature: GYAE6OF01AGEHJ.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtgttatactttgtctctgataccaacagcacccaggacaaacgccacccaaattcatgtatttatggagtcactaatccggccctcgtagggtttctaatcgtcttctcgtgctaccaagtctgacaacgccggccctccctgacctactcctcgtcgggtcctcccgagggtcgtacggacgggaaccggacggtcgttaggtaaacttttagtttacgttcggtacctaactttccgttaccgtaaaatttaccttaaaaccccaaaacccgaaaccctaacggtaccctaacccgtttacccgttacccgggttaacgtttacggggtttaacccggttttacccgggggaaccggggtaaccggggtaaaccccgaaaccgggttacccggtttaaccccgggttaacccccgggtttaacccgggttaacccggggtaacccggaacccgggtaacccccggtaaaccggggttcccccttaacccccgggtcccccccccgggtttaccgggttaccccgttaaccccggttttcccggtttaccccccggttttacccccccggtccccccgtttacccccggttccccggttaaccggtttaaccccggttaaaccgggttacccgggttaccgggggtacccggggttacccggggggtcccgggttaacccgggggttacccgggaaaaccggggtccccggtaacgtaaacgggttacgcgtacccgtag

SEQ ID NO: 178976 - DNA, 496 bp, Homo sapiens
  misc_feature: GYAE6OF02IDAHF.15.81.H04.1.454.CMB.1.raw
tcagtctacgtagccacgaccggtgctcgatttagtagtgtagattcgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtgcagcactctcgtattcggcgtgggaccaagctgaccgtctaggtcagcccaaggctcgcccctcgg

SEQ ID NO: 178977 - DNA, 511 bp, Homo sapiens
  misc_feature: GYAE6OF02JHSK4.15.81.H04.1.454.CMB.1.raw
  modified_base (236)..(236): a, c, t, g, unknown or other
  misc_feature (236)..(236): n is a, c, g, or t
  modified_base (483)..(483): a, c, t, g, unknown or other
  misc_feature (483)..(483): n is a, c, g, or t
  modified_base (509)..(511): a, c, t, g, unknown or other
  misc_feature (509)..(511): n is a, c, g, or t
tcagtctacgtagccacgaccggtgctcgatttagtagtgtagattcgcggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaccaaattcatgattangagtcactaatcggccctcagggtttctaatcgcttctctggctccaagtctggcaacacggcctccctgaccatctctgggctccaggctgaggacgaggctgattatattgcatcgtcatagtacaaaccaacagcactctcgactggtattcggcggagggaccaagctgaccgtcctagtcagcccaaggcctagcccctcggtcacgtctcgttcccaccctcctcgctacgagactggacncgggctcggcaacggcgtcatacggnnn

SEQ ID NO: 178978 - DNA, 521 bp, Homo sapiens
  misc_feature: GYAE6OF02IONXZ.15.81.H04.1.454.CMB.1.raw
  modified_base (353)..(353): a, c, t, g, unknown or other
  misc_feature (353)..(353): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgagtcagtaatcggccctcgaggggtttctaatcgcttctctggctcaagtcnggcaacacggcctccctgaccatctctggctccaggctgaggacgagggtgtaattatttacgtgcagctcaatataagaagtgcagcactctcgtagttcgggcggtacgggaccaagcgtacggtccgtccgtaggtcacgacccgaaggtcctcgcccccgtcgg

SEQ ID NO: 178979 - DNA, 511 bp, Homo sapiens
  misc_feature: GYAE6OF02HGN12.15.81.H04.1.454.CMB.1.raw
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagtctacgtagccacgaccggtgctcgattttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggacaaacgcccccaaatccatgatttatgaggtcagtaactcgccctcgagggtttctaatcgctttcnctgctccaagtctggcaacncgcctccctgaccatcctntcgggctccaggctggaggcgagggtgattattactgcagctacatatagagtgangcactntctagttcgggcggtggaccgaagctcgaccgttccaggtcacgcccgaaggcctcgcccctcgg

SEQ ID NO: 178980 - DNA, 496 bp, Homo sapiens
  misc_feature: GYAE6OF02GFXOI.15.81.H04.1.454.CMB.1.raw
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctcaagtctggcaacacggcctcctgaccatctctgggctccgaggctggacggacgagggtgattatactgcagctcatatagagtgcagcactctcgtattcggcggtggacgaagctgaccgtctaggtcacgccaggctcgcccctcg

SEQ ID NO: 178981 - DNA, 511 bp, Homo sapiens
  misc_feature: GYAE6OF02HE0MK.15.81.H04.1.454.CMB.1.raw
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtgcagcactctcgtattcgggcgttgggaccaaggctgaccgtccgtaggtccaggcccaaggcctacgcccccttcgg

SEQ ID NO: 178982 - DNA, 503 bp, Homo sapiens
  misc_feature: GYAE6OF02F8NVB.15.81.H04.1.454.CMB.1.raw
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgtctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcgaggggtttctaatcgcttctctggctccaagtctggcaacacggcctccctgaccatctctgggctccaggctgaggacgagggtgattatactgcagctcatatagagtgcagcactctcgtattcggcgtgggaccaaggctgacccgttctaggtcacgcccaaggcctcgcccctcgg

SEQ ID NO: 178983 - DNA, 509 bp, Homo sapiens
  misc_feature: GYAE6OF02JG1SD.15.81.H04.1.454.CMB.1.raw
  modified_base (507)..(509): a, c, t, g, unknown or other
  misc_feature (507)..(509): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcagggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtctaggtccagcccaaggctcgccccctcggtccactctcgttccccgcctcctcgctacgtagactgacgcgggctggcaggcgcatagnnn

SEQ ID NO: 178984 - DNA, 497 bp, Homo sapiens
  misc_feature: GYAE6OF02GFDLW.15.81.H04.1.454.CMB.1.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtccgggtctcctggacagtcgatcatcatcttctgcactggatccagcagtgacgttggtagttataattatgtctcctggtaccaacagtacccaggcaaagcccccaaactcatgatttangaggtcagtaatcggccctcaggggtttctaatcgcttctctggctccaagtctggcaacncggcctccctgaccatctctggctccaggctgaggacgagggtgattattactgcagctcatatagagtggcagcactctcgtatcggcgtggacagctgaccgtcctaggtcacgccaaggcctcgcccctgtcc

SEQ ID NO: 178985 - DNA, 505 bp, Homo sapiens
  misc_feature: GYAE6OF02HGONB.15.81.H04.1.454.CMB.1.raw
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaatcatgatttatgaggtcagtaatcggccctcgaggggtttctaatcgcttctctggctccaagtctggcaacacggcctcctgaccatctctgggctccaggctgaggacgaggtgattattactgcagctcatagtagagtggtagctactctacgtattcggcggtggaccaagctggaccgtcgtaggcacgcccgaaggcctcgcccctggtcc

SEQ ID NO: 178986 - DNA, 500 bp, Homo sapiens
  misc_feature: GYAE6OF02FX5D0.15.81.H04.1.454.CMB.1.raw
  modified_base (298)..(298): a, c, t, g, unknown or other
  misc_feature (298)..(298): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaatcatgatttangaggtcagtaatcggccctgaggggtttctaatcgcttctctggctccaagtctggcaacacggcctccctgaccatctctgggctccgaggctgaggacgagggtnattatactgcngctcatanagagtgcagcactcgtcgtagttcggcggtggacctaagctgaccgttctaggcacgccaggcctacgcccctcgg

SEQ ID NO: 178987 - DNA, 516 bp, Homo sapiens
  misc_feature: GYAE6OF02G6EAF.15.81.H04.1.454.CMB.1.raw
  modified_base (302)..(302): a, c, t, g, unknown or other
  misc_feature (302)..(302): n is a, c, g, or t
  modified_base (409)..(409): a, c, t, g, unknown or other
  misc_feature (409)..(409): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaaacgcccccaaatcatgatttangaggtcagtaatcggcctcgaggggtttctaatcgcttctctggctccaagtctggcaacgacggccctccctgaccatctctggctccaggctgaggacgagggtnattatactgcagctacgatagtagaagtgacagcactcgtcgtagttcggcgtagggaccaaggctcggacccgtcgtaggcacgccaacggctaccgcccctacgg

SEQ ID NO: 178988 - DNA, 503 bp, Homo sapiens
  misc_feature: GYAE6OF02GTZHC.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtccgggtctcctggacagtcgatcatcatcttctgcactggatccagcagtgacgttggtagttataattatgtctcctggtaccaacagtacccaggcaaagcccccaaaactcatgatttatgaggtcagtaatcggccctcgagggtttcaatcgcttctctggctccaagtctggcaacacggcctccctgaccatctcgtggctcaggctgaggacgagggtgattattactgtagctacatatagaagtgcagcactctcgtatcggcggtggaccagctgaccgtcgtaggcagccaaggcctcgcccctggtctacc

SEQ ID NO: 178989 - DNA, 501 bp, Homo sapiens
  misc_feature: GYAE6OF02FSORI.15.81.H04.1.454.CMB.1.raw
  modified_base (499)..(501): a, c, t, g, unknown or other
  misc_feature (499)..(501): n is a, c, g, or t
tcagtctacgtagccacgaccggtgctcgatttagtagtgtagattcgcgggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggttcactaatcggcctcaggggtttctaatcgcttctctggctccaagtctggcaacacggcctcctgaccatctctgggctcaggctgagacgagctgattattattgcatctcatatacaaccaacagcactctcgactggtacttcggcgagggaccaagctgaccgtcctaggtcagccaaggctcgcccctggtcactcttcgttcccacctcctcgctacgtacgactgagcgggctggcaaggcgcagtacgnnn

SEQ ID NO: 178990 - DNA, 515 bp, Homo sapiens
  misc_feature: GYAE6OF02FSL7A.15.81.H04.1.454.CMB.1.raw
  modified_base (301)..(301): a, c, t, g, unknown or other
  misc_feature (301)..(301): n is a, c, g, or t
  modified_base (426)..(426): a, c, t, g, unknown or other
  misc_feature (426)..(426): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttangaggtcagtaactcggccctcaggggtttctaatcgcttctctggcctcaagtctggcaacacggcctccctgaccatctctgggcctccaggctgaggacggagggtgattattactgcagctnatatagagtgcagcactctacgtagttcggcggtcggaccaagctcggacccgtctaggtccacgacccgaaggcctccgccccgtcgg

SEQ ID NO: 178991 - DNA, 516 bp, Homo sapiens
  misc_feature: GYAE6OF02F98T0.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacaacacccaggcaaagcccccaaactcatcatttatgaagtctctaagcgccctcaggggtatctaatcgcttctctggctcaagtctggcaacacggcctccctgaccgtctctggccctccagactgaggacgaggctgtaattattactgccactcaatactagaagtatactactctgttggtttcgcggtaggaccaagctcggaccgtctaggtcagcccaaggcctcgccccctggtcctaccg

SEQ ID NO: 178992 - DNA, 499 bp, Homo sapiens
  misc_feature: GYAE6OF02HOSST.15.81.H04.1.454.CMB.1.raw
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtccgggtctcctggacagtcgatcatcatcttctgcactggatccagcagtgacgttggtagttataattatgtctcctggtaccaacagtacccaggcaaagcccccaaatcatgatttangaggtcagtaatcggccctgagggtttctaatcgcttctctggctccaagtctggcaacacggcctccctgaccatctctgggctccaggctgaggacgngggtnattattactgcagctcatatagaagtgcagcactctcgtattcggcggtggaccaggctgaccgtctaggcagcccgaaggcctcgcccctgtcc

SEQ ID NO: 178993 - DNA, 547 bp, Homo sapiens
  misc_feature: GYAE6OF02I99NB.15.81.H04.1.454.CMB.1.raw
  modified_base (239)..(239): a, c, t, g, unknown or other
  misc_feature (239)..(239): n is a, c, g, or t
  modified_base (544)..(545): a, c, t, g, unknown or other
  misc_feature (544)..(545): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangagtcactaatcggccctcaggggtttctaatcgcttctctggctccaagtctggcaacacggcctccctgaccatctctgggctccaggctggaggacgaggctgattattattgcatctcatataccaaaccaacagcactctacgtactggtacttcgggcggacgggaccaagctcgaccgtcgtaggtccacgcccaaggcctcgccccgtcggtacctactctccgttccccgcccttcccgtcgtaccgtacgtacgaccgtgaccggcgggtcgtcggacgaacggccgacagtcgnntg

SEQ ID NO: 178994 - DNA, 505 bp, Homo sapiens
  misc_feature: GYAE6OF02IE1DM.15.81.H04.1.454.CMB.1.raw
  modified_base (319)..(319): a, c, t, g, unknown or other
  misc_feature (319)..(319): n is a, c, g, or t
  modified_base (404)..(404): a, c, t, g, unknown or other
  misc_feature (404)..(404): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgagtcagtaatcggccctnaggggtttctaatcgcttctctgctccaagtctggcaacacggcctccctcgaccatctctgggctccagctgaggacgagggtnatttattactgcagtctacatatagagtggcagcactctcgtattcggcggtggaccaaggctggaccgttcaggtcaggcccaaggctccgcccgtccgg

SEQ ID NO: 178995 - DNA, 636 bp, Homo sapiens
  misc_feature: GYAE6OF02JKVF1.15.81.H04.1.454.CMB.1.raw
  modified_base (303)..(303): a, c, t, g, unknown or other
  misc_feature (303)..(303): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatctctgcactggatccagcagtgacgttggtagttataattatgtctctggtaccaacgagtacccaggcaaacgcccccaaacgtcatcgtaattangtaggtcaagtaactcgcctgtaggggtttactaatcggtcttcctctggctaccgtaagtctggacaacgtaccggtccctacccgtcgaccacttcgtcgtcggtctaccgcggtactgacggacggtacgggtagagtttacttacgcgtctacgtctaccagttaacgtaacgtaaggtcggtactaacggtcctaccgttcgttaccgttacgttccggggaccggtaggggtaaccctacgggtattaccgggtaaccgttacccgtaacggtaccgtaaccggtaccggaaccggttccggttacccggtacccccgttacccggg

SEQ ID NO: 178996 - DNA, 515 bp, Homo sapiens
  misc_feature: GYAE6OF02GNSC6.15.81.H04.1.454.CMB.1.raw
  modified_base (382)..(382): a, c, t, g, unknown or other
  misc_feature (382)..(382): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgacgttggtagttataattatgtctcctggtaccaacagtacccaggcaaacgcccccaaactcatgatttatgagtcagtaatcggcctcgaggggtttctaatcgcttctctgctcagtctgcaacacgcctcctgaccatctcgtggcnccgaggctgaggacggagggtgtattatactgcagctacatatagtagtgcagtcactctgtatcggcggtcggaccgtaagctacggaccgtcgtaggtcaccgaccgaaggtccgtccgcccccgttacgg

SEQ ID NO: 178997 - DNA, 508 bp, Homo sapiens
  misc_feature: GYAE6OF02GULCB.15.81.H04.1.454.CMB.1.raw
  modified_base (298)..(298): a, c, t, g, unknown or other
  misc_feature (298)..(298): n is a, c, g, or t
  modified_base (431)..(431): a, c, t, g, unknown or other
  misc_feature (431)..(431): n is a, c, g, or t
  modified_base (489)..(489): a, c, t, g, unknown or other
  misc_feature (489)..(489): n is a, c, g, or t
tcagtctacgtagccacgaccggtgctcgatttagtagtgtagattcgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttangagtcagtaatcggccctcgaggggtttctaatcgcttctctggctccaagtctggacaacacggcctccctgaccatctctgggctccgaggctgacgggacgagggtgtaattaattactgcagctcatanaggaagtggacagctactcgtacgtattcggcggtggaccaagctgaccgtcaggtcncgaccaggctcgccctcgg

SEQ ID NO: 178998 - DNA, 614 bp, Homo sapiens
  misc_feature: GYAE6OF02IDYRV.15.81.H04.1.454.CMB.1.raw
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
  modified_base (600)..(600): a, c, t, g, unknown or other
  misc_feature (600)..(600): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatctcctgcactggaacctagttggtgtattataactatgtctcctggtaccagcagcacccaggacaacgcccccaaaagtcatctaatttatgacgtctacactaacgccggtccctcgacgggtccctagactcgtctttctcgtcggcctaccaagtcgtcggccgtaccgtccggccctcccgtgtacccgttctcgtcgggcctccgacgtcctaggaaacgntaggacggtctagttatttacgtttcgngtcggtctataattagtacgggacaacgttaattaacgagttcctttacggttaccgttacgggaagttacgggaaccgtaacggttccgtaaccgttaccgtacgtaccacggaccccaacggaccccaaccccgtnttaccgtactaccg

SEQ ID NO: 178999 - DNA, 500 bp, Homo sapiens
  misc_feature: GYAE6OF02G6Z95.15.81.H04.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (373)..(373): a, c, t, g, unknown or other
  misc_feature (373)..(373): n is a, c, g, or t
  modified_base (459)..(459): a, c, t, g, unknown or other
  misc_feature (459)..(459): n is a, c, g, or t
  modified_base (498)..(500): a, c, t, g, unknown or other
  misc_feature (498)..(500): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaanagcacccaggcaaagcaccaaattcatgatttangagtcactaatcggcctcagggtttctaatcgcttctctggctccaagtctggcaacacggcctccctgaccatctctgggctccaggctgaggacgaggctgattatattgcatctcatatacaacaacagcacncttcgacttgtattcggcggaggaccagctgaccgtcctaggtcagccaaggctcgcccctcgtcactcttcgtcccacctcctcnctactacgactggcgtcggctcggcaacggcgacatagnnn

SEQ ID NO: 179000 - DNA, 569 bp, Homo sapiens
  misc_feature: GYAE6OF02G5T3N.15.81.H04.1.454.CMB.1.raw
  modified_base (302)..(302): a, c, t, g, unknown or other
  misc_feature (302)..(302): n is a, c, g, or t
  modified_base (422)..(422): a, c, t, g, unknown or other
  misc_feature (422)..(422): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttangaggtcagtaatcggccctcgtaggggtttctaatcgtcttctctggcctcaagtctgacaacgaccggcctccctgaccatcctcgtcgggcctccgaggtctggacggacggagggtntaatttattactgcagtctcataagtaggtaagtggacagacctactcgtcgtagttccgggacgggtcgggaacccaaggtccgtacggacccgttaccgttaggtccgtacggaccccgaagggtccctccggtccccccgtcgg

SEQ ID NO: 179001 - DNA, 514 bp, Homo sapiens
  misc_feature: GYAE6OF02H4VF4.15.81.H04.1.454.CMB.1.raw
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggacaaacgccccaaactcatgatttangagtcagtaatcggcctcgaggggtttctaatcgcttctctggctcaagtctggcaacacggcctcctgaccatctcgtgggctccgaggctgaggacggaggtagtattattacngcagctacatatagaagtggcagcactctcgtagtcggcggtacggaccaagcgtgaccgtcctaggtcagacccgaaggctaccggccccttcgg

SEQ ID NO: 179002 - DNA, 642 bp, Homo sapiens
  misc_feature: GYAE6OF02IV4XA.15.81.H04.1.454.CMB.1.raw
  modified_base (213)..(213): a, c, t, g, unknown or other
  misc_feature (213)..(213): n is a, c, g, or t
  modified_base (363)..(363): a, c, t, g, unknown or other
  misc_feature (363)..(363): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcatcttcngcactggatccagctagtgacgtttggtaagttataattatgtctcctggtaccaacacgtacccaggaccaaacgccccaaactcatgtattatgagtcagtactccggcctcgtagggttctaactcgtcttctcgtcgctcaagtcncgacaacgccgccctccgtcacctctctcgtcggcctcgaggctaggacggacggtagggtcgttaagtttacttaccgtgacctagtcctattaagtaagtaacggtaaggtcggaccgtacgacctaccgttacgttccgggttacggttccggggtaccgggttacgggaacccgtaacggtccggttaaccgggtaccccgttacgggttaccggtaccggaacccgggtacccccggtaagggtccccttaccccgggtccccccgttaccggg

SEQ ID NO: 179003 - DNA, 551 bp, Homo sapiens
  misc_feature: GYAE6OF02F2QKR.15.81.H04.1.454.CMB.1.raw
  modified_base (362)..(362): a, c, t, g, unknown or other
  misc_feature (362)..(362): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactccatgatttatgaggtcagtaatcggccctcaggggtttctaatcgcttctctggctcaagtctggcaacncggccttccctgaccatcctctgggctccaggtctggaggacggagggtgtaattagttactgtacgagtctacatatagtaagtgggacagcctactctcgttacgtcgggtcggtcgggaccaaggcctacggtacccgtaccgttagggtccacggcccgaaggtcctccggcccccgttacccgg

SEQ ID NO: 179004 - DNA, 510 bp, Homo sapiens
  misc_feature: GYAE6OF02IBUF1.15.81.H04.1.454.CMB.1.raw
  modified_base (240)..(240): a, c, t, g, unknown or other
  misc_feature (240)..(240): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
  modified_base (507)..(509): a, c, t, g, unknown or other
  misc_feature (507)..(509): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcaggggcacagggtcctgggtcctccactggaaccagcagtgacgttggtggttataactttgtctcctgataccaacagcacccaggcaaagcacccaaattcatgatttangaggtcactaatcggccctgaggggtttctaatcgcttctctggctccaagtctggcaacacggcctccctgaccatctctgggctccgaggctgaggacgaggctgatttattatgctatctcatatacaaccaatacgcactctcgacttaggtattcgggcggtaggaccagctgaccgtcaggtcacgccagcnccgccctcgtcnctctcgttcccncctcctcgctacgtacgctgcggcggcgtgacgaggcgcagtagnnng

SEQ ID NO: 179005 - DNA, 604 bp, Homo sapiens
  misc_feature: GYAE6OF02JGQYX.15.81.H04.1.454.CMB.1.raw
  modified_base (241)..(241): a, c, t, g, unknown or other
  misc_feature (241)..(241): n is a, c, g, or t
  modified_base (604)..(604): a, c, t, g, unknown or other
  misc_feature (604)..(604): n is a, c, g, or t
tcagtctacgtagccacgaccggtgctcgatttagtagtgtagattcgcggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagccaacccaattcatgatttangaggtcactaatccggccctacaggggtttctaatcgcttctctcggcttcaagtctcggacaacacggcctccctgaccatctctgggctccaggctgaggacgaggctgatttattattgctatctacgtattactaacaaccaaactagacctactacctacggtaactcgggtttaattccgggagggtaaccgggaaacctaacggcgtacgacccgttaccgtaagtcgacgacccaagggtcctaccggcccccgttacgggtacctaccgttaccgttccgttacccccgccttacccgcgtacctcgtacgtactcggaccgtcgggctacggacgtacggtcacgtagcgcan

SEQ ID NO: 179006 - DNA, 596 bp, Homo sapiens
  misc_feature: GYAE6OF02IHQVO.15.81.H04.1.454.CMB.1.raw
  modified_base (241)..(241): a, c, t, g, unknown or other
  misc_feature (241)..(241): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgtttggtggttataacttttgtctcctgataccaacagcacccaggcaaagcacccaaattcatgatttangagtcactatcgcctcgagggtttctaatcgcttctctgctccaagtctggacaacacggcctccctgacatctctgggctccagctgagacgagctgattnttatgctatcntatactacaaccaacagcactctacgacgtagtagttcggcgggacggaccaacggtctcggtaaccgtaccgtacggtaccacgaccgaacgggcccttaccggcccccgttcggtacctaccgttcctttcccgttacccctaccccgttcccgtccgtacccttaccggtacgtaccgtacggtaccggtccggggccgttacggaccggacggtaccggacccgtagtaacgcagtcg

SEQ ID NO: 179007 - DNA, 553 bp, Homo sapiens
  misc_feature: GYAE6OF02GJ4FC.15.81.H04.1.454.CMB.1.raw
  modified_base (312)..(312): a, c, t, g, unknown or other
  misc_feature (312)..(312): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
  modified_base (550)..(552): a, c, t, g, unknown or other
  misc_feature (550)..(552): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcaacccaaattcatgatttatgaggtcactaatccggccctcgaggggtttctaatcgcttctctggctcaagtctggcaacacggcctcccngaccatctctggctccgagctgaggcgacggctgatttattattgctatctactaatactaacaaccaacagaccactcctcgacgtggtacttcgggacggagggaccaacgcgtacggccgtaccgtaggtcacgcccgaaggcctccgcccctgtcctacgtccgtccgttcccnccctccnccgtcgtacgtacgcgtcggacgccgggcgtcggacgacggccgactagtcgnnng

SEQ ID NO: 179008 - DNA, 596 bp, Homo sapiens
  misc_feature: GYAE6OF02H0S6W.15.81.H04.1.454.CMB.1.raw
  modified_base (304)..(304): a, c, t, g, unknown or other
  misc_feature (304)..(304): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcattctctgcactggatccagcagtgacgttggtagttataattatgtctctggtaccaacagtacccaggacaaacgcccccaaactcatgtatttagngtaggtcaagtaactccggcccttcgtaggggtttactaatcgtcttctcgtggctacgaagtcgtacggacaacgaccggtccctccctcgacctactcctcgtcggtcctccgaggctagggacgggacggagggtataagtttagttactgactagctactaattaagacggtaaggtcgacgacgcctacttcgtacgttacgtccggtacgggtcggaccgaacggtccgtacggacccgttccgtacgggtcaccggacccgaaggccctccggcccccgttacgg

SEQ ID NO: 179009 - DNA, 699 bp, Homo sapiens
  misc_feature: GYAE6OF02GSL9F.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgacgttggtagttataattatgtctcctggtaccaacagtacccaggacaaacgccccaaactcatgtatttatgaggtcagtaatccggcctcgtacggggtttctaagtcgtcttctcgtcggtccttaccgaagttcgtaggaccaacgaccggtcccttacccgtacgaaccctacttccgtccgtcgggtccgtccgacggccgttaggaacggggtacgggtaggggttagtaacgttttaacgttacgttacggtacctacggtaccttacgtaagttaacgttaaggtaaacgggtcggacgtacggaccttaaccgttcgttaaccggtttacggttaccgggtaccggggttacgggaacccggtaacggtaccggttaaccggtacccggttaccgttaacgggtaccgtaaccggacccggtaaccgggtccgtaccccggtcccccgttacccggg

SEQ ID NO: 179010 - DNA, 603 bp, Homo sapiens
  misc_feature: GYAE6OF02I0L2Q.15.81.H04.1.454.CMB.1.raw
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtacccagcaaacgcccccaaatcatgatttatgaggtcagtaatccggccctcgtaggggtttactaacgtcgtctttctactcggcctaccagtctggacaacgaccgtcctcccgtgacctatcctcgtcggtcctccaggctggacggacgggtagggtatagttaactttacgtcgaccgagtcctcgtaagttaactaggtaacggttggacctaacgtccgtaactcgttacgtagttccgggcgggttagggacccaagtccgttacgacccgttaccgtaggttaccgaccggtacccgaacgggccgttcccggacccccgttaccgg

SEQ ID NO: 179011 - DNA, 535 bp, Homo sapiens
  misc_feature: GYAE6OF02GSG8O.15.81.H04.1.454.CMB.1.raw
  modified_base (415)..(415): a, c, t, g, unknown or other
  misc_feature (415)..(415): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaatcatgattatgagtcagtaatcggcctcgtagggtttctaatcgtcttctctggtctccgaagtcgtggacaacgacggccctcctcgaccatctcgtggcctccgaggctaggacggacgagggtntattatacgtgcagctacatatacgagtgcagctactctgtacgttcgggcggtaggaccgaggtcctcggtaacccgtcgtaggtccacgacccgaaggccgttaccgcccccgttcgg

SEQ ID NO: 179012 - DNA, 560 bp, Homo sapiens
  misc_feature: GYAE6OF02J0POW.15.81.H04.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (342)..(342): a, c, t, g, unknown or other
  misc_feature (342)..(342): n is a, c, g, or t
  modified_base (396)..(396): a, c, t, g, unknown or other
  misc_feature (396)..(396): n is a, c, g, or t
tcagtctacgtagccacgaccggtgctcgatttagtagtgtagattcgcgggggggtcgtcaggaggcagcgctctcaggacatctccaccatggcctgggctctgctgctcctcaccctcctcactcagggcacagggtcctgggtcctccactggaaccagcagtgacgttggtgttataactttgtctctgataccanagcaccagcaaagcaccaattcatgattangagtcactatcggcctcagggttctaatcgcttctctggctcagtctggcacacggcctacctgaccatctctcggctcgagctgaggacgaggctgtatattatgcatcnatatacaacaacagcactctcgacttggacttcggcgggacggtaaccaggacncggtaccgttactaacggtccagacccgtaaggtcgtaccgtcccccgacgggttacccaccggttccttaccggttccccctacccgtaccgtcccgtaccgttacgtacgtaccggtgtacggccggtcgttcggacgtacggaccgtcaacgtacgcagac

SEQ ID NO: 179013 - DNA, 522 bp, Homo sapiens
  misc_feature: GYAE6OF02HQNDQ.15.81.H04.1.454.CMB.1.raw
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaaacgcccccaaactcatgatttatgagtcagtaancggccctnagggtttcaatcgcttctctggctccaagtctggacaacgacggcctccctgaccatctctcggctcaggctgacggacgaggtgattacttangacancactatatagaagtgcagcactctcgttacgtcggcggtcggaccaaggtctaggacccgttcctagggtcacggcccgaacggctacggcccccttacgg

SEQ ID NO: 179014 - DNA, 563 bp, Homo sapiens
  misc_feature: GYAE6OF02HD61E.15.81.H04.1.454.CMB.1.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (416)..(416): a, c, t, g, unknown or other
  misc_feature (416)..(416): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctgtaccaacagtacccaggacaaacgcccccaaatcatgtatttatgaggtcagtaactccggccctgtaggggtttctaagtccgtcttctctggctcagtctgcacncgcctccngaccntcctcgtcgggctccgaggtctggacggacggagggtntacgtttattacgtgactacgtctactatagtaggtaaggtgacagacctacttcgtcggttacgttcgggtccgggtacgggaccaaggtctacggacccgttccgtaggccacggaccctaacgggccttcccggcccccgtcgg

SEQ ID NO: 179015 - DNA, 619 bp, Homo sapiens
  misc_feature: GYAE6OF02GPZOC.15.81.H04.1.454.CMB.1.raw
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtacccaggacaaacgcccccaaactcatgtattatgaggtcagtatcggcctcgagggtttctaagtcgcttctctggctcagtctggcaacaccggtcctcctcgacctatcctcgtacgggtcctccgacggtctacgggagggaccgtaggggtacgtaagtttacgttacgtgtaccgagtcctacgtaattaagtaacggtaaggttcgggaactacggtacctacgttccgttacggttacgtttcgggtacggggtacgggtaaccgtaacggtccgttacggacccggttaccgtacggtaccgacggtaccccgaacggtcctacccggtcccccgttaccgg

SEQ ID NO: 179016 - DNA, 603 bp, Homo sapiens
  misc_feature: GYAE6OF02FNWS8.15.81.H04.1.454.CMB.1.raw
  modified_base (238)..(238): a, c, t, g, unknown or other
  misc_feature (238)..(238): n is a, c, g, or t
  modified_base (343)..(343): a, c, t, g, unknown or other
  misc_feature (343)..(343): n is a, c, g, or t
tcagtctacgtagccacgaccggtgctcgatttagtagtgtagattcgcgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaattcatgattangaggtcactatccggccctcagggttctaatcgcttctctgctccaagtctggcaacacggcctccctgaccatctctgggcctccaggctgagcgagctgattnttatgcatctcatataacaaccaacagaccactctcgacgtggtacttcgggacggacgggtaccaacggcgttacgacccgtccgtaggtaccgacgaccccgaaggcctaccgtcccccgtcgggtccacgttccttcccgttccccctacccgtcctccggtaccttaccggtacgtaccgttcgggaacggtacccgggggtccgttacggggacccgaacggggcccggtaacctacggttaacgggctaggtcc

SEQ ID NO: 179017 - DNA, 656 bp, Homo sapiens
  misc_feature: GYAE6OF02JW552.15.81.H04.1.454.CMB.1.raw
  modified_base (237)..(237): a, c, t, g, unknown or other
  misc_feature (237)..(237): n is a, c, g, or t
  modified_base (656)..(656): a, c, t, g, unknown or other
  misc_feature (656)..(656): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtgttataactttgtctcctagataccaacagcacccaggcaaagcaaccaattcatgattangagtcactaatcggcctcgagggtttctaatcgcttctctgctcatctgcacacggcctcctgaccatctcgtcggcctccgaggctggaggacgaggctgtatttattatcgcatctataactactaacaaacctaacagtaccactccgtacgtacgttggtacttccggggtacggacgggtaaccaaaggtccgtacggtacccgttaccgtacggtaccgaccgtaacccgtacgggtcctacccggcccccgttcggtacccgtacccgttaccgttcccgttacccccgtaccccgttcccgttaccgtacccgttaccgtaacggtaccggttacgggaccggggtccgggtaccggttaccggaaccgggtaaccgggtcccggtaaccgtaacggtacgtcgtacggtn

SEQ ID NO: 179018 - DNA, 526 bp, Homo sapiens
  misc_feature: GYAE6OF02JD5YA.15.81.H04.1.454.CMB.1.raw
  modified_base (404)..(404): a, c, t, g, unknown or other
  misc_feature (404)..(404): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtacaacagtaccaggcaaagcccccaaactcatgatttatgaggtcagtaatccggccctctaggggtttctaatcgcttctctggctcagtctgcaacacgcctcctgacctatctctgggctccgaggtctggaggcgagggtntattatctgcagtctcgatagtagagtcgacagcactcctcgttagttcggcggtggaccgtaaggccttaggacccgttcgtacggtcaccgacccgacggccttaccgcccccgttacgg

SEQ ID NO: 179019 - DNA, 753 bp, Homo sapiens
  misc_feature: GYAE6OF02JWGIT.15.81.H04.1.454.CMB.1.raw
tcagtctacgtagccacgaccggtgctcgatttagtagtgtagattcgcggggggggtctcgaggaggcagcgctctcaggacatctccaccatggcctgggctctgctgctcctcaccctcctcactcagggcacagggtcctgggcccagtctgccctgactcacgcctgcctcgtgtctgggtctcctggacagtcgatcatcatcttctgcactggactccagccaggtcgtacgttggtagttataattatgtctccgtaggtaccaacgtacgtacccaggaccaaacgtacccccaaatcaagtgtactttagtggacgtcgaagtacgtcgcctagtagggtttctaagtcgtcgttctcgtcggtacctacctaggtcgtggacctaacgcccggtaccctcccggtacgtaaccctacgttacccgtcgttccgggacctttacccgggacgtacgtccgggaacggggtaaccggtagggttaccgttagtttaacgtaacgtcgggtaacctagggtacttacctaagttaagttaaggtaccggttagggaaccttccggtaaccttaaccgttccgggtttaccggttaacgggtttacccggggtacgggtaaccgggtaacccgggtaaccggtaccggtttaaccgggtaaccccgggtttccggttaaacggggttcccgtaaccgggacccggttaaccgggtccccttccccgggttaaccccccgtccgggg

SEQ ID NO: 179020 - DNA, 635 bp, Homo sapiens
  misc_feature: GYAE6OF02FO7K8.15.81.H04.1.454.CMB.1.raw
tcagtctacgtagccacgaccggtgctcgatttagtagtgtagattcgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtaagttataattatgtctcctggtaccaacagtacccaggaccaaacgcccccaaatcatgtattatgagtcagtaatcgccctcgtaggggttctaagtcgtcttcgtctggcctaccgaagttcgtggacaaccgaccggtccctccctacgacctatccgtacgtcgggtcctccgaaggtcgtaggaacggacggtagggtagtaagttaacttacgtcgcgtagtcctactacgtaagttaacgggtaaggtcggacgtaacgacctacgttcccgtttacggtacggtttccgggtaccgggttacgggaaccgtaacggtacctacgggtaacccgtacgtacgggtaccacggaccccgaaaggtcccgtcccgtcccccgttacccgg

SEQ ID NO: 179021 - DNA, 512 bp, Homo sapiens
  misc_feature: GYAE6OF02I42S8.15.81.H04.1.454.CMB.1.raw
  modified_base (410)..(410): a, c, t, g, unknown or other
  misc_feature (410)..(410): n is a, c, g, or t
  modified_base (504)..(504): a, c, t, g, unknown or other
  misc_feature (504)..(504): n is a, c, g, or t
  modified_base (511)..(512): a, c, t, g, unknown or other
  misc_feature (511)..(512): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaacaacagcactctcgactggtacttcggcggagggaccaagcncgaccgtcctaggtcacgcccaaggctacgccccttggtccacttctcgttcccaccctcctcgctacgtagactggagcgggctggcacggcncatagcnn

SEQ ID NO: 179022 - DNA, 634 bp, Homo sapiens
  misc_feature: GYAE6OF02JVRFB.15.81.H04.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (251)..(251): a, c, t, g, unknown or other
  misc_feature (251)..(251): n is a, c, g, or t
  modified_base (334)..(334): a, c, t, g, unknown or other
  misc_feature (334)..(334): n is a, c, g, or t
  modified_base (430)..(430): a, c, t, g, unknown or other
  misc_feature (430)..(430): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcaggcactagggtcctgggcccagtctgccctgactcagctgccctccgtgtcctgggtctccgtggacngtcgatcatcntcgttcagcactgactccagcagtgacgtttgtagttataattntgtctcgtagtaccacacgtccagacaaaccgtccccaatcatagtattatgaagtcaagtactccggaccctgtacgggttntactcgtcttcgtctgtcctactagtctacgacactaccggtcctaccgtagactactcgtcgtcggcctcgaggtcaggtacgaccggtagggtntagttaactcgtacgctagcctagtatacgtagaaggttcagtaccgacctccggttacgttaaccggttcggtttacccggaggggttaaccgtaacccggtaacggtcccggtcgtttacccccggacggttaacgttaccccggtaaccggaaccccggttaccgggtaccccgttcccccggtacccccgtttacccggg

SEQ ID NO: 179023 - DNA, 601 bp, Homo sapiens
  misc_feature: GYAE6OF02HP46T.15.81.H04.1.454.CMB.1.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcaggcacgagggtcctcgggcccagtctcgccctgactcagcctgcctcgtgtccggtctcgtgacagtcgatcatcatcttcngcactggatcagcagtgacgtttgtagttatatatgtctctgtacacacgtaccgngacaacgacccaactacatcgtaatttacgngtacgtacacgtaagtccgaccgtcgttacgggttctaacgtcgtcttctgtcgcctctacgtcgtcgactaaccgacgtccttacccgtgaccacttcctacgtcggccttcgacgtcgtggacggtacgggtacggtagtactttagttacgtagtacacgtactatacgtaagtacggagacgacgtctaccgttacgccggttaacgtcggggaccgtagggaccgacgtcgtaccggtaccggtctacggtaccgaccgtaccggacgcccgttaccctccccgttcggtacctacccg

SEQ ID NO: 179024 - DNA, 647 bp, Homo sapiens
  misc_feature: GYAE6OF02IPR96.15.81.H04.1.454.CMB.1.raw
  modified_base (218)..(218): a, c, t, g, unknown or other
  misc_feature (218)..(218): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (476)..(476): a, c, t, g, unknown or other
  misc_feature (476)..(476): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcgagggcacagggtcctgggcccagtctgccctgactcagcctgccctccgtgtcctgggtctccgtggactgtcgatcatcattcgttcngacacgtggactccagcaggtgtacgttggtaattataattatgtctccttggaccaacagtacccaggacaaacgaccccaaatcactgtattaangtacgtcagtactccggcctgtagggttcatcgctntcgtcgtctacagtcgtacggctaacgccgtcctcctcgtacctacgtctcggtcggaccttccgacggtacgtcggaagggaccgggtagggttacgtaagtttaacgttaccgttcgggaacncggttacctacgtaagttaaacgtaacggtaacggttacggtacgaaacggttcctaaaccgtttcgttaccggtaaggttcccggtacgggtacggtaaccgtaacgtcgtaccggtaaccgttccgtaacggtcaccggaccgtacggaccgtcccggtcccgttacgg

SEQ ID NO: 179025 - DNA, 669 bp, Homo sapiens
  misc_feature: GYAE6OF02I6YXU.15.81.H04.1.454.CMB.1.raw
  modified_base (304)..(304): a, c, t, g, unknown or other
  misc_feature (304)..(304): n is a, c, g, or t
tcagtctacgtagccacgaccggtgctcgatttagtagtgtagattcgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcattcttctgcactggactccagcaggtcgacgttggtagttataattatgtctctgtaccaagcgtaccagacaaacgccccaaatcatgtattagngtaggtacagtaacgtccggtacccttggtacggggttttactaacgtccgtcttctcgtcggtaccttacctaagttcgtacggacctaaccgtccggccctcccgtaccgacctacttcccgtggtaccggtcctacccgagggtcgtagggtaacgggaccgggtaggtacgttattaacgtttacgtgaccgtacgtcccttagacgttaaacgtaggtacggtcggtacaacggtacccttaacgttcccgttaacggttacggttccggggacgggttcgggaaaccctaggtacccgtacggtcccgttaccggtaggtacccgacgtacccgtacggtccgtccccgacccgttcgg

SEQ ID NO: 179026 - DNA, 711 bp, Homo sapiens
  misc_feature: GYAE6OF02G1TEC.15.81.H04.1.454.CMB.1.raw
  modified_base (203)..(203): a, c, t, g, unknown or other
  misc_feature (203)..(203): n is a, c, g, or t
  modified_base (707)..(707): a, c, t, g, unknown or other
  misc_feature (707)..(707): n is a, c, g, or t
tcagtctacgtagccacgaccggtgctcgatttagtagtgtagattcgcgggggggggtctcgaggaggcagcgctctcaggacatctccaccatggcctgggctctgctgctcctcaccctcctcactcagggcacgagggtcctgggtcctcactggaaccagcagtgacgttgttggtatactttgtctctgataccaangcaccaggcaaagcaaccaatcatgtattagtgagtcactaatccggccctcgtagggtttctaactcgtacttctcgtcgctcgaagtctggacaacgccggcctccctagacctacgtcctcggtcgggcctcccgaggtctgggacggtacggaggtcgtagtacttttattacgttgacgtactaccgtactaagttacttaaacccaaaccgtaaacgtcgtaacccacgttaccgtaccggtacttacgggttacgttaccgggacgggtaacgggaaccgtaacgtaccgtcggtacccgtcgttacggtacctaacggacccgaacgggcccttacccggcccccgttacggtacctacccgttccgttacccgtttacccccctaccgtttacccgtaccggttaccgttaaccgtacggtaaccgtcggggaaccgggtcccgggtacgggttcggtaacccggaacgggttccccggaattacgtacggtacncgac

SEQ ID NO: 179027 - DNA, 776 bp, Homo sapiens
  misc_feature: GYAE6OF02JWUDP.15.81.H04.1.454.CMB.1.raw
  modified_base (767)..(767): a, c, t, g, unknown or other
  misc_feature (767)..(767): n is a, c, g, or t
  modified_base (774)..(774): a, c, t, g, unknown or other
  misc_feature (774)..(774): n is a, c, g, or t
tcagtctacgtagccacgaccggtgctcgatttagtagtgtagattcgcggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggacaaagcaaccaaattcatgattatgaggtcactaatcggccctacgaggggttctaatcgtacttctctggtctctaagtctggacacgacggcctcctacgacctatcctcgtcggtctacccaggtcgttacggaacggtacggaacgggtcgttagtaagttttaacgttaagttacggtacttactaccgtttacctaattaaacttaaaccctaaaacccgaaactaaaccgtacctaaaccgttcgttaacccgttaacgtttacgggttaaacgttttcccggggaaacgggggtaaaccgggaacccgttaaaggaccctttaaaccggggtaccccgttaccggttaaacccgggttacgtaacccgaaccccgggtaaaccgggtccgtaacccccggtacccccggttccggttaaccccgtaaccttccgggttaacccgtttcccccggtccccttacccgtccgttaaccgtacccgttacggtaccggtacggtaccggtccgggaccgtacgggtccgaacggcgtacccgaagngtaccgncg

SEQ ID NO: 179028 - DNA, 760 bp, Homo sapiens
  misc_feature: GYAE6OF02GU0ZR.15.81.H04.1.454.CMB.1.raw
  modified_base (247)..(247): a, c, t, g, unknown or other
  misc_feature (247)..(247): n is a, c, g, or t
  modified_base (756)..(756): a, c, t, g, unknown or other
  misc_feature (756)..(756): n is a, c, g, or t
tcagtctacgtagccacgaccggtgctcgatttagtagtgtagattcgcgggggggggtctcaggaggcagcgctctcaggacatctccaccatggcctgggctctgctgctcctcaccctcctcactcagggcacgagggtcctgggtcctccactggaaccagcagtgacgttggtgttatactttgtctcctgataccaacagccacccgaggacaaagccaaccctaaattcatgtatttagnggagtcactaagtccggccctcgtaggggtttctaatcgtcttctctgcctacaagtcgtcggacaacgaccggtccctccctacgacctatccgtcgtcgggcctccgaggcgtaggacggacggaggtctagtatttacttagttcgactacgttactctaattaacgtaaccaaaccaaccgacgtacctaacctcgtttaccgtaacgtttcgggttacggttaccggggacggggtaaccgggaaccgtaacgaccggttaccggtaacccggttaccgttacgggtaccgaaccggtaccccgtaacgggtcccgttaaccccgtccccccgggttacgggtaccccttaccggttcccgtttaccccgttacccccgtaccccccgttacccggttccccgtaccgttacccgggttaacgtacccgggtcgggtaccggggtacccggggtcccggtaccggggtaccggtaccgggaccggtaccggtaagttcgaccgngacc

SEQ ID NO: 179029 - DNA, 689 bp, Homo sapiens
  misc_feature: GYAE6OF02JXCJP.15.81.H04.1.454.CMB.1.raw
  modified_base (175)..(175): a, c, t, g, unknown or other
  misc_feature (175)..(175): n is a, c, g, or t
  modified_base (638)..(638): a, c, t, g, unknown or other
  misc_feature (638)..(638): n is a, c, g, or t
tcagtctacgtagccacgaccggtgctcgatttagtagtgtagattcgcgggggggtcgtcaggaggcagcgctctcaggacatctccaccatggcctgggctctgctgctcctcaccctcctcactcagggcacagggtcctggcccagtctgccctgactcagcctgcctcgngtctggtctcctggacagtcgatcatcatcttctagcactggactccagtccaggttcgacgtttggtaagttattaattatcgtctccgtggtaaccacctagtacccaggaccaaacggcccccaaaagtcacttgactttagtgtaggtacgaagtaacgtcgaccctcggtaggggtttactaactcgtccgttctacgtcgggtcctacgtacttcgtacggtaccacgtaccgggtccctcccgtacgtaacctcgttcgtccgtcggtacttcccgagtcgtcgacggtaggtacgtgtaaattcttaccgtgaccgtcgtacgtctaagtcgtaaaggtacgtacggcgtaaaccgtcccgttaacttaccgttacggttacgtccgggttcgggtaacgggtaccgtaaccggttcggtaacccggttacccggtaaccggttgggtaaacccnccggtaacccggtaaccgggtcccgtttccccggtaacccccggttccggg

SEQ ID NO: 179030 - DNA, 615 bp, Homo sapiens
  misc_feature: GYAE6OF02GCZ59.15.81.H04.1.454.CMB.1.raw
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggacagtcgatcatcattcttctgcactggactccagcagtgtacgttggtagttataattatgttctccgtcggtaaccaacacgtacccaggacaaacgacccccaatcatgatttagngaggtcagtaactcggcctcgtacgggtttctactcgtctctcgtgctaccgagtcgngaccaacgcgtccctcctcactntctcgtcggctcgtaggcgtaggacggtacggaggtacgtagtttaactctgcgacgtctactagttaagtaggtaggtggaccacgtacgttaccgtcgttacggttacgttcccggggaggtccgggaacccgtacggtccgttacccggtacccggttaccgtaacgggtcccgacggtaccccgaaggttcccccgtccccggtcccgttaacccggg

SEQ ID NO: 179031 - DNA, 541 bp, Homo sapiens
  misc_feature: GYAE6OF02FP5XA.15.81.H04.1.454.CMB.1.raw
  modified_base (211)..(211): a, c, t, g, unknown or other
  misc_feature (211)..(211): n is a, c, g, or t
  modified_base (294)..(294): a, c, t, g, unknown or other
  misc_feature (294)..(294): n is a, c, g, or t
  modified_base (429)..(429): a, c, t, g, unknown or other
  misc_feature (429)..(429): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttcngcactggatccagcagtgacgttggtagttataattatgtctctgtaccacagtaccagacaacgccccaaatcatgtattangagtcagtaatcgccctgtaggggtttactatcgtcttctcgtcgctacaagtcgtaggacaacgcgtcctccctgacctatctcgtggcctccgagtcgtaggacggtacggagggtatagttattcgtgaccngtctcaatagtaagtaggtggctacgcacttcgtacgttgtcggtacggtcggaccaggtcctacgtacgtaccgtgtaccgacggacctaggccgttccgccccgttccgg

SEQ ID NO: 179032 - DNA, 646 bp, Homo sapiens
  misc_feature: GYAE6OF02HZAA0.15.81.H04.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (387)..(387): a, c, t, g, unknown or other
  misc_feature (387)..(387): n is a, c, g, or t
  modified_base (644)..(646): a, c, t, g, unknown or other
  misc_feature (644)..(646): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccgactggaaccagcagtgacgttggtggttaatactttgtctcctgataccaanagcacccaggcaaagcaaccaaattcatgattangagtcactatcggcctgagggtttctaagtcgctttctactggtcctacgtaagtctaggtccaacgacggtcccctcctgaaccatctcgtcggcctacgagtctgacgggacgaggctagtacttaagttagttgactattacctntaaactactaaacaaacccctaagacgtactaacctccgtacgtacgttacgggttacgttcgggtacgggtaacgggaacccgtaaaggtacgtaaccggtaccgttaccgtaggtaccaaccgtacccgaaacggtccgtacccggtccccgttcggtaaaccctccgttaccgttccgttcccccgtcctcccgtccgtcctaccgtacgtacgcggtacggccggtcgaccggtcgacggccgatacgtacgnnn

SEQ ID NO: 179033 - DNA, 840 bp, Homo sapiens
  misc_feature: GYAE6OF02IXZZH.15.81.H04.1.454.CMB.1.raw
tcagtctacgtagccacgaccggtgctcgatttagtagtgtagattcgcgggggggggtctcaggaggcagcgctctcaggacatctccaccatggcctgggctctgctgctcctcaccctcctcactcagggcacagggtcctgggcccagtctgccctgactcagcctcgcctccgtgtctgggtcctccgtggacagtcgactacattcattccgttctgcctacgtggtactcccgaaggcctaggtcggtacggtttaggtaaggttattaattagttacgtcctccgtacggtaaccaacgtaccgtaaccgaacgggtaccaaaccgaacccccgtaaacttcaacgtttagtaacttttaacggtaggtaacgggtaacgtaaacgttaaccggtcccggtaacccgttacgggtaacggggttttactaaacgtccgttaccgtttcctcgttcgtacctacgtaaacggttccgtaggtaacccaaccgtccgggtccccttaccgtaccggtacctagttacccggtcggttaccgggtacctaccgggacgtcgtagggaacgggacggtacgggttacttaagttaaccttcggtacgacgtaccgtcttaacgtaagttaacggtaacgtacgggtacgactaacggtccctaacgttcccgtttaagggttaacccgggtccgggttaccgggaaccgggttaaccggaccgggtttacccgtaaccgggttaccccgttaaccgggtttaacccggtaaccggtacccggtaaaccccggttaccggtacccggttacccccgggttaccccccggttaaccgg

SEQ ID NO: 179034 - DNA, 605 bp, Homo sapiens
  misc_feature: GYAE6OF02FVPG4.15.81.H04.1.454.CMB.1.raw
  modified_base (377)..(377): a, c, t, g, unknown or other
  misc_feature (377)..(377): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggacagtcgatcatcattcttctgcactggactccagcagtgacgttggtagttatatatgtctctgtaccaacacgtaccaggacaaacgccccaaactcatgtattatgaggtcagtacgtccggcctcgtaggggtttctagtcgtcttctctgtctcctagtcgcgacacgtaccgcctccncgacctctctcgtcggtctccgaggtcgtggacggacggtacgggtagtaagttactacgtgaccacgtctaactagtaagtaacggtaaggtcggaacgcgtacctcgttaccgttcgttacgtccggggtacgggtacgggaccgtacggtccgtaccggtacccgttaccggtacggtaccgaccggtaccccgaaggtccccgtacccgtccccggttacccgg

SEQ ID NO: 179035 - DNA, 507 bp, Homo sapiens
  misc_feature: GYAE6OF02F2YI7.15.81.H04.1.454.CMB.1.raw
  modified_base (358)..(358): a, c, t, g, unknown or other
  misc_feature (358)..(358): n is a, c, g, or t
  modified_base (466)..(466): a, c, t, g, unknown or other
  misc_feature (466)..(466): n is a, c, g, or t
  modified_base (503)..(503): a, c, t, g, unknown or other
  misc_feature (503)..(503): n is a, c, g, or t
  modified_base (505)..(507): a, c, t, g, unknown or other
  misc_feature (505)..(507): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgattatgagtcactaatcggccctcaggggtttctaatcgcttctctggctccaagtctggcaacacggcctcctgaccatctcgtgggctccaggctgaggacgaggctgattattattgcatcnaatatacaaaccaacagcactctcgactggtattcgggcggagggaccaagctgaccgtctacggtcagcccaagcctcgcccctcggcactctcgtcccaccctccncgcctacgcactggacgcgggctggcgaggccgatangnnn

SEQ ID NO: 179036 - DNA, 737 bp, Homo sapiens
  misc_feature: GYAE6OF02HP24V.15.81.H04.1.454.CMB.1.raw
  modified_base (730)..(730): a, c, t, g, unknown or other
  misc_feature (730)..(730): n is a, c, g, or t
  modified_base (735)..(735): a, c, t, g, unknown or other
  misc_feature (735)..(735): n is a, c, g, or t
  modified_base (737)..(737): a, c, t, g, unknown or other
  misc_feature (737)..(737): n is a, c, g, or t
tcagtctacgtagccacgaccggtgctcgatttagtagtgtagattcgcgggggggggggtctcaggaggcagcgctctcaggacatctccaccatggcctgggctctgctgctcctcaccctctcactgaggcagacggtcctgggtcctccacgtggaaccagcagtgacgttggtaggttattaacttttgtctcctagactaaccgaacagccaacccgaggcaaaacgtccaaccctaaattcaagtagtattttagagtaggtaccaagttaacgtcccggtacccttcgggtaggggttttacaaacgttcggtctttcctcgtcggtactaccgaattcgtacggacaacaccggtcccttacccgagtaacctatttcccgtacggtccgggtaccttaaccgggcgggttccgagggtaacggaccgggaacgtcggttcgttaaaagtttagtttaaccgttggaaccctatttacccgataaaccggtaacttaaacccgaaacctaacgcgttacctacgtcccgtaacgtacgttacggtacgttccggacgggaacgtacgaacggcgtacgtaccgtaccgtacggtaccgacgacccgtacgacccgtccgtaccccgtgtactccgtccttaccgtccccctacgtcccgtcctacggtaccgttggacgtcggaccgcggttaccgtcggaacgttcggacctacgtacgngtacntn

SEQ ID NO: 179037 - DNA, 684 bp, Homo sapiens
  misc_feature: GYAE6OF02JG7JE.15.81.H04.1.454.CMB.1.raw
  modified_base (252)..(252): a, c, t, g, unknown or other
  misc_feature (252)..(252): n is a, c, g, or t
  modified_base (357)..(357): a, c, t, g, unknown or other
  misc_feature (357)..(357): n is a, c, g, or t
tcagtctacgtagccacgaccggtgctcgatttagtagtgtagattcgcggggggggggtctcaggaggcagcgctctcaggacatctccaccatggcctgggctctgctgctcctcaccctcctcactcgagggcacgagggtcctgggtcctccacgtcggaaccagcagtgacgttggtgttatactttgtctcctgactaccaacacgccacccgaggacaaacgccaacccaaattcgatgtattanggagtcaactacgtccgcctcgtagggtttactaatcgtcttctcgtggtcctcgaagtccgtgaccacgaccgtcctcgacgactctcgtcgtcgtccgtacgngtcgcggaggacggcgtctaggttactttagtacgtcgtactctactatacttaaacaaccaaacctacgtacgacctacgtacgtacgtacggttacggttacggtacgggaccggaacgacgtaacgtcgtaccggtacgtacgtccgacgacccgtacgtaccgtccgtacccggtcccgtacgaccttaaccgttcccgttaccccttaccccgtaccccttccggttaccgtaccgttaccggtacggtaccggtccgggaccgggtcccggttacgggaccggtaacgggacccgtacggtaacttcgggatccggatacg

SEQ ID NO: 179038 - DNA, 758 bp, Homo sapiens
  misc_feature: GYAE6OF02H15P0.15.81.H04.1.454.CMB.1.raw
  modified_base (127)..(127): a, c, t, g, unknown or other
  misc_feature (127)..(127): n is a, c, g, or t
  modified_base (523)..(523): a, c, t, g, unknown or other
  misc_feature (523)..(523): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactnaggcacaggtcctggccagtctgccctgactcagtcctgccctccgtgtcgtggtctccgtggacagtcgatcactctactcttctcgctcgtaggactccagtcgagtggtacgttaggttaagtttataaattgtacgttctcccgttagtaacctaaacgacctaacccgagaaccgtaaacccgaccccaaactccaagttagttaacttagtggtaacggtacgtaacgtacgtaccccggtaccgttacggtacggggtttactaaaccgtcgttccttacgttccggtacggtaccttaacccgtacgttcgtacggtaaacccacccgtaacccggtcccctacccgtacctaacccagttccgttacccggtcggcccgttacccgnggttaccggaggtaacgggtacggagggtttaagtaacgttttacgttacgtcgtaccgtacgtcccgttaagtaccgttaaataaacgggtaacggtacgacgtaacgtcccttaaccgttaccgttacgttacgggtccgtaccggggtaccgaaccgtcgtaccggtaccgttaccgtaccgtaccgtaccgaccgacccgtacggtacccggtaccccgtccgtaccccgg

SEQ ID NO: 179039 - DNA, 726 bp, Homo sapiens
  misc_feature: GYAE6OF02IZQGL.15.81.H04.1.454.CMB.1.raw
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctcgccctgactcagcctgcctcgtgtcgtgggtctcgtggacngtcgatcatcattcttcngcactggactccagcagtgtacgttgttagttaatattgtcgtctaccgtacggtaaccaacgtacgtaccgaaggaccaaaacccgaccccaaatcaacgttagttattagacgtaggtactaagttaacggtcccggggttccggttacgggttttactaacgttcctacgtttccgtcgttccgtaccttaccgtaaggttccgtacggaacccaaaccgtccggtcccctaccgtacgaccctacttccgtcggtccggtcctaccggtacggtacgtaggacggggtacggtagggttacgttaacgtttacgttacgtgtacctacgttactacgtaattaaggtacgggtacggtaccgtaacacggtacttaccgttaccgttcggttccggttacggggacgggttaccgggaactcggtaccggtaccggttaccgttaccgtacggtccgaaccggtccgtaaccggtcccgttaccccggtacccggtccgttaaccccg

SEQ ID NO: 179040 - DNA, 693 bp, Homo sapiens
  misc_feature: GYAE6OF02FMBNB.15.81.H04.1.454.CMB.1.raw
  modified_base (472)..(472): a, c, t, g, unknown or other
  misc_feature (472)..(472): n is a, c, g, or t
tcagtctacgtagccacgaccggtgctcgatttagtagtgtagattcgcgggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctcctggacagtcgatcatcatcttctgcacgtggactccgagcgtaggtgacggtttggtagttaatattatcgtccttcgtacggtaaccaacgtacgtaccgaggaccaaaccgaccccaaactcatagtatttacgtggacgtactaagtaacgtccggtccgtacggttacggggtttactaacgttccgtcttcgtcgtgtcctacgtaacgtcgacggtaccaccggtaccgtacccgtccctacgaccctctcgttacgtccgggtacctaccggnggtcgtagggacggacggtgggtacttacgtttacgtaccgtgaccgtagtccgtattaacgtaggtaaggtaggtacggacgacgttaccgtacgttacggttacgtacgggttcgggtaccgggtacggtaccggtaacggttccggtaccggtacccggttacggtacgtaccgtaccggtacccgtacggccccgttacccggtccccggttacccg

SEQ ID NO: 179041 - DNA, 537 bp, Homo sapiens
  misc_feature: GYAE6OF02GDQ7F.15.81.H04.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (450)..(450): a, c, t, g, unknown or other
  misc_feature (450)..(450): n is a, c, g, or t
tcagtctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgccctccgtgtccgggtctcctggtacngtcgatcatcatcttctgcactggactccagcagttgacgttgtattatatatgtctcctggtacctaacacgtacccaggacaaacgacccccaaatccatgtattangagtcagtaatccgacctcgtaggttctatcgcttctctgctcagtctcgacaacncgtcctccncgaccatctcgtcggctccgagtcnggacggacggtagggtactatttacttacgtgtacgcgttcaatagtaagtaggngcagcctacttctagtgtcggcggtacgacgtacgctacgaccgttcgtacgtcacgccgtacggccgtccgtcccgtacgctaccg

SEQ ID NO: 179042 - DNA, 711 bp, Homo sapiens
  misc_feature: GYAE6OF02HHNLT.15.81.H04.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (689)..(689): a, c, t, g, unknown or other
  misc_feature (689)..(689): n is a, c, g, or t
tcagtctacgtagccacgaccggtgctcgattttagtagtgtagattcgcgggggggggtctcagggaggcagcgctctcaggacatctccaccatggcctgggctctgctgctcctccaccctcctcactcagggcacgagggtcctgggacccagtcctcgccctgacctcacgcctgccctcgtgtcgtgggtcctcgtggacngtcatctatcattcttctgcctacgtcggacnccagtcagttggtacgtttaggttaagtttaattaattacttcgtaccttccgttaacgtaaccaacgtacgtacccgagtacgaccgaccgtaacccccaattcaagtagttactttaggcggtaaccggacctaacgtaacgtacccgtaccgtcggtacggtttacctttacgaccgttccgttacctttcggaccgttcgtaccttaccgaggttccgtacggaacctaaccggcccgttcctacccgtacgtaccttacgttccgtacggaccgttcccgacggtacggtacggtaccggtacgaacgggtactttaacgttaactttcgtaactcgtctacgttctacgtagttacggttactaaacgttaacattaacgtataccggttagtaccggagtaccggacgtagccgtacgtaaccgcgtacgtcgcgtacccggngtacccgtccgtcccggtcccg

SEQ ID NO: 179043 - DNA, 662 bp, Homo sapiens
  misc_feature: GYAE6OF02HLY9E.15.81.H04.1.454.CMB.1.raw
  modified_base (213)..(213): a, c, t, g, unknown or other
  misc_feature (213)..(213): n is a, c, g, or t
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagtcctgccctcgtgtcgtggtctccgtggacagtcgatcatcatcttngcactggatccgagcagtgtacgttggtagttataattatgtctctaggtaccaacngtaccagcaacgccccaaatcactgatttagngagtcataagtccgcctgtaggtttcagtcgtacttcncgtgcctacgaacgtcgtcgacctaacgacccgtacctcccgtacgtacctagtcgtaccgtcgggtccctaaccggcgtaccgtagggaacgggacgggtagggtcgttaatttaacgttacgtacgcgtaacgtcctaacgttaacgtaacgttaagtaacggtacggtacaaccgtaccgttaccgttacccgtacggtttacggtccgggtacgggaccggtaaccggtacggtacctaccggggttaaccttacccgggtaacgtcccggttaaccgacccggttaagtccccgttcccgtaccccggtttacccgg

SEQ ID NO: 179044 - DNA, 787 bp, Homo sapiens
  misc_feature: GYAE6OF02HP8IY.15.81.H04.1.454.CMB.1.raw
  modified_base (123)..(123): a, c, t, g, unknown or other
  misc_feature (123)..(123): n is a, c, g, or t
  modified_base (642)..(642): a, c, t, g, unknown or other
  misc_feature (642)..(642): n is a, c, g, or t
tcagtctacgtagccacgaccggtgctcgatttagtagtgtagattcgcggggggggtctcaggaggcagcgctctcaggacatctccaccatggcctgggctcgtgctgctcctcaccctcncactcagggcacagggtcctgggcccagtctgaccctgactcagcctgcctacgtgtctggcctctggacctagtcgatcatcatcttacggcactggaatcccgagctaggtacgtacgggtttaggtaagttattaattagtacgttccgccgtttacggtacctaagtaccgtaacccgtaagggtacccaaaccggtacccccctaaataccgtaacgttacggttaacgtttagtaggtaaccgtacgtaagttaaccggtcccggtacccgtttacggttaacggggttttactaacgtcggttaccctttacgttcgtcgttacctccgtaaagtcccgtaaggctaaaccgaccgtcccctacccgagacccttactccgtacggtcccggacttaccgacgggttaccgagggtaaccgggttaccggaagggttacctaagtttaacgtttaccggacgtacgaccggtataacttaacggtaaataagggtacgtacccgggaacctntaacccgaccgtttacgtaacgggttccggttacgggaccgggggtaaccgtacctaacgggttccacccggttaacccggtttacggaccggtacccgttaaccgggagttacccgggtaccggtccccgtacccgttacccgg

SEQ ID NO: 179045 - DNA, 822 bp, Homo sapiens
  misc_feature: GYAE6OF02GLZMV.15.81.H04.1.454.CMB.1.raw
tcagtctacgtagccacgaccggtgctcgatttagtagtgtagattcgcgggggggggtctcaggaggcagcgctctcaggacatctccaccatggcctgggctctgctgcctcctccaccctcctcactcgagggtcaccgagggtcctcgggcccaggttcctcgccctagtactcacgccgtcgcccgttccgttcgtcgttcgggtcctccggttcggacgtggtaccgatcagtcctattcttcgcgtcaacgttggtacctaccagtcgtagtcggtaacgttggttaattaattaagttcgtcgttcctccggtacgtaaacccgactaccgtacccggacgaaccgtaaaacccgacccctaaactcgaagtttactaacgtttcggaacggtaaccggttagtaacggttaaccggtccccggtaccgttttaggggttaacggtttacctaacgttcccgttcttcgggttaccgtacgggttacccctaagttaccgtacggtacccggtaaaccgtaacccggtcccgttccccttaaacggccctaaacgtccggttaccgtcccgggttacggtcccggtaaccggtcgggtaaccgggtgggtaacgggaaccgggttaaggttcgtaaccttttacggccgttacgggcctaaacgggttcaaggtacgttaggacggtgtacgaacgtctacttgtacccggttggtacgttcgggtaccgaacggtacgtccggtcgttaccggtacgtacccggtagtcccgcggttaacccggctccccggttacccggcccgttaacccgg

SEQ ID NO: 179046 - DNA, 1109 bp, Homo sapiens
  misc_feature: GYAE6OF02IRAMN.15.81.H04.1.454.CMB.1.raw
  modified_base (520)..(520): a, c, t, g, unknown or other
  misc_feature (520)..(520): n is a, c, g, or t
tcagtctacgtagccacgaccggtgctcgatttagtagtgtagattcgcgggggggggtctcaggaggcagcgctctcaggacatctccaccatgcctgggctctgctgctctcaccctctcactcgacggcacgacggtccgtcgggcccaggtctcgcccgtagactcacgtcctcgtcctcgtgtcgtcggtctaccgtggactcgtcgtatctactcacttcttctcgactactggactaccgtacgacgtacggtaggtacggtttacgggttaattttaacgttaaacgtttgttccgttaccgtttaccggttaaaccggtaaccctaaacccgtacggtaacccccggtaagggtaacccctaaaccccggtaaccccccttaaagttacctaaggttaaccggtttaattacggttaacgggacgttccgtaaaacgggtttacctccccggggtaaccgttaccgggtttaacggggtttaaccaacggtttccgtaccgttttacccgnggttaccggtacccgtttaaccggtaacggtttcggaacggtacccctaaccggtccgggttccccttaccgtacccaccgttacgtttaccgtacgggtaccgttacccgttaccgggcgggtacggttacgggaacgggtaacggttacgggttaacgtttaaccgtttacgttaaccgggttcgaacccggttacgttaacccgttaagtaaaccgggttttaacgttaaaacgggggtttaccccgggtaagggttaaaccccgtaacccgggtttaacccgggtttaacccgtttacccgggggtttttaacccgggttaaaccgggggtttccggggggtttaaccccggggggtttaacccgggtttaaaccccgggggggtttaccccgggtttaaccccgggttttaaacccggggggtttacccccgggttttaaccccgggggaacggggttttttaaaacccccgggggaacccccggggtttttaaaaccccccccgggggttaaccgggggttttaaccccccccccgggtttaacccgggttaaccccccccccgggggtttttacccgggggg

SEQ ID NO: 179047 - DNA, 706 bp, Homo sapiens
  misc_feature: GYAE6OF02GGMBZ.15.81.H04.1.454.CMB.1.raw
  modified_base (214)..(214): a, c, t, g, unknown or other
  misc_feature (214)..(214): n is a, c, g, or t
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
tcagtctacgtagccacgaccggtgctcgatttagtagtgtagattcgcggggggggtctcaggaggcagcgctctcaggacatctccaccatggcctgggctctgctgctcctcaccctcctcactcgagggcacgagggtcctgggcccagtcctgccctgactcagcctgccctcgtgtctggtctcgtggactgtcatcatcattcttcngactactggactccgagctagtgacggttgtagttatagtatgtcctacgtgttaccactacgtaccagaccaaacgacccctaatcagttcgtatttagtagacggttanaggttaactccggccgttaggtacggggttactaacgttcgtactttccncgttcggtacctacgtacgtccgtaggaccaaccggtacctcccgttaccctcgaacctagttacctccggttacggtccctacgggaaccgttcgtacgggaaccgggtagggttacggttaacgttacgtttaacgtacgtccggatacggtctaacgtaagtactaagggtacggtacgtacgtcgtacgttaccgttcgtaaaccggttgggttaccggggtacgtaaccggtacaacgggtttcccgtaacggtacccggtttacgaccgggttacacccggtaaccggtaccggttccccgttccccggacccggttttacccgg

SEQ ID NO: 179048 - DNA, 778 bp, Homo sapiens
  misc_feature: GYAE6OF02FIHBJ.15.81.H04.1.454.CMB.1.raw
  modified_base (144)..(144): a, c, t, g, unknown or other
  misc_feature (144)..(144): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (518)..(518): a, c, t, g, unknown or other
  misc_feature (518)..(518): n is a, c, g, or t
tcagtctacgtagccacgaccggtgctcgattagtagtgtagattcgcggggggggtcgtcaggaggcagcgctctcaggacatctccaccgatggcctgggctctgctgctcctcaccctcctcactcacggcacagggtccngggccccaggttcctgaccctgactcagcctggcctccgtgtcctgggtctccgtggaccagtcgactcatcactcgttncgcacgtggacnccgngccgagtcgtaacgttggtacgttaatacttatcgttcctccgtacggtaaccaaccgtacggtaccccaagggaccaaacccgtacccccctaaactacgtaacgtcgtaaacttttacgacggttaaccgggtactaacgttaaccgtcccggttaccccgttacgggttacgggggttttacctaaaccgtttccggtccgtttaaccgtcgtaccgggtactaaccgtaacgtttccgcggaactaaccggtacccggtcccttaccccgtacncccgtactaccgtcgtccggtccgtaacgtccggtaacgtacggacgggtaaacggtcgggtacttagtttactacgtacggctagcctaataacgttacgtaacgtacggtacgtacgtaccgtcgaccgttaccgttcggttacggtccgggtaccgggtaacggaacccgggtactccgggtaaccgtacccggtacgtaacggttcccgaccgtaaccccgggtaactcccgggtacccccgccccgttaacccgg

SEQ ID NO: 179049 - DNA, 715 bp, Homo sapiens
  misc_feature: GYAE6OF02GA2U7.15.81.H04.1.454.CMB.1.raw
  modified_base (712)..(712): a, c, t, g, unknown or other
  misc_feature (712)..(712): n is a, c, g, or t
tcagtctacgtagccacgaccggtgctcgatttagtagtgtagattcgcgggggggggtctcaggaggcagcgctctcaggacatctccaccatggcctgggctctgctgctcctcaccctcctcactcgagggcacgagggtcctgggtcctccactggaaccagcagtgtacgttggtggttaattaactttgtctcctgactaccaacagccacccgaggacaaagccaacctaaattcgatgtaatttagtggagtactaacttaacgtcccggtccttcggtacggggtttactaagtcgtactttccttcgtcggtcctaccgtaagtcgtcggacctaacgaccgtccctcctacgacctactctcggtacgggccttaccgacggtcgtacgggaaggaccggtacggtcgtagtaacttttacgttaatcgtactacgtctactaacttaacgtaaccaaacctaacgactacctaccgtcgtaccgtacgttacggttacggtcgggacgggaacggtaccgtaacggtactaccggtccgttacgtacggtacgaaccgtcccggtaaggcccgtacccggtaccccgtcggtaccctacgtcccgttaccgtcccctaccctccgtaccgaccgtaccgtacgtaccgggtcggaccggtccgggtgtaccgaacggacggtacctacgtagcgtcgtanacg

SEQ ID NO: 179050 - DNA, 791 bp, Homo sapiens
  misc_feature: GYAE6OF02HIB53.15.81.H04.1.454.CMB.1.raw
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (715)..(715): a, c, t, g, unknown or other
  misc_feature (715)..(715): n is a, c, g, or t
tcagtctacgtagccacgaccggtgctcgatttagtagtgtagattcgcggggggggtctcaggaggcagcgctctcaggacatctcccaccatggcctgggctctgctgctcctcaccctcctcactcgaggcactagggtcctgggtcctccacgtcggaaccagcagtgacgttggtggttataactttgtctcctagataccaacagccaccaggacaaagcctaaccaaattcagtgaatttacgnggagttcaacgtagtccggaccctggtacgggtttactaacgtccgtctttctcgtcgtacctaccgaagttcnggaccaacgccggtcccttccagtacctcttctccggtggaccctaccgaggtcgtaggtaacggaccggtaggtcttagtaacttttgttatcgtaactctctaaccggtaattaacgaaccaaaaccagggttcctaccgtaacctttcgaaccggttacggtttaggtacccgttacgggggaccgggtaacggaacctaaccgggtcggttaccgggtaaccccggtttcggttaaacgggtccctaaacgggaccccgaacgggttcccgtcccccgtccccgggtttaaccggcccttaaccggtttccgttccccgggttcccccccgtaaaacccttttccccgggaccgtttaccgttaaacccggggtcttaccccgggnggttaaccgggcccgggttaactacgggggaacccaaccgggggttcaacccggtttaagaacccggtgtacgtac

SEQ ID NO: 179051 - DNA, 715 bp, Homo sapiens
  misc_feature: GYAE6OF02JX9I0.15.81.H04.1.454.CMB.1.raw
  modified_base (120)..(120): a, c, t, g, unknown or other
  misc_feature (120)..(120): n is a, c, g, or t
  modified_base (132)..(132): a, c, t, g, unknown or other
  misc_feature (132)..(132): n is a, c, g, or t
  modified_base (658)..(658): a, c, t, g, unknown or other
  misc_feature (658)..(658): n is a, c, g, or t
  modified_base (671)..(671): a, c, t, g, unknown or other
  misc_feature (671)..(671): n is a, c, g, or t
tcagtctacgtagccacgaccggtgctcgatttagtagtgtagattcgcgggggggtctcaggagcagcgctctcaggacatctccaccatggcctgggctctgctgctctcaccctcanactcaggcacgnggtcctggaccctagttcctacgccctgactcacgcctgaccctcgtgtcgtagggtcctcgtgactgtcatccgatcagttcctcgtcgactacgtaggacctccgagtcgtaggttaggtacggtttagtaacgttaattaattcgtcgtcctacgttaggaacccaacgtaccgtaccgaggtacctaaacccgacccctaaagtcgtattaagtacgtttagtaccggtaggttaacacgttaaccggtcccggtacccttagggtaccgggttttaactaacggttccgtacgtttccgtacgtccggtactaccgtaggttactacggacctaaccggccgttacccgtaccgtaggtaaccctgttacccgtcggtacgggttacccttaccgtaggttaccgtaacggggtaggtaaaccggtgggtttaactaacgtttacgcgttacgacgtactaccgtagtataaccgtaggtccgtgtacgactccgtacgttgacgttcggagtccggtaanccgagtccggtanccggttacgagtcccgaacgtcgtacccgtctaccggtcctacg

SEQ ID NO: 179052 - DNA, 647 bp, Homo sapiens
  misc_feature: GYAE6OF01EMZET.3.6.A06.1.454.CMB.1.raw
tcagagacgcactccacgaccggtgctcgatttagatctactgacaacacacgaagggggagtcagtctcagtcaggacacagcatggacatgagggtccccgctcagctcctggggctcctgctactctggctccgaggtgccagatgtgacatccagatgacccagtctcatcctccctgtctgcatctggtagggacagagtcaccatcacttgccgggctaagtcagtagtattagcaggttattaaagttggtactacaagaacaaaaccgagggtaaacaccccttaaatttgattctagtcgctagctatccagtttgactaaggtcgggtaccatacgaaggttacaagttggactaggtggtacgtcgtagggactaaggtacttccgtacgtcctacgtaacctatacacgtctacggttactaactacgtacccgtaaggtaaacgttattttacgactttaaacttaactttaaccgtcgtaaacgtaaacgtacgtaacgtttaacgtaacggtttactttaggtttactttacgttaaccgtttcggtacccgttacgggtaaccgtaaaggtcgggtaacctagttaaccgaaacgtacttacggtacggtactacgtccgactcgttaccg

SEQ ID NO: 179053 - DNA, 871 bp, Homo sapiens
  misc_feature: GYAE6OF01BD2N7.3.6.A06.1.454.CMB.1.raw
  modified_base (810)..(810): a, c, t, g, unknown or other
  misc_feature (810)..(810): n is a, c, g, or t
tcagagacgcactccacgaccggtgctcgatttagatctactgacaacacacgaaggggggagtcagtctcagtcaggacacagcatggacatggacgggtccccgctcagctccgtggggctcctgctactctggctccggaggtgccagatgtgactatccaagactcgacccagtcctaccactccctcctgtctgctagtcgtagggtaacgggacaggtacgtaccaacctacgtacctacggttccggacccggtacgaagtaccgaaggtagttaattacgagttaaggtttaaattttaaagttggtaataacgaacgaaaccgaaaaaccggtaacggtaaaaccccgtaaccccttttaaagtttcgtaacttactacgtacggtacctacggtactaaccttccgttaacggtttaaccggtaacggttaaaccggggtttaccggggtaccccttaaaggtaaccggttaaacggtttacgaaaggttacgggtacgtagggttacgggtaacgttacgggttacggggtaaacttacggttaaccttaccgtaaccttcgtaaccctaccgtaacgtaccgtagtacccgtaacggttaaccaaccgggtacctaaggttaagtaacgttttacgttaacgtaacccttaccgtttaacgttacgtaaccgttaacctaagggtttaacctacggtttaaaccggtagttttaaccgggttttcttacccggtttaccgtttcccgggttaacccgggtacccgtttaaacgggaaacgtttacggaaccggttaanaaaccggtaacgtaaaccggttacgtcggtacgttactacgtccgtaacttcgggttaacc

SEQ ID NO: 179054 - DNA, 848 bp, Homo sapiens
  misc_feature: GYAE6OF01EJNS0.3.6.A06.1.454.CMB.1.raw
  modified_base (132)..(132): a, c, t, g, unknown or other
  misc_feature (132)..(132): n is a, c, g, or t
tcagagacgcactccacgaccggtgctcgatttagatctactgacaacacacgaagggggatcagtctcagtcaggacacagcatggacatggacgggtccccgctcagctccgtggggcctcctgcttacncgtggcctccggaggtcgaccgagtatggtacgactactccgagtactccggtacccagttccctacctacttcccgttcctgttctcgactgtcggtgggtaacgggacaggtctccaccgtattccgacggttccgggcgggtactaacgtcgaagttacgttaacggtacgtagtttaaaggtttaacttttaggttacgtactaaaccggaaacgtaaaaccgaaaaaccgggtacgggtaaacccctttaacccgttttaattccggtaactttacgggtacttcggtacacgtacctttaacgtaccggtttaggtacgtaaacggtcgggtacccggtactaacgtaggtaacgtacgagtggtaacgtggtacgtggtacgaggttacttaggttactcccgtatcccgtactactattccgaacgacgttcgtaaccggtaacgtcgtttaaacgtacgttaaacccgtttaacttttaaccctaagttttaccctaacgtttaacgtaacgtaacgttaccgttaacgttaacctttacggtttacggttttaccgttaacgttttaccccggttacggtttaccccggtaaacggtttaccggttaaaccggtaaccgtttaccggaaaccgtttaacgttaacccgggttattaccgggtaccttcgggtaacctacggtaacttaccgttcttacgttacccg

SEQ ID NO: 179055 - DNA, 726 bp, Homo sapiens
  misc_feature: GYAE6OF01CZILH.3.6.A06.1.454.CMB.1.raw
  modified_base (706)..(706): a, c, t, g, unknown or other
  misc_feature (706)..(706): n is a, c, g, or t
tcagagacgcactccacgaccggtgctcgatttagatctactgacaacacacgaagggggagtcagtctcagtcaggacacagcatggacatggacgggtccccgctcagcctccgtggggctcctgctactcgtggctccggaggtgccagatggtgacatccagatcgacccagtcctccactccctccctgtctgcagtcgtagggtagggacagtacgtccaacctatcctaccgttcgggacccgggactaagtcaggtagttaagttacggagtaggttaattttaaagttggttaatacgaacgaaaccgaaaaaaccggtaacgggtaaaaccgttaccccttttaaaacgttttagtaactacgtaagtcgtactcgactactacgttagtttacgaacgtaagggttccgggtacctagtacgttaacgttacgtaaggtcgacgtaaggttcggagttacggtagggtaaacgtagttactttaccaccgttacgtaacctaacccgtattaccgacgtacgtaacgttactaacgtacgtacgtagttaagttacgttttccgaactttaccgttaacttaccgtaacgtaactaaacgtagttaaccgttagttaacgtttacgtttacgttactttaccgttacggttcccgtaccgacggtaacgtagtacgtaacagtacgaacgttagngtacgtcagactcgtgtacg

SEQ ID NO: 179056 - DNA, 739 bp, Homo sapiens
  misc_feature: GYAE6OF01AYQWI.3.6.A06.1.454.CMB.1.raw
  modified_base (157)..(157): a, c, t, g, unknown or other
  misc_feature (157)..(157): n is a, c, g, or t
  modified_base (195)..(195): a, c, t, g, unknown or other
  misc_feature (195)..(195): n is a, c, g, or t
  modified_base (547)..(547): a, c, t, g, unknown or other
  misc_feature (547)..(547): n is a, c, g, or t
  modified_base (562)..(562): a, c, t, g, unknown or other
  misc_feature (562)..(562): n is a, c, g, or t
tcagagacgcactccacgaccggtgctcgatttagatctactgacaacgacacaagggggagtcagtctcagtcaggacacagcatggacatgagggtccccgctcagctccgtggggctcctgctactctggctccgaggtgccagatgtagaccntccagtatcgaccccagtctccacttccctccgtgtcngacacttcgtacgggtaggggaaccaggtacgttaccaaccgtatacctaacgttccggcccggggacaaggttccgaaggttaggtaagtacgtagtaacggttaatttaaagttacggtaatacggtaaggaaacctaaaaaccgggtaacggaaaccgttaacccccctttaaattttacggtacttacctagtaccgttactacggtacctaacggttacccgttaggttttaccgaaacgggttaaaccggttcggggtaccctaaggtaaccgttacgggtaacctagggtacgacgtaggtcgtaactggtacggtactagttactcctactactaccgactagngtacgcgtatacgtnacggtctaagtagttacttacgattaacctacttctacgtaacgaactacgtacgttaacttgttaaccgttagttacttaccgtacgttaccggtccgtaaggtaaccgtagtaccgtagtaaccgtaactaacccgggtaatcgggtaccttagaccctacgtaactcgttacgg

SEQ ID NO: 179057 - DNA, 752 bp, Homo sapiens
  misc_feature: GYAE6OF01DROFC.3.6.A06.1.454.CMB.1.raw
  modified_base (232)..(232): a, c, t, g, unknown or other
  misc_feature (232)..(232): n is a, c, g, or t
  modified_base (512)..(512): a, c, t, g, unknown or other
  misc_feature (512)..(512): n is a, c, g, or t
  modified_base (616)..(616): a, c, t, g, unknown or other
  misc_feature (616)..(616): n is a, c, g, or t
  modified_base (642)..(642): a, c, t, g, unknown or other
  misc_feature (642)..(642): n is a, c, g, or t
tcagagacgcactccacgaccggtgctcgatttagatctactgacaacacacgaaggggggagtcagtctcagtcgaggacacagcatggacatggacgggtccccgctcacgtcctccgtggggcctccgtgccttaccgtcgtcgggccgtccggaggtcgccgtaagtgtggtacgacctacgtccgaaggtactccgaccctagtccctcctacttccctccgtgtcngctagtcgtaggagggacagctcatctactcgttcggtcggaccggtatagtacgaggttgttaagtttaagtttaattttaaacgttaaagttcgttataccgtaaacgtaaccgaaacggaccggtaacctaccgtaagtccgtacgtagtattaccggtagtccgacttcgacctacgttaaccgttaaggtaacggtaaccggggtgtaaccctaggttagtaacggtgagggtcgtaggagttcggtagtcgtaacgggtctatttcccgttaancccgttagccctaacgtaccgttacgtaacgtttaacgtaccctaaacgtacgttaagtaaccttgtaaccgttaacctaactacggttataactaccggtaanaccggtaactctaacccccgtacctntaccgttacgtacggggaccggtaaccggtcggtaaacggtgtaccgggaaattccgtaaaactggggtacgtgaaccgttacctaacggaaccttgttcgtccttacgg

SEQ ID NO: 179058 - DNA, 900 bp, Homo sapiens
  misc_feature: GYAE6OF01EZNQV.3.6.A06.1.454.CMB.1.raw
  modified_base (106)..(106): a, c, t, g, unknown or other
  misc_feature (106)..(106): n is a, c, g, or t
  modified_base (567)..(567): a, c, t, g, unknown or other
  misc_feature (567)..(567): n is a, c, g, or t
tcagagacgcactccacgaccggtgctcgatttagatctactgacaacacacgaagggggatcagtctcagtcaggacacagcatggacagtcggacggtccccgntcgacgtccgtccgtcggggcctccgtgtccttactcgtcggccgtccggaggtcgacgtaggtatcggtacgactactccgagtacgtacccgaacccgtacgtcctacctacttccccgtccgttacgtcgtcgtcctaggttacggtacgggtaacggggtaacacggtacctaccgtaacctactaccgttacggtccgggacggtaccaaggtactaacggttaagtagttaacgtacggtttaaagggtttaaactttaaggttacgtaaactacgaaaaacgggtaaacccgtaaaaacggaaccgggttaaacccgttaacctttaactttacgacgttaacgtgtacgtcgtacgtcctaacttccggttagtagtaacggtacggtacggtaccgagtacgtaaggtatacgtaggtacgtggaaacgttcgtacgggtaactgtaacttntaccgtacgactacgactcgacgtactacggacttacgtaacggtacgtaccgtagttaacggttaaccgtttaccgaaaccttttaccgtagtttaaccggtaacctaacggttaaccgttaaaggtttaacccgttacgttaaaccgttttcgttaaacccgggtttttaccttacccgggtaacggtttaaccggtacccgggttaacgggtaacgttaaaccgggtaaccggtacggtaaaaccgtttaaaccgggaaaccgttacgggttaccccggttgttaaaccccgggttaaccggttactttaaacccgttaaagggtttccc

SEQ ID NO: 179059 - DNA, 932 bp, Homo sapiens
  misc_feature: GYAE6OF01CJUR4.3.6.A06.1.454.CMB.1.raw
  modified_base (629)..(629): a, c, t, g, unknown or other
  misc_feature (629)..(629): n is a, c, g, or t
tcagagacgcactccacgaccggtgctcgatttagatctactgacaacacacgaagggggagtcagtctcagtcaggacacagcatggacatggacgggtcccccgctcgagccttccgtggggcctcctgcttactcgtcggcctccggaggtcgaccagattgagactataccagataccgaccctagtcctacctacctccccttccgtcgttcctgacctagttccggtagggtacggggaactaggtacgtaccaacctataccgtaccggttcggacccggaataacggtacgtaaggtagtacttaacggtaacgttaaggtttaatttaaaggttcgtaacaaccgtaaacggaaaaaccgaaaaccgggtaacggttaaaaccccgtttacccttttaaaacgttacgtaacttaccgtagtacgtaccgtacttaccgtaacttaccggtttaaaggttacggaaccgggttaacgggttaccccggtacttaaaccgtaaacgggttaacgtttaacggaaacgggttacggaaccgggtttaaggtccgggttagttaaaccggggtaacggtaaccttaacgttttacgtaccctaacccttctacccgaaccttnacccgggttaaactccgttaaccgtaccgtaacgttaccggaagttaaccgtttaatttcccttaaccggttaaaccttacctttaacgaagttaccgaaaccgtttaacggaggtttaaccccgttaagttaaggtttttacccggttacttttacccgtaccccggggtttcgtaacccccggaagggttaaaccgggtttaaaaccgtaacgggttaacctaaaccgtaaacccgttacgtaaacggttacccgggtaggttacccagtttaccccaacgtttcgttccgtttaaacccg

SEQ ID NO: 179060 - DNA, 674 bp, Homo sapiens
  misc_feature: GYAE6OF02GEVST.3.6.A06.1.454.CMB.1.raw
  modified_base (226)..(226): a, c, t, g, unknown or other
  misc_feature (226)..(226): n is a, c, g, or t
tcagagacgcactccacgaccggtgctcgatttagatctactgacaacacacgaagggggagtcagtctcagtcaggacacagcatggacatgagggtccccgctcagctcctggggctcctgctactctggctccgaggtgccagatgtgacatccagatgacccagtctccatccctccctgtctgcatctggtaggggacagagtcaccatcacttgccgggnaagtcagagtatagcaggttaatttaagtggtatcagacaaaacgagggaaacaccccttaaatttgatctatcgctgcatcctagtttgacgtaaaggtcgggtacccagtacgtaagggttcaagtggactaggtaggtatcgtaggggactaggttactttaccacgttcctaccgaaccctataccgagtacgtaacgttccgtaaccgacgtcccgtaggtaaacgtttacgttttacgaaccttaaacctttacgtaacctttagtaacccgtaaacgtaacggttaacgtttaacgtaacggtttacgttttacgggtttaaccttttaccgtaccgttttcccgggacccgttaggggtaaaccgtaacgggtcggtaaccttacgtaaccgaaacggtaccgttagggtcggtaccgttacggacctaccgtattcccg

SEQ ID NO: 179061 - DNA, 720 bp, Homo sapiens
  misc_feature: GYAE6OF02F30SN.3.6.A06.1.454.CMB.1.raw
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (677)..(677): a, c, t, g, unknown or other
  misc_feature (677)..(677): n is a, c, g, or t
tcagagacgcactccacgaccggtgctcgatttagatctactgacaacacacgaagggggagtcagtctcagtcaggacacagcatggacatgacgggtccccgctcagctccgtggggctcctgctactcgtggctccgaggtcgccagatgtagacactccgagtatcgaccctagtcctaccactcccgtccctgtctgccatccgtaggtacgggganagacgtccacctacacctacgttcggacccgganaacggtcagtaagttatagacgtaagttaacgtttaaagttggtaacgtactaacgaaaccgtaaaaaccgtacggggtaaaaccgtaaccccctttaaagttttacggtaacttacgttaacgtacggtcctacgtacgtaacttccgttaggtttacgaccggtaaagggttccgggttaccacggttactaaacgggttacgaagtcggtacgtaggtacgttcgtacggtagggaccttagtacgtttaaccaccgttacctactaactgtactacggtactacggttactaaccgtaacggcttaaggtattcgtttacaccgtttaatacgtccttaagaaccctagtaaccggtattaccggttagttacttcgttactttcctacgttcgccgttacggaacgtagtaacggntaacctacgaagttacgtaggcggcttagaacccgtatcgttc

SEQ ID NO: 179062 - DNA, 788 bp, Homo sapiens
  misc_feature: GYAE6OF02GRM7E.3.6.A06.1.454.CMB.1.raw
tcagagacgcactccacgaccggtgctcgatttagatctactgacaacacacgaaggggggagtcagtctcagtcaggacacagcatggacatggagggtccccgctcagctccgtggggctcctgctactcgtggctccggaggtgccagatgtagacactccaagtactacgaccctagtcctaccacttcccttcccgtgtacctgactacttcgtagggtacggggaactagacgtaccacctatcgtacgttacggaccgggtactaacgtacgaagtagttaacgttaggacgtaaaggttaaacttttaaagttaggttaacgtacgaaacgaaaccgtaaaaaaccggaacgggtaaaaccgtaacccgtttaaagtttacggaacttacgtacgtacgtactacggactacgtaccgttaaggttacgtaacggtaaagggtccggtacctaagtacgtaagttaacaagtacggacgtaggtacgtacgtacggtacgactacgttacttccgtaacttccgaactacgtacgtacgaccgtcgtaacgtaccgtacgaactacgtaagtaagtttacttaaccgaactttaacgttaacacgttaaccgaaataacgtaacggttacttaacggtaacgtttaaggtttacgttaacgttcctttaacgggtaccccggttaaccgggttaacggtaaacccgttaagggtaacaaccgttaacggtaaacgttaaacggttgaccgggtctaccgataaccgttacctggtaaccg

SEQ ID NO: 179063 - DNA, 494 bp, Homo sapiens
  misc_feature: GYAE6OF01ETWTA.15.83.H06.1.454.CMB.1.raw
  modified_base (417)..(417): a, c, t, g, unknown or other
  misc_feature (417)..(417): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccaggaaagcccctaaagctcctgatctatggtgcatccagtttgcaaagtgggccccatcaaggttcagtggcagtggctctgggacagatttcactctcaccatcagcagtctccaacctgaagattttgctaacttactactgtcaacngagtttcagtagtccccggattcggccaagggaccaaggtcggacagtcaaacgaactgtggctgcacatctgtctc

SEQ ID NO: 179064 - DNA, 511 bp, Homo sapiens
  misc_feature: GYAE6OF01D9ZFV.15.83.H06.1.454.CMB.1.raw
  modified_base (220)..(220): a, c, t, g, unknown or other
  misc_feature (220)..(220): n is a, c, g, or t
tcagtctacgtagccacgaccggtgctcgatttagatcacgtgcgtcgcggggcaggagtcagtctcagtcaggacacagcatggacatgaggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattatttaaattggtatcagcagaaaccaggaaagcccctaagctcctgatctatggtgcatccagtttgcaaagtgggccccatcaaggttcagtggcagtggctctgggacagatttcactctcaccatcagcagtctaccaacctgaatattttgctaacttactacttgtacaacagagtttacagttacgtccccggtacgttcggccgtaacgggaccaaggtggacgagtacaaacgactgcggtctcgcaccatacttgtcttacc

SEQ ID NO: 179065 - DNA, 499 bp, Homo sapiens
  misc_feature: GYAE6OF01DH7FS.15.83.H06.1.454.CMB.1.raw
  modified_base (368)..(368): a, c, t, g, unknown or other
  misc_feature (368)..(368): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaatgtatcagcagaaacaggaagcccctaagctcctgatctatggtgcatccagtttgcaaagtgggcccatcaaggttcagtggcagtggctcgtgggacagatttcactctcaccatcancagtctccaacctgaagattttgctaacttactactgtacaacatagtttcagtacgtcccggtacgttggccgtaacggaccaggaggacagtacaacgaactagtacggctagtcaccatctgtcttac

SEQ ID NO: 179066 - DNA, 514 bp, Homo sapiens
  misc_feature: GYAE6OF01BFE5N.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtgggcccatcaaggttcagtgcagtgctctgggacagatttcactctcaccatcagcagtctaccaacctgaatattttgactaacttactactgtcaacagtacgtttcagttacgtccccggtacgttccggaccaacgggaccaaggtcggaacagtacgaaacgaacgtcgtaggctgccaccatcttgtcttac

SEQ ID NO: 179067 - DNA, 517 bp, Homo sapiens
  misc_feature: GYAE6OF01B4JJW.15.83.H06.1.454.CMB.1.raw
  modified_base (497)..(497): a, c, t, g, unknown or other
  misc_feature (497)..(497): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtgggccccatcaaggttcagtggcagtggctctgggacagatttcactctcaccatcagcagtctccaacctgaagtattttgctaacttactactgtcaactagtagtttcgagttacggtccccggtacgttcggaccgaacgggtaccgaaggtcggaacgacgtacgaaacgaactgnggctgcaccatctgtcttac

SEQ ID NO: 179068 - DNA, 538 bp, Homo sapiens
  misc_feature: GYAE6OF01CF5S2.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaatggtatcagcagaaaccagggaaagcccctaagctcctgatctatggtgcatccagtttgacaaaggtcgggcccatcaaaggttcagtggcagtggctgtgggacagtatttcactctcaccatcagcagtctaccaaccgtgaagtattttgactaactttactaacttgtacctaacagtaacgtttcaacgttaccgtccccggtacgttccggaccaacgggaccgtaagggtacggaacacgtaccgaaacgaactgtacggtctgctaccatctgtcttacc

SEQ ID NO: 179069 - DNA, 554 bp, Homo sapiens
  misc_feature: GYAE6OF01CDF5J.15.83.H06.1.454.CMB.1.raw
  modified_base (271)..(271): a, c, t, g, unknown or other
  misc_feature (271)..(271): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattattaatgtatcagcagaaaccagggaacnccctaagctcctgatctatggtgcatcctagtttgacgaaaggtcgggacccagtcgaaggttcaggtggcaggtggctcgtgggactagtatttcacttcacacatcagcagtcctaccaactgaacgtattttgactaactttacgtacttgtaccaacgtgtaacgtttacgaacgttaccgtccccggtagttccggaccgaacgggtaccgtaaggtacggaactacgtacgaaacgaacgtcggtacggtctcgacctaccagttctgtccttaccg

SEQ ID NO: 179070 - DNA, 562 bp, Homo sapiens
  misc_feature: GYAE6OF01CFWNF.15.83.H06.1.454.CMB.1.raw
  modified_base (197)..(197): a, c, t, g, unknown or other
  misc_feature (197)..(197): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccgtcaagtcagaacatagattattaatgtatnagcagaaaccaggaaagccctaagctcctgatctatggtncatccagtttgcaaaggtgggacccatcaaggttcagtgcagtggctcgtgggacagatttcgactctcacatcagcagtctcaactgaactattttgactaacttactactgtacaacgtagtaagtttcaacggttacgttcccccggaacgtttcggacccgtaaacgggaaccgtaacgggtacggtaactaacgtaccgtaaaacgaaacgttacggtacgggtaccttcggacctaaccctaagttacccttggttacctttacccg

SEQ ID NO: 179071 - DNA, 509 bp, Homo sapiens
  misc_feature: GYAE6OF01ACV0L.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattattaaatggtatcagcagaaaccaggaaagcccctaagctcctgatctatggtgcatccagtttgcaaaggtgggccccatcaaggttcagtggcagtggctcgtgggacagatttcactctcaccatcagcagtctccaacctgaagtattttgactaacttactactgtacaactagtagtttacagttacgtccccggtagttcggacgaacgggaccaaggtggacagtacaaacgaactgtaggctcgcacatctgtcttac

SEQ ID NO: 179072 - DNA, 523 bp, Homo sapiens
  misc_feature: GYAE6OF01CENBG.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaagttcagtggcagtggctcgtgggacagatttcactctcaccatcagcagtctccaactgaagtatttgacctaacttactactgtacaactagagtttcagttacgtccccggagttccggaccgtaacgggaccaacggtcggaacgacgtacgaaacgaacgtgtacggtctacgcaccatctgtcttaccg

SEQ ID NO: 179073 - DNA, 748 bp, Homo sapiens
  misc_feature: GYAE6OF01D99TV.15.83.H06.1.454.CMB.1.raw
  modified_base (219)..(219): a, c, t, g, unknown or other
  misc_feature (219)..(219): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcacatcacttgccgtnaagtcagaacattagaattattaaattgtatcagacagaaaccgaggaacgacccctaagctcctgatctatggtgctatcctagtttcgacgtaaaggtccggggacccctagtaccgtaaagggtttcgaaggttggacgtaggtcgggtccgttcggtacggggaacctaaggtacttttaccgaaccttccgtaccaacccgtattccgaacgtacctaacggttaccctacccgaaaccgtttacggtaaacggtttacttttttacgaaccttaaaaccgtttaccttaacgtttacgtaacctaaaccgtaggttaacgttttacccgtaacggtttacccgggttacccccgggtaacggtttaccccgggtaacccgtaaaccgggggtaacccgtaaacggggttaaccggtaaaccgtaacgttaaacccggaaaaacggttaaccggttacggtaccgggtaccgttaccggtacctaacccgttaacctttaccgttacgttcccgtttaaccccg

SEQ ID NO: 179074 - DNA, 540 bp, Homo sapiens
  misc_feature: GYAE6OF01A631J.15.83.H06.1.454.CMB.1.raw
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggaaccaaatgtgacatccagatgacccagtctccatcctccctgtctgcatctgtaggagacagaatcaccatcacttgccggtcaagtcagacattagaattattaaattggtatcagcagaaaccagggaaagcccctaagctacctgatctatggtgcatccagtttgcaaagtgggccccatcaaggttcagtggcagtgctctgggacagtatttcactctcaccntcagcagtcctccaacctgaacgtnttttgacctaactttaccgtacttgtaccaactagtagttttaccaggttacgtccccggtagtttccggaccgaacgggaccaagggtggacctataccgaaacgtacgtggtcggctacgcctaccattctcgttcgttctaccg

SEQ ID NO: 179075 - DNA, 515 bp, Homo sapiens
  misc_feature: GYAE6OF01AX4ZY.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattatttaaattggtatcagcagaaaccagggaaagcccctaagctcctgatctatggtgcatccagtttgcaaagtggggccccatcaaggttcagtggcagtggctctgggacaggatttcactctcaccatcagcacgtctccaacctgaagtattttcgactaacttactactgtacaacagtagtttcagtacgtcccggtacgttcggacccgtaaggaccgaaggtcggaacagtcgaaacgaactgagcgtcgctacatctgtcttac

SEQ ID NO: 179076 - DNA, 528 bp, Homo sapiens
  misc_feature: GYAE6OF01DNBRW.15.83.H06.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (350)..(350): a, c, t, g, unknown or other
  misc_feature (350)..(350): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtnaagtcagaacattaggaattatttaaattggtatcagcagaaaccagggaaacncccctaagctcctgatctatggtgcatcctagtttgcaaaggtcgggcccatcaaggttcagtggcagtgctcngggacagatttcactctcaccatcagcagtctaccaacctgaagtattttgactaactttacctactcgtacaacagtagtttcagttacgccccggtacgttcggccgaagggaccgtaaggtcgacgaagtacgaaacgaactcggtacggctacgaccaccagtctgtcttaccg

SEQ ID NO: 179077 - DNA, 526 bp, Homo sapiens
  misc_feature: GYAE6OF01CNTXZ.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattattaaattggtatcagcagaaaccagggaaagcccctaagctcctgatctatggtgcatccagtttgcaaagtcgggcccatcaaggttcagtggcagtggctcgtgggacagatttcactctcaccatcagcagtctaccaacctgaagtattttgctaactttactacttgtactaacaagtacgtttcaagttacgtccccggtacgttcggtaccgaacgggaccgtaacggtacggacagtaacaaacgaacgtgtagctcgacacatcttgtcttacc

SEQ ID NO: 179078 - DNA, 516 bp, Homo sapiens
  misc_feature: GYAE6OF01DZBOV.15.83.H06.1.454.CMB.1.raw
  modified_base (221)..(221): a, c, t, g, unknown or other
  misc_feature (221)..(221): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccggtnaagtcagaacattaggaattattaaattggtatcagcagaaaccagggaaagcccctaagctcctgatctatggtgcatccagtttgacaagtgggcccatcaaggttcagtgcagtgctcgtgggacagatttcactctcacctatcagcagtctacaacctagaatatttgactaacttactactgtacaactagtacgtttcagttacgtccccggtagttaccggacgaacgggaccgaaggtacgacgacgtacgaaacgaacgtgtacggctgacacatctgtcttacg

SEQ ID NO: 179079 - DNA, 566 bp, Homo sapiens
  misc_feature: GYAE6OF01CRW64.15.83.H06.1.454.CMB.1.raw
  modified_base (220)..(220): a, c, t, g, unknown or other
  misc_feature (220)..(220): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcacatcacttgccgtnaagtcagaacatagaattattaaatgtatcagacagaaaccaggaaagaccctaagctacctgatctatggtgcatccagtttgacaaaggtcgggaccccatacgaaaggttcaggtcggactaggtggctcgtagggactaaggtatttacacttcacaaccatcagctagtacctaccaaactgaaagtattttagactaacttactactgtaacaacagtagtttacaaggtacgtaccccgggagttacgaccgtaaacgggaccgaagggtacgggaacaacgtaacgaaacgaacgtaggtacgtcgttacgtaccgactaactctacggtcttacccg

SEQ ID NO: 179080 - DNA, 510 bp, Homo sapiens
  misc_feature: GYAE6OF01DXCXQ.15.83.H06.1.454.CMB.1.raw
  modified_base (341)..(341): a, c, t, g, unknown or other
  misc_feature (341)..(341): n is a, c, g, or t
  modified_base (489)..(489): a, c, t, g, unknown or other
  misc_feature (489)..(489): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattattaaattggtatcagcagaaaccaggaaagcccctaagctcctgatctatggtgcatccagtttgcaaagtgggcccatcaagttcagtgcagtgctntggacagatttcactctcaccatcagcagtctccaacctgaagtattttgactaacttactactgtcaacagtagttcagtacgtccccggacgtcggaccgtaacggaccgaaggtacggaacgacgtacaaacgaactacgtaggntcgacgaccatctagtcttac

SEQ ID NO: 179081 - DNA, 575 bp, Homo sapiens
  misc_feature: GYAE6OF01BATL5.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattatttaaattggtatcagcagaaacaggaaagcccctaagctcctgatctatggtgcatcctagtttgctaaagtcgggcccatcaaggttcagtgcagtggctcgtgggacagtatttcgactctcaccatcagcagtcctccaaccgtgaagtatttgactaacttactacttcgtaccaacgtagtacgtttcagttaccggttaccccggtacgtttccggaccgtaaacgggaccgaaacgggttcggaaaccgtacgtaaccgtaaaaccggaacgttcggtacgggacgttacggtaccgtaacccagttccttcggttccttaccg

SEQ ID NO: 179082 - DNA, 517 bp, Homo sapiens
  misc_feature: GYAE6OF01EGDKM.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgactcagtctccatcctccctgtctgcatctgtaggagacagaatcaccatcacttgccggtnaagtcagaacattaggaattatttaaattggtatcagcagaaaccagggaaagcccctaagctcctgatctatggtgcatccagtttgcaaagtgggccccatcaaggttcagtggcagtggctcgtgggacagatttcactctcaccatcagcagtctccaacctgaagtattttgactaactttactactgtacaacagtagtttcaggttacgtccccggagttccggaccgaacgggaccaagggtaggacgagtacaaacgacgtagtggctcgacaccactcgtgttcc

SEQ ID NO: 179083 - DNA, 515 bp, Homo sapiens
  misc_feature: GYAE6OF01B40BG.15.83.H06.1.454.CMB.1.raw
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
tcagtctacgtagccacgaccggtgctcgatttagatcacgtgcgtcgcgggggcaggagtcagtctcagtcaggacacagcatggacatgagggtcccccgctcagctcctggggctcctgctactctggctccgaggagccaaatgtgacatccagatgacccagtctccatcctccctgtctgcatctgtaggagacagaatcaccatcacttgccggtcaagtcagaacattagaattattaaatgtatcagnagaaccaggaanccctaagctcctgatctatggtgcatccagtttgacaaaggtcgggccccatcgaaaggttcaggtggcaggtggctcgtgggacagtattcactctcaccatcagcagtctaccaacctgaagtatttgactaacttactacttgtacaacagtaagtttcaagtacgtcccggacgttcggaccgaacggacgaacgtaggacaagtacaaagaactcgtagcgtgaccacatctgtcgttacc

SEQ ID NO: 179084 - DNA, 677 bp, Homo sapiens
  misc_feature: GYAE6OF01DELI4.15.83.H06.1.454.CMB.1.raw
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaactattaggaatttatttaatgtatnagcagaaacaggaacgacccctaagctcctgactctagtggtnctatcctagtttacgactaaaggtcgggacccagtaccgtaaggttcaggtcggcgtaggtcggctcgtagggactaggtactttaccacttccgtaccaacctatacgagctacgttccctacccaaaccgttgtaaacgtactttttacgaacttaaacctttaccttacttacgtaacctaacgttacgttaacgttttaccgtaacgggttacccggttacccccgggttaccgtttaccgggacccgtaaacggggtaacccgtaaggggtaccgggtaacctaaccggttaaaccgtaaaaccgggtaaccgttcgggttaccgggtcgtaccggtacctaacccgtattcccgttacgttccgtttacccg

SEQ ID NO: 179085 - DNA, 570 bp, Homo sapiens
  misc_feature: GYAE6OF01BOSJ4.15.83.H06.1.454.CMB.1.raw
  modified_base (221)..(221): a, c, t, g, unknown or other
  misc_feature (221)..(221): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtnagtcagaacattagaattatttaaattgtatcagcagaaaccaggaacgcccctaagctcctgatctatggtgcatcctagtttgacaaagtcgggacccagtcaaggttcagtcggcagtggctcgtcgggacagtatttcacttctacacctatcagctacgtacctaccaaccttgaagttactttacgactaaactttactaacttgtacaacgtagtaacgtttacgaacggttaccgtcccggtacgttccggaccgtaacgggaccgtaagggtacggaacgtacgtaacgaaacgtaacgtcgtacggctacggtaccacctacgtcttggttccttaccg

SEQ ID NO: 179086 - DNA, 596 bp, Homo sapiens
  misc_feature: GYAE6OF01BQ8UJ.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcgaaaaggtcgggaccccagtacaaggttcaggtggcagtggctcgtgggacagtattcactctacacctatcagcagtcctaccaaactgaagtattttagactaaacttactactagtacaacgtagtacgtttacgaagttaccggttacccccgggtacgtttccgggaccgtaaacggggaacccgtaaacgggtacggtaaacgacgtaaccgtaaaaccgtaacgttacggacggtacttacgggacctaaccgtaattccttcgttccgtttaacccg

SEQ ID NO: 179087 - DNA, 550 bp, Homo sapiens
  misc_feature: GYAE6OF01A9GRV.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattatttaaattggtatcagcagaaaccagggaaagcccctaagctcctgatctatggtgcatccagtttgcaaaggtgggccccatcaaggttcagtggcagtggctcgtgggacaggtactttcgactctccaccatcagcacgtcctaccaacctgaagtattttagctaacttactactgtacaacgtagtagtttacagttacggtaccccggtacggttaccggccgaaacggggaccctaagggtacggaccgtaacgtacgaaacgacgtggtacggctcggtccactaactctcgtcttccg

SEQ ID NO: 179088 - DNA, 594 bp, Homo sapiens
  misc_feature: GYAE6OF01EC6OZ.15.83.H06.1.454.CMB.1.raw
  modified_base (278)..(278): a, c, t, g, unknown or other
  misc_feature (278)..(278): n is a, c, g, or t
tcagtctacgtagccacgaccggtgctcgatttagatcacgtgcgtcggcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcaagaaaccagggaaacncccctaagctcctgatctatcggtgcatcctagtttgactaaaggtcgggaccccagtaccgaaggttcaggtggcgtaggtggctcgtgggactagtatttcacttctcacctatcagcagtcctaccaacgtgtaagtacttttgacctaacttactactgtacaacgtagtacgtttacgacgttaaccggttccccggtacgttccgggaccgtaacggggtaaccaagggtaccggaacctaacgtaacccgaaagtaaccggttcggtacgggtacgtacgtacctaacctacttcgttcgttcttaccg

SEQ ID NO: 179089 - DNA, 560 bp, Homo sapiens
  misc_feature: GYAE6OF01CRKVR.15.83.H06.1.454.CMB.1.raw
  modified_base (410)..(410): a, c, t, g, unknown or other
  misc_feature (410)..(410): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtcaagtcagaacattagaattattaatgtatcagacagaacaggaaacgccctaagctcctgactctatggtgcatcctagtttgacgtaaaggtcgggacccagtacgtaaggttcaaggtggctaggtcggctcgtagggactagtactttcactctcactatcagcagtcctacaaccgtgaacgttntttacgacctaactttactactgtaccaacgtagtacgtttacgacgttaccgtccccggtagttaccggaccgtaacgggacgaacggtcggaacgacgtaaccgaaacggtaactcggtaggcctacgacctacatcttgtcttaccg

SEQ ID NO: 179090 - DNA, 531 bp, Homo sapiens
  misc_feature: GYAE6OF01EQGSI.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaattggtatcagcagaaaccaggaaagcccctaagctcctgatctatggtgcatccagtttgactaaaggtcggggccccatcgaaggttcagtggcagtggctcgtgggacagatttcactctcacctatcagcagtcctaccaactgaagtattttcgactaacttactactgtacaactagtagtttacagttacgtaccccggtacgttcggaccgaagggacctaagggtacggaactagtaccgaaacgaactgtacggctgaccaccatctgtcttac

SEQ ID NO: 179091 - DNA, 500 bp, Homo sapiens
  misc_feature: GYAE6OF01CM6E7.15.83.H06.1.454.CMB.1.raw
  modified_base (345)..(345): a, c, t, g, unknown or other
  misc_feature (345)..(345): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaatggtatcagcagaaaccagggaaagcccctaagctcctgatctatggtgcatccagtttgcaaagtgggccccatcaaggttcagtgcagtgctcnggacagatttcactctcacatcagcagtctccaacctgaagattttgcaacttactaactgtacaacagtagtttcagttacgtccccggtacgttcggcctaagggaccaaggtacggacacgtcaaacgaactgtgctgcacatctgtcttac

SEQ ID NO: 179092 - DNA, 583 bp, Homo sapiens
  misc_feature: GYAE6OF01BM8RC.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattattaaattggtatcagcagaaaccaggaaacgcccctaagctcctgatctatggtgcatcctagtttcgacgtaaaaggtcggggacccctaagtactaaacgggtttcaagggttggactagggttcgggcttcgtaggggaactaggtactttcgactcctacacctatacacgtactacgtacctacctaaacctagtaagtattttacgactaacttactactcgtacaacagtagtttacacgttacgtcccggtacgttcggaccgaacgggaccgaacggtacggaacgacgtacgtaaacgaacgtggtggctcgaccactatctgtcgttac

SEQ ID NO: 179093 - DNA, 536 bp, Homo sapiens
  misc_feature: GYAE6OF01DICCV.15.83.H06.1.454.CMB.1.raw
  modified_base (222)..(222): a, c, t, g, unknown or other
  misc_feature (222)..(222): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagacattaggaattattaattggtatcagcagaaacaggaaagcccctaagctcctgatctatggtgcatccagtttgacaaagtcgggacccatacgaaggttcagtggcagtggctcgtgggacagatttcactcncacgactcngtacagttcctaccaacctgaacgtattttacgacctaacttactactcgtacaacaagtacgtttcagttacgtccccggtagttcggaccgaagggaccgaacggtggaacacgtacgaaacgtaactgtacgcgtacgctaccattctgttccttaccg

SEQ ID NO: 179094 - DNA, 526 bp, Homo sapiens
  misc_feature: GYAE6OF01DWLVT.15.83.H06.1.454.CMB.1.raw
  modified_base (503)..(503): a, c, t, g, unknown or other
  misc_feature (503)..(503): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccaggaagcccctaagctcctgatctatggtgcatccagtttgcaaaaggttcggggacccagtcaaggttcagtggcagtggctctgggacagtatttcactctcacatcagcagtctccaactgaagtattttgactaacttactactgtacaacagtagtttacagttacgtacccggtacgttcggaccgaacggaccgaaggtcggaacacgtacaaacgaactcgtaggtcncgtaccaacatctgttcgttacc

SEQ ID NO: 179095 - DNA, 662 bp, Homo sapiens
  misc_feature: GYAE6OF01DW38P.15.83.H06.1.454.CMB.1.raw
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatctgtaggagacagaatcaccatcacttcgccggtanaagtcagaactattagtaatttattaattgtatacagacaagaaccgaggaaacnccctaagctcctagatctagtggtgtcactccgtagtttacgacgtaaacggtccgggaccctagtacgtaacggttacgaggtcggacgtaggtcggtctcgtagggactaggtactttaccacttcctacacctagtaccgacgtaccgtaacgttccctaaccgtaaccgtaagtaacgtttacgttttacgaacctttaacttacttaaccgtacgttaaccgaacgtaggttaactttacgaacgttaccggttaccccgggtacgttacggacccgaagggaaccgtaacggtacggtaaccgtacgtaaccgtaaacgtacggtacggtacggtacgtacgtacccgtaactacgttccttcgttccgttacccg

SEQ ID NO: 179096 - DNA, 521 bp, Homo sapiens
  misc_feature: GYAE6OF01D0G7L.15.83.H06.1.454.CMB.1.raw
  modified_base (220)..(220): a, c, t, g, unknown or other
  misc_feature (220)..(220): n is a, c, g, or t
  modified_base (271)..(271): a, c, t, g, unknown or other
  misc_feature (271)..(271): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccgtnaagtcagaacattaggaattatttaaattggtatcagcagaaaccaggaancccctaagctcctgatctatggtgcatccagtttgcaaagtggggccccatcaaggttcagttggcagtggctcgtgggacaggatttcacttctcaccatcagcagtctaccaactgaagtattttgactaacttactactgtacaacagtatttcgagttacgtccccggacgttccgaccgaacggaccgaaggtcggacgagtacgaaacgaactgtacggcgtcgactaccatctgttcgttacc

SEQ ID NO: 179097 - DNA, 623 bp, Homo sapiens
  misc_feature: GYAE6OF01EOKWR.15.83.H06.1.454.CMB.1.raw
  modified_base (225)..(225): a, c, t, g, unknown or other
  misc_feature (225)..(225): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtcctccatccctcctgtctgcatctggtaggagacagaatcacatcacttcgccgtanaagtcagaactattaagaatttaattaaatggtatcagacaagaaacgaggaaacaccctaagcctctgactctagtggtcactactcgtagtttacgacgtaaacgggtccgggaccctagtacgaacggttcaggtgacgtgtcggctgtaggactagtacttcnctcncacatcanctacgtctaacctactagtaacgttntttacgactaacttactacttacgaactaactaggttactttacgaacggttacccggttacccggtacggttaccggaaccggtaaacgggtaaccggtaacgggttacgaaccgtaacgtaaccggtaaaagacgttacggacggtaccgtacccgtacgtaaccgtacgttaccgttcgttccgttaccg

SEQ ID NO: 179098 - DNA, 541 bp, Homo sapiens
  misc_feature: GYAE6OF01CFVME.15.83.H06.1.454.CMB.1.raw
  modified_base (221)..(221): a, c, t, g, unknown or other
  misc_feature (221)..(221): n is a, c, g, or t
  modified_base (386)..(386): a, c, t, g, unknown or other
  misc_feature (386)..(386): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcactttccggnaagtcagacattagaattatttaaattggtatcagacaagaaaccgagggaaacgacccctaagcctcctgatctatggtcgcatcctagtttgactaaggtcgggaccctagtcgaagttcagtggcgtagtcgctcgtggacagtatttcactctcacatcancacgtctaccaacctagtaacgtatttgactaacttactactgtacaactagttagttacagttaccgtcccaggtacgtcggacgaacggtacaagggtcgaactagtaccgaaacgtactggtacgcttacgaccactattcgtgtcttaccg

SEQ ID NO: 179099 - DNA, 670 bp, Homo sapiens
  misc_feature: GYAE6OF01CXMPR.15.83.H06.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattagaattattaatgtatnagcagaaacaggaaacnccctaagctcctgatctatggtgcatcctagtttgacgaaaggtcggggacccctaagtaccgtaaaggttcgaaggttcgggacctaaggttcggtcttcggttaggggaacctaaggtacttttaccacttaccttaccaacctacttaccgaacgacctacggttaccctaaccctaaaccgttaggaaacgtttactttttacgaacccttaaactttaaccgttaacgttgtaaccaaacttaacggtaacgtttccgaacggttaccggttaccccccgggtagttacccggaccggtaaacggggaccgtaaacgggtacggaactaacgtaaccgaaacgtaacgtcggtacggtacgttacgacccgtaacctattaccgtgttccttaccg

SEQ ID NO: 179100 - DNA, 552 bp, Homo sapiens
  misc_feature: GYAE6OF01CXINX.15.83.H06.1.454.CMB.1.raw
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (403)..(403): a, c, t, g, unknown or other
  misc_feature (403)..(403): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatcngtaggagacagaatcaaccatcacttgccggtnaagtcagaacattaggaattatttaaattggtatcagcagaaaccaggaagcccctaagctacctgatctataggtgcatcctagtttgacaaaggtcgggcccagtcaaggttcaggtggcagtggctcgtgggacagtattcgactctacaccatacagcacgtctaccaactgaatnttttagacctaacttactactgtactaactagtactttagacgtacggtcccggtacgttccggaccgaaagggaccgtaaggtacggacgacgtaaccaaaggtaactaggtacggtcgtagaccctaacagttacctgtctttaacg

SEQ ID NO: 179101 - DNA, 656 bp, Homo sapiens
  misc_feature: GYAE6OF01DPTVI.15.83.H06.1.454.CMB.1.raw
  modified_base (222)..(222): a, c, t, g, unknown or other
  misc_feature (222)..(222): n is a, c, g, or t
  modified_base (273)..(273): a, c, t, g, unknown or other
  misc_feature (273)..(273): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtcctccatcctccctgtctgcatctgtaggagacagaatcaccatcacttgccgtnaagtcagaacattaggaatttattaaattggtatcagcaagaacaggaacnccctaagcctctgatctagtggtgcatcctagtttcgacgaaaggtcgggacccagtacgaaggttcaggtcggactaggtcggctcggtagggactaggttactttccgaactcctaccacctagtccgaacgtcgttaacgtaccctaccgtaaaccgttagtaacgtttattttacggaacccttaaactttaaccgttacttacgtaaccaaccttaaggttaccgtttccgaacgggttacccggttacccccggggtacgtttaccgggacccgtaaacggggaaccgtacggtacggaaacctacgtaaccgaaacggttaacgtcggtacggtaccgttacgaccgtaactacgttacgttcgttccgttacccg

SEQ ID NO: 179102 - DNA, 532 bp, Homo sapiens
  misc_feature: GYAE6OF01E0ADS.15.83.H06.1.454.CMB.1.raw
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagagacagaatcaccatcacttgccgtcaagtcagaactattaggaattatttaaatggtatcagcagaaacaggaacacccctaagctcctgatctatggtncatccagtttgacgtaaaggtcgggcccagtcaaggttcagtggactagtggcgtcgtgggactagtacttcactctcacctatcancatcctacaactgaagtntttcgactaacttctactgtacaactagtagttacgagttaccggtcccgtacggttcgaccgaacggaccgaagggtcgaaccagtaccgaaacgtacgtgtcggcttacgacctactatcttcgttctcg

SEQ ID NO: 179103 - DNA, 722 bp, Homo sapiens
  misc_feature: GYAE6OF01C29C6.15.83.H06.1.454.CMB.1.raw
tcagtctacgtagccacgaccggtgctcgatttagatcacgtgcgtcgcgggggcaggagtcagtctcagtcaggacacagcatggacatgagggtcccccgctcagctcctggggctcctgctactctggctccgaggagccaaatgtgacatccagatcgacccagtcctccactccctccctgtctgcatcgtgtaggagacagaatccaccatcacttcgccggtacaagtcaagaactaagttaaggtaaattttaatttaaagtggttaatcaagtacaagaaaccggagggaaacctccccgtaagccttccgtagtactacgtagtggtacgcctaacgttccgtaagggtttacgaaccgtaaaacggggtcccgggtaacccctaagttaccggtaaaggtttccgaagggtcggtaccgtaagggtcgggtaccgttacgggtacgggaaactacggtttattaccctaaccttccgtacaacccgtattaccggacgtaccgtacgttccctaacccgtaaacgttagtaaccgtttattacgaccttaaacgtttacacttaggaaccaaacgttgtacgtttcggaacgtaccgggttccccgtaagttccggaaccggaaacggtaacggtaggtaccggaactaagtaaacccggtaagtaacgtcggtacggtccttacggacctactagttcctgtaccttccg

SEQ ID NO: 179104 - DNA, 541 bp, Homo sapiens
  misc_feature: GYAE6OF01EF3PV.15.83.H06.1.454.CMB.1.raw
  modified_base (197)..(197): a, c, t, g, unknown or other
  misc_feature (197)..(197): n is a, c, g, or t
  modified_base (522)..(522): a, c, t, g, unknown or other
  misc_feature (522)..(522): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtcaagtcagaacattaggaattatttaaattggtatcagcagaaaccagggaaacgcccctaagctcctgatctatggtgcatcctagtttcgacgtaaaggtcgggaccccagtacgtaaggttcagtggcaggtcggctcgtgggacagtatttcacttctcacatcagctacgtcctacctaacgtagaagttactttacgacctaacttactactagtacaacgtagtacgtttcacggttaccgtcccgggtagttccgaccgaacggaccgaggtagactacgtacaacgatgcgntacgcactatctgtctacg

SEQ ID NO: 179105 - DNA, 572 bp, Homo sapiens
  misc_feature: GYAE6OF01D0OIC.15.83.H06.1.454.CMB.1.raw
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (467)..(467): a, c, t, g, unknown or other
  misc_feature (467)..(467): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatctgtaggagacagaactcaccatcacttggccggtcaagtcagacattagattattaattggtatcancaagaaaccaaggaaacgcccctaagctacctgactactntggtgcatcctagtttgcgtaaacggtcgggacccctaagtactaaacggttcaaggttcggcgtaggtggtcctacgtgggaactagtacttttacaccttcgttaccacctataccgagactacgttcctacccaactgaagttatttcgactaacttactatcgtanaactagtagtttacgagttaccgtcccggtagttccggacgaacggaccgtaaggacgatacgaaccgtaagtcgtagcgtcgagccaacattcgtgttctaccg

SEQ ID NO: 179106 - DNA, 737 bp, Homo sapiens
  misc_feature: GYAE6OF01CF0EU.15.83.H06.1.454.CMB.1.raw
  modified_base (223)..(223): a, c, t, g, unknown or other
  misc_feature (223)..(223): n is a, c, g, or t
tcagtctacgtagccacgaccggtgctcgatttagatcacgtgcgtcgcgggggcaggagtcagtctcagtcaggacacagcatggacatgagggtcccccgctcagctcctggggctcctgctactctggctccgaggagccaaatgtgacatccagatgacccagtctccatccctccctgtctgcatctgtaggagacagaatcacatcacttgccgtanaagtcagacattagtaattaatttaatgtatcagacaagaaaccaggaacgacccctaagctcctagatctagtggtgcatcctagtttgacgtaacggtcgggacccctaatacgtaaggttcgaggtcggacgtaggtcggcgtcgtagggaactagtactttcacttctaccacctatcaacgtctaacgttacctaccctaaaccgtaggtaacgtttacgttttacgtaacctttaaacctttaccttaaccgttagtaaccgtaacgttaacgttaaccggttttaccgtaaacggtttacccgggttaccccccggggttaacggtttaccccggggtaaccggtaaaaccggggtaacccgggtaaacgggttaccgggtaaaccgtaaaccggtaaacccggttaaaaaccggtaaccggttaccgggtaaccgggttaccgttacccgggtaacccttaacccggttaaccgtttaccgtttacccggtttccgtttaaccccg

SEQ ID NO: 179107 - DNA, 631 bp, Homo sapiens
  misc_feature: GYAE6OF01C3FK2.15.83.H06.1.454.CMB.1.raw
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcactgccgtcaagtcaagaacattaggaatttaatttaattggtaatnagacagaaacagggaacnccctaagctcctgatctatggtnctatcagtttgacgaaaggtcgggacccatacgaaggttcaggtgcagtcggctgtgggacagtactttcacgttctaccacatcagctagtcctaccaaaccgttgtaacgttagttttacgaccttaactttaacctaacgttgtacaaacgtagttacgttttaccgaacgggtttaccgtacccccgggtacgtttcccgggaaccggtaaaccggggaaccggtaaacgggtacggtaaaccgtaacgtaaacccgtaaaagggtaaccctcgggtaccgggtactaccgggtaccaacccgtaattccgttacgttccgtttaccc

SEQ ID NO: 179108 - DNA, 660 bp, Homo sapiens
  misc_feature: GYAE6OF01C0VHJ.15.83.H06.1.454.CMB.1.raw
  modified_base (285)..(285): a, c, t, g, unknown or other
  misc_feature (285)..(285): n is a, c, g, or t
  modified_base (309)..(309): a, c, t, g, unknown or other
  misc_feature (309)..(309): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgagagccaaatgtgacatccagatgacccagtctccatcctccctgtctgcatctgtaggagacagaatcaccatcacgttcgccggtacaagtcaagaactaattaggtaatttaatttaaattggtatcagacaagaaaccagggaacncccctaagctcctgatctagtgtnctatctagttcgacgtaagggtccgggaccctagtacgtaacggttacgaggtcggacgtaggtcggtcgttcggtagggactaacggttactttaccgtaccttcctacccgtaacctactacgacgtaccgtaacgttccctaacccgtaacgttacggtaacgtttacgtttttaccgaacctttaaacgtttacctaacgttacgtaacctaacgtacgtttacgttaccgtacgggttacccggtaccccggtagttacccggacgaacgggtaacctagggtacgaactacgtaaccgaaacgtacgttcggacgtactcgactacctagttctcgttcttaccg

SEQ ID NO: 179109 - DNA, 564 bp, Homo sapiens
  misc_feature: GYAE6OF01CSBY4.15.83.H06.1.454.CMB.1.raw
  modified_base (273)..(273): a, c, t, g, unknown or other
  misc_feature (273)..(273): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccaggaancccctaagctacctgatctatggtgcatccagtttgacaaaggtcgggcccatcaaggttcagtggcagtggctcgtgggacagtatttcactctcacatcagcagtctaccaacctgaagtattttgacctaactttactacttgtaccaactacgtacgtttacacgttacggttaccccggtacgtttccggaccgaaacgggtacccgaacgggtacggaccagtaaccgaaacgtaacgttcggtacggccttacggacctaacctatccgttgttcctttacccg

SEQ ID NO: 179110 - DNA, 680 bp, Homo sapiens
  misc_feature: GYAE6OF01D3UAW.15.83.H06.1.454.CMB.1.raw
  modified_base (190)..(190): a, c, t, g, unknown or other
  misc_feature (190)..(190): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatcngtaggagacagaatcaccatcacttgccgtcaagtcagacattagaattattaatggtatcagcagaaaccaggaaacnccctaagctctgatctatggtncatccagtttgacaaaggtcggcccatcaaggttcagtgntagtggctcgtagggactagtactttcaacttcgtacaacctactacgaagtctaacggtcctaaccctaaacccgttagtaaacgttactttttaccggaacccttaaaccgtttaaccgttaaccttacgttaacctaaacgtaacgttaacgtttttacccgaaacgggtttcccggttaacccccggggtacggttttacccgggaaccccggtaaacggggtaaacccgtaaaacggggtccggaaaaccgtaacgttaaaccgtaaaaccgtaacccggttaggtacccgggtacgttaacgggacccttaaacccgacgtttacgttcgttccctttaaccg

SEQ ID NO: 179111 - DNA, 535 bp, Homo sapiens
  misc_feature: GYAE6OF01EZ07F.15.83.H06.1.454.CMB.1.raw
  modified_base (265)..(265): a, c, t, g, unknown or other
  misc_feature (265)..(265): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcacatcacttgccgtcaagtcagaacattagaattattaatgtatcagcagaaacaggaanaccctaagctcctgatctatggtgcatccagtttgacgtaaaggtcgggaccccagtacgtaaggttcaggtggcaggtcggctcgtgggactagtatttcacttctacactatcagcagtctaccactagaatatttacgactaacttactacttacgtacaactagtacgttacgagttaccgtacccggtacgttcggaccgaacgggaccgtaacggtagacacgtacgaaacgacgtagtgacgtcgacacctatctgtcttacg

SEQ ID NO: 179112 - DNA, 611 bp, Homo sapiens
  misc_feature: GYAE6OF01AZ9DM.15.83.H06.1.454.CMB.1.raw
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatccaccatcacttgccggtnaagtcagaacattaggaattatttaaattggtatcagacagaaaccagggaacncccctaagctcctgatctatggtgcatcctagtttgacaaaggtcggggacccagtacaaggttcaggtggcgagtggctcgtgggactagtactttcacttctacaccgattcgagctacgtcctaccctaaaccgttagaagttattttacggaccttaaacctttaccttaacgtacgttaccaacgtaaggtagttttaccgaacgttaccgggtacccccggttacggtttaccgggaccgtaaacgggacccgtaaggggttacggaacacgttaaccgaaacgtaaccgtggtacggcttcgacccacctagtcttcgtctttaccg

SEQ ID NO: 179113 - DNA, 583 bp, Homo sapiens
  misc_feature: GYAE6OF01B7UZ8.15.83.H06.1.454.CMB.1.raw
  modified_base (221)..(221): a, c, t, g, unknown or other
  misc_feature (221)..(221): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtnaagtcagaacattagaattatttaaattggtatcagcagaaaccagggaaacgcccctaagctcctgatctatggtgactatccgtagtttgacgaaaggtcggggacccctagtacgaacggttcaggtcggacaggtggctcgtgggactaggtactttcactctacacctatcagcagtacctacctaacctagtaatattttgaccttaacttactactacgtaccaactagttaacgtttacgaacggttaccggttaccccggtacggttccggaccgaacgggtaacccgtaagggtacgacgaacgtaacgaaacgaacgtgtaccggagtacgtcaccattctgttccttacg

SEQ ID NO: 179114 - DNA, 710 bp, Homo sapiens
  misc_feature: GYAE6OF01DB5NY.15.83.H06.1.454.CMB.1.raw
  modified_base (201)..(201): a, c, t, g, unknown or other
  misc_feature (201)..(201): n is a, c, g, or t
  modified_base (692)..(692): a, c, t, g, unknown or other
  misc_feature (692)..(692): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagacaaatgtgacatccagatcgacccagtctccactccctccctgtctgcatcgtgtagganacagaatcaccatcacttggccgtacaagtcagaactaagttaaggtaatttaatttaaagttggtatacagtacaagaaaccgagggaacacccctaagcctaccgtagtactctagtgggcactacttacctagttacggacgaaacgggtccgggaccctagttacgtaaaggttacgaggttcggacgtaggtcggtcttacggacgggaacctaggttacttttaccgacgttccctaaccgtaaccctacgttaccgtaagacccgttacgttaccccgttaacccctaaaccggttaggttaatttaccgtttttacgaacctttaacctttaactacgttacggtaactaacgtagttacgtttaccgtacgggttacccggtacccgggtaccgttaccgggaccgtaaaggggtaacccgtaagggacgtacaacgtaaaccgtaaccggtaacggtcggtacggcctacgacctaacgtntaccgttcgttcttaccg

SEQ ID NO: 179115 - DNA, 691 bp, Homo sapiens
  misc_feature: GYAE6OF01D6MAF.15.83.H06.1.454.CMB.1.raw
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatcgtggtaggagacagaatccaccatcacttcgccggtnaagtcagaacattagtaattattaatgtatcagcagaacgaggaacnccctaagctactgatctagtggtancactcgtagtttcgacgtaaacgggtcgggacccctaagttacgaaggttcgaggtacggacgtaggtcggtccgttacggtagggacctaaggttaacttttccctaccgttccctaccctaaccctaactaccgtacgtaccgtaacgttacctaccctaaccgttacggtaacgtttacgttttacgtaccttaaacctttaaccttaaccgttacgtaacctaagtaacccccccccgttagtttaccgtacgttaccggttaccccggtacggttaccggtaccggtaacggtaaccggtaacggtacggaacgtaacgtaccgtaaacgtaacggttacggtacggtacgtaccgtacctaccgtacgttcgttcgttcgttaccg

SEQ ID NO: 179116 - DNA, 685 bp, Homo sapiens
  misc_feature: GYAE6OF01EGAIS.15.83.H06.1.454.CMB.1.raw
tcagtctacgtagccacgaccggtgctcgatttagatcacgtgcgtcgcgggggcaggagtcagtctcagtcaggacacagcatggacatgagggtcccccgctcagctcctggggctcctgctactctggctccgaggagccaaatgtgacatccagatgacccagtcctccatccctccctgtctgctatctgtaggagacaagaatccaccatcacttcgccggtacaagtcagaacagttaaggaattaatttaaagttggtatcagcaagaaaccgaggaaacgcccctaagcctcctagactctagtggtagctatccgtagtttgacgtaaaggtcgggaccccagtacgaaggttcaggtgacaggtcggtctcggtaggactagtacttaccacttcctacaccatacgacgtacctacgtacctaacccgaacgttaggtaactttagttttacgaccttaaaccgtttaaccttaacgttacgtaacctaacgtaacggtttaacgtttccgtaacgggttacccggtaccccccgggttaacggttccccgggtaacccgaaaccggggtaacccgtaaacggggtacgaaccgtaacgtaaacccgaaacggtaccgttaggtaccggtactaccggacctaaccctagtaccgtttcgttcccgttaaccg

SEQ ID NO: 179117 - DNA, 771 bp, Homo sapiens
  misc_feature: GYAE6OF01EM8O3.15.83.H06.1.454.CMB.1.raw
  modified_base (288)..(288): a, c, t, g, unknown or other
  misc_feature (288)..(288): n is a, c, g, or t
  modified_base (316)..(316): a, c, t, g, unknown or other
  misc_feature (316)..(316): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccggaggagccaaatgtgacatccagatgacccagtctccatccctccctgtctgcatctgtaggagacagaatcaccatcacttcgccgtacaagtcaagaactattaaggtaatttaatttaaagttggtatcagacaagaaaccgagggaacncccctaagcctcctagattctagtggtnactattcctagtttcgacgtaaaggtcgggccctagtacgtaaggttcgaggtggcgtaggtcggtcgtacggtcgggactaagtactttaccaccgttcctaccaaccgtactaccgacgtcgtaacgttaccctacccgtaaaccgttacggtaacgtttaacgtttttaccgaacctttaaacccgtttaccttaacgttcgtaacctaaacgtaaggtttaacggtttaccggtaacggtttacccgggttaccccccgggttaacgggttacccgggtaacccgggtaaacggggtaaacccggtaaacggggttaccggtaaacccggtaacggttaaacccggaaaaccgggttaaacccggttacggggttaacccgggtaccggttaaccggtaccccgtaaacccgttaaccgtttaccggtttaccgtttccctttaaccccgg

SEQ ID NO: 179118 - DNA, 650 bp, Homo sapiens
  misc_feature: GYAE6OF01C6J70.15.83.H06.1.454.CMB.1.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctcatcctccctgtctgcatctgtaggagacagaatcaccatcacttgccgtnagtcagacattagattattaatgtatnanacagaacaggaacgccctaagctcctgatctagtggtgctatccgtagtttgacaaaacggtcgggaccctatacgtaaggtttcaaggttggacctaggtcggcgttcgtggggaacaggtattttccgacttctaccaacctataccagcctaacgttcctacctaaacccgttgtaaacgtacgtttttacggactaaaccttttactaacttcgtaacctaactaacggtacgttttacgtaacggtaccgttaccccggggtacccgttaccgggtaccgaaacgggtaacccggtaaagggtaccgggtaacgaacgtaaaccgaaacggtaaaccgtacggttaccggtacgttacggacctaacccgtaagtttcctcgtttccgttaacccg

SEQ ID NO: 179119 - DNA, 626 bp, Homo sapiens
  misc_feature: GYAE6OF01CDFJ0.15.83.H06.1.454.CMB.1.raw
  modified_base (277)..(277): a, c, t, g, unknown or other
  misc_feature (277)..(277): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcaagaaaccagggaaacnccccctaagctcctagatctagtggtgcatcctagtttcgacgtaaaggtccggggaccccagtaccgaaggttcaggtggacaggtggctcgtgggactagtactttcacttctacaccctatccgagtcctacgtcctaccctaaccgtggaattagttttcgacctaactttacctactacgtacctaacgtagttacgtttacgacgggttaccgtacccccgggtagtttacccgggaccgaaacggggtaaccctaaggggtcgtaaccgaagttaaccgaaaacggttacgtggtaccgggactcggtacctacccgtagttcccgtggttccctttacccg

SEQ ID NO: 179120 - DNA, 733 bp, Homo sapiens
  misc_feature: GYAE6OF01AGQIA.15.83.H06.1.454.CMB.1.raw
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagacaaatgtgacatccagatcgacccagtctccatcctccctgtctgcatctgtaggagacagaatcacatcacttcgccggtcaagtcagaactagttagtaattatttaaatggtatcagacaagaaacgagggaacncccctaagcctcctagtactcgtagtggtcnctacgtccgtaggtttcgaacgtaagggtccgggaccctagtacgtaacggttcgaggtcggacgtacggtcggtcgttacggtacgggactacgttacttttacccacgttcctaccgaacctacgtccaacggtccctacccggttacctaacccgtaaaccgttagtaaacgtttacgttttaacgaaccctttaaacgttaaccttaccgtattaacccgtaagtaaccggttttaacgtttaccggtaacgggttaccccgggttaccccgggttaacggtttaccccgggaacccggaaacggggttaaccgtaacggggtaccggtaaactaaccggtaaaccggtaaacggttaaccgttgggtacggtacccgtacgtaccctaccgttacgttccttccggttaccttacccg

SEQ ID NO: 179121 - DNA, 912 bp, Homo sapiens
  misc_feature: GYAE6OF01C4B8R.15.83.H06.1.454.CMB.1.raw
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatccaccatcacttggccggtnaagtcagaacattagaatttaatttaatggtatcanacaagaaaccagggaacacccctaagcctcctagacttactagtggtcgactacttacccgtaggtttacggaacgtaaacgggttccgggggacccctaaagttacccggttaaagggtttacccgaaaggggttcgggaccgttaacgggttcgggacccgtttacggggttaggggtaaaccgttaaggttaaccttttttaccgaaccctttacccgttaaccctaaccccctaacgtttaccccgaaacggtacccgtaacggtttacccccttaacccccgtaaaaacccggtttacggttaaaaacggtttaccgtttttttaaccggaaaccctttaaaacctttttaacccgttttaaacgttaccggttaacctaaaccggtttaagggtttaacggtttttaaaccggtaaaccggggtttaaaccccgggtttacccccccgggggttaacgggttttaaccccggggaacccgggtaaaaccggggggtaaaccccggttaaaagggggttacccggtaaaccggtaaaccgttaaaacccggtaaaacccggttaaaccgggttacgggttaccgggaacccgttacggtaacccgttaaaccctaccgtttaccttacccggtttccctttaacccg

SEQ ID NO: 179122 - DNA, 603 bp, Homo sapiens
  misc_feature: GYAE6OF01D33WO.15.83.H06.1.454.CMB.1.raw
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgctgacatctgtaggagacagaactcaccatccacttgccggtcaagtcaagacattaggaattaatttaatcggatcagacaacgaaacgaacggaaacncccctaagctcctgataccgtagtaggtgcgatccgtagtttgacgaaaggtcgggccccatcgtaagttcaaggtcgcgaggtggctcgtcggacnggtaactttcaacgtctccaactctacacgactaacggttcctaaccctaacgtacgtaattacgttttacgaactaactttactacgttagtacaactagttagtttacaacggtttaccggtcccggtaacgttcggaccgtaacgggaaccgaaggtcgaaactagaacgtaaacgtacgtacgacgggtctaccgggctaacgacctggttacctcttaccg

SEQ ID NO: 179123 - DNA, 640 bp, Homo sapiens
  misc_feature: GYAE6OF01ATN74.15.83.H06.1.454.CMB.1.raw
  modified_base (254)..(254): a, c, t, g, unknown or other
  misc_feature (254)..(254): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattagaattattaaatggtatnagcagaaccagggaaagcccctaagctcctgatctatggtgcatcctagtttcgacgtaaaacggtcggggacccccagtaccgtaaacgggttccaaggtcgggacaaggttcgggcttcgtggggactaggtactttcgtaacctcgttaccaccaacttccaagtccaggttcctacccaaacccttaggaaacgttacttttacgacctaaactttacctacttagtaccaacgtagtacgtttacagttaccggtccccggtacgttaccggtaccgaacgggtaccgtaagggaccggtaacgtaacgtaaccgtaaaaggaaccgttacgggtcggaccgttacgacccgttaaccaacttccgttcttcgtttaaccc

SEQ ID NO: 179124 - DNA, 575 bp, Homo sapiens
  misc_feature: GYAE6OF01DQNWW.15.83.H06.1.454.CMB.1.raw
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (556)..(556): a, c, t, g, unknown or other
  misc_feature (556)..(556): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattagaattatttaatggtatcagnaagaacaggaancccctaagctcctgatctaatggtgcatcctagtttagacaaaggtcgggaccccatcaaggttcagtgcagtgctcgtgggacagtactttcactctccgaaccatactagctacgtctaaccaaacctgaagttattttcgactaaactttactacgtcgtaacaacaagttacgttacgagttacccggttccccggaaggtttccgggacccgaaagggtaacccgtaagggtacggaactacgtaacgaaacggacttcggtacggcgtacgactaaccgtnttaccgtgttacgttaccc

SEQ ID NO: 179125 - DNA, 539 bp, Homo sapiens
  misc_feature: GYAE6OF01A3KF2.15.83.H06.1.454.CMB.1.raw
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (436)..(436): a, c, t, g, unknown or other
  misc_feature (436)..(436): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattagaattatttaaattggtatcagcaagaaaccagggaacncccctaagctcctgatctagtggtgcatccagtttgacgaaaggtcgggaccccagtacaaggttcaggtggcaggtcggctcgtgggactaggtattcactctacaccatcagcagtcctaccaactgaattatttagacctaacttactactgtacaanagtagttcagttacgtacccggtacgttcggaccgaacgggaccgtaaggtacggaacacgtacgaaacgacgtgtcgctacgaccactactcttgtccttac

SEQ ID NO: 179126 - DNA, 634 bp, Homo sapiens
  misc_feature: GYAE6OF01EQT55.15.83.H06.1.454.CMB.1.raw
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtagganacagaatcaccatcacttgccggtcaagtcagaactattaggtaattatttaaattggtatcagacaagaaaccgagggaacaccccttaagcctaccgtagtatctaagtggtnctactcctagtttgaacgtaacgggtcgggaccccataccgtaaggttcaggtggcgaggtcggctcggtagggactagtactttcacttaccgtaccacctaactcgacgtacgtacgttaccctaccctaaacgttagtaaacgtttacttttacgacctttaaacctttactacttacgtactaacgtgttaacgttcgaggttacccggttaccccggtacgttaccgggaccgtaaacgggacctaacgggtacggaactacgtaacgtaaacgtacgtcgtacggtactacgacgaacctattccttagtcttaccg

SEQ ID NO: 179127 - DNA, 664 bp, Homo sapiens
  misc_feature: GYAE6OF01AV9JT.15.83.H06.1.454.CMB.1.raw
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccggaggagccaaatgtgacatccagatcgacccagtcctccactccctcctgtctgcatctggtaggagacagaatccaccatcacgttcgccgtacagtacagaactattagtaatttaagtttaaatcgtatcgagacaacgaaaccagggaacnccctaagctaccgtagatctagtggtnactatcctagtttcgacgtaagggtcgggaccctagtaccgtaaggttcgaaggtcggacttacgggtacggtccgttacgggtacgggaactaacggttatttacccgtacttaccctaccgtaaccttataccgtacgtaccgtaccgttacccgtaacctaaccggttagttaacgttacttttaccgaacctttaacttaccgtactacgtaaccaagtacgttacgttaccgtacggttacccgtccggtaccgttacggaccggtacggaacccgtaaggtccgtaatacgaacgtaaggtacgtgtcggcttacgacgtaactagtcttccgtcttaccg

SEQ ID NO: 179128 - DNA, 772 bp, Homo sapiens
  misc_feature: GYAE6OF01C07KK.15.83.H06.1.454.CMB.1.raw
  modified_base (221)..(221): a, c, t, g, unknown or other
  misc_feature (221)..(221): n is a, c, g, or t
  modified_base (311)..(311): a, c, t, g, unknown or other
  misc_feature (311)..(311): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcactgccggtanaagtcagacagttaggtaattaatttaatggttatctagacaagaaaccgaagggaacgcccctaagtcctccgtgactactagtcggtnctatccgtaggtttcgacgtaaacggtccggggacccctagtaccgtaaaggttccgaaggttcggacgtacggttgggaccgttcggtacggggtactaacggttacttttccgaacctttccgtaaccctaacccgtacgttaccgaacggtccgtaacggttccccttaacccgttaaaaccggttacgttaaacggttacttttttaccggaacccgtaaacctttttaccgttaacttacggttaacccaaacgttaggttaacgttttacgtaccgggttaacccggttacccccggggttaacgtttacccggggtacccggaaaacggggttaacccggtaaacgggtaaaccgggtactaaacggttaacccgtaaaacggtaaccgttaagggttccggtaaactcccgggtaaacctaacccttagttacccgtcgtttaccccggttac

SEQ ID NO: 179129 - DNA, 812 bp, Homo sapiens
  misc_feature: GYAE6OF01E44KM.15.83.H06.1.454.CMB.1.raw
  modified_base (210)..(210): a, c, t, g, unknown or other
  misc_feature (210)..(210): n is a, c, g, or t
tcagtctacgtagccacgaccggtgctcgatttagatcacgtgcgtcgcgggggcaggagtcagtctcagtcaggacacagcatggacatgacgggtccccgctcagctccgtggggcctcctgcctactctggcctccggaggacgaccaaatgtgacatccagatcgacccagtcctccactccctcctgtctgctatcgtgtagganacaagactcaccatctacttcggccgtacaagtcagaactagttaaggaatttaatttaaagttggtactcagacaacgaaaccgagggaaacgacccctaagcctccgtagattactagtggtcgcaacttccgtaggtttcgaacgtaaacggggtccgggacccctagttaccggtaagggttccaggtcggacgtaggtcggtacctcggtagggactaggtactttcaccttcgtaccaacctagtccgacgcgtacgttacctaacccaaacccgttaggtaaacgtttacgttttaccgaaccttaaacccttttaccgttaaccttacggtaacccaaaacggttacggttaaccggttttaccgtaaaccggggtttaacccgggttacccccccggggttaacgggttttaccccgggaaaccccgggtaaacgggggtaaaccccggtaaacgggggttacggtaaaaccccggttaacgtaaaaccccggtaaaaaccggtaaacccggtttgggttaacccgggtaccttacccggtaaccccgaaccccgttaaacgttcccgtttaacggtttccccgttttaaccc

SEQ ID NO: 179130 - DNA, 583 bp, Homo sapiens
  misc_feature: GYAE6OF01B7PH1.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgacaaagtcgggccccatcaaggttcaggtggcagtggctcgtgggacaggtatttcactctcaccatcagtcagtcctccaacctgaagtattttagacctaactttactactgtaccaacgtagtacgtttacgaagttaccggtcccccggttaacggtttccggaccgtaaacgggtacccgtaaagggtcggaaccgtacgttaaccgaaaaccggtaacgttggtcggacttacggtacctaacccgtaattccttgttctttacccg

SEQ ID NO: 179131 - DNA, 604 bp, Homo sapiens
  misc_feature: GYAE6OF01CJZIF.15.83.H06.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtnaagtcagaacattaggaattaatttaatggtatcagcagaaaccagggaacaccccaagcctactgatactatggtgcatccgtagtttgacaaaggtcggggaccccatacgaaggttcaggtggcaggtcggcgtacgtgggtacagtactttacgacttctacctaccactcagacacgtctaccaactgaagtatttagactaacttactatacgtacaactagtacgtttacgacggttacccgtaccccgggtacgttaccggacccgtaaacgggtaccgtaaacgggtcggtaaacgtaccgtaacaaaaccggtacgttacgggtaccggtacgttaccgacgtaccctagttccttaccgttcgtttacccg

SEQ ID NO: 179132 - DNA, 691 bp, Homo sapiens
  misc_feature: GYAE6OF01AKFCL.15.83.H06.1.454.CMB.1.raw
  modified_base (232)..(232): a, c, t, g, unknown or other
  misc_feature (232)..(232): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtctccactcctccctgtctgcatctggtaggagacagaactccaccatcctacgttcgccggtanaagtcaagaactagttaaggtaatttaatttaaattggtatcagacaagaaaccgaggaaacgtcccctaagcctaccgagtactctagtggtacgactacgttaccgtagtttcggaacgtaaacgggtccgggacccctagtaccgtaaggttcgaggtacggcgtaggtcggcgtcggtagggactaagtacgtttacctactccgtaccactacgtccgtagtcgtaacccgtcctaaccctaacgtagtaacgttacttttcgaacctttaacttacctacttagtacctaacgtagttacgttacctaacgggttcccggtaacccggttacggttaccgaccgggtaaaccggtaccggtaacggttacggaacgtacgtaaacccgtaacggtaacggtcggtacggtactacggtaccctactacgttacccgttgttcccgtttacccg

SEQ ID NO: 179133 - DNA, 697 bp, Homo sapiens
  misc_feature: GYAE6OF01BB5QA.15.83.H06.1.454.CMB.1.raw
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccggatgacccagtctccatcctccctgtctgcatctgtaggagacagaatcacatcacttgccgtcaagtcagaactattagtaattaatttaaattggtatcagacaagaaaccgaggaaacnccctaagctcngatntatggnacactcctagtttcgacgtaaacggtccgggacccctaagtaccgtaaaggttcgaaggtcggacgtaggtcggtacctcggtacgggaacctagttactttaccctaaccgttccgtaccctaacctacgttaccgacgtacctacgttacccctaacccgaaccgttagtaaacgtttacttttaccgaaccttaaacgttttacctaacgttacgtaacctaacgttaacgttacgtttaacggtaacggtttacccggttacccccgggttaacggttaccggaacccggtaacggggtaaccgtaacgggtacggaacctaaacgtaacgaaaccggtatacgggtacgccgtaacgacctaaccgttattacctcgttccttccgttacccg

SEQ ID NO: 179134 - DNA, 682 bp, Homo sapiens
  misc_feature: GYAE6OF01EG2HH.15.83.H06.1.454.CMB.1.raw
  modified_base (229)..(229): a, c, t, g, unknown or other
  misc_feature (229)..(229): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtctccatcctcctgtctgcatctgtaggagacagaactccaaccatccacgttcgccggtanaagtcaagaactagttaaggtaatttaatttaaagttggtaatcaagcaagaaaccagggaacncccctaagcctctgactctagtggtncatccgtagtttgacgtaaggtcgggacccagtacgtaacggttcaggtggactaggtcggtacgtcggtacggggaactaggtactttaccgaccttaccgtaccaaccctctaccgacgtacgtaacgttccctaacccgtaaaccgtaggtaacgtttacgttttagacccttaactttaccttacgtacgttacaaacgttaacgttaacgttacgtaacggttaccggttacccccggtacggttaccggaaccggtaaacggggaccctaaagggtacggaactaacggtaaccgtaaaacggaacgttcggtacggtacgtcggtaaccacgttaacttcgttacgtctttacccg

SEQ ID NO: 179135 - DNA, 681 bp, Homo sapiens
  misc_feature: GYAE6OF01ENQ3X.15.83.H06.1.454.CMB.1.raw
  modified_base (282)..(282): a, c, t, g, unknown or other
  misc_feature (282)..(282): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttcgccggtacaagtcagaacattaggtaattaatttaaattggtatcagacaagaaaccaagggaacncccctaagctcctgattctagtggtgcatcctagtttgacgtaaaggtcgggaccccagtacgaaggttcaggtcggacgtaggtcggtcctcggtcgggacctaggtacttttaccgtaccttccttacccaacccgtattaccgacgtaccgtaacgttaccctaaccccgtaaaccgtacggtaaacgtttactttttaccggaacctttaaacccttttaacctaaccgtttcgtaacctaaacgtaacggttacgtttacgtaacggttacccggttccccgggtaacgttacccgggaccgtaaacgggacccgaagggtaccggaacgtactaacgtaaaccgaacgttgcgggtacaccgtaccaaccgtaccttcgttcgttcttacccg

SEQ ID NO: 179136 - DNA, 579 bp, Homo sapiens
  misc_feature: GYAE6OF01BLUB7.15.83.H06.1.454.CMB.1.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (430)..(430): a, c, t, g, unknown or other
  misc_feature (430)..(430): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacataggttttttaanatttaaattggtatcagcaagaaaccagggaaacncccctaagcctcctgactctagtggtgcattcctagtttgacgtaaaggtccgggaccccagtacgaaggttcagggtcggctaggtcggctggtagggacagtatttccacttctcactatcagtccagtcctaccaacttgaagttnttttgaccttaactttactactgtaaccaacgtagtacgtttacagggttacccgttccccgggagttccggaccggaaaggtaccgaagggtcgaacacgtaacgaaacgtacgtgacggctcgtaccaccctattccttgtcttacg

SEQ ID NO: 179137 - DNA, 903 bp, Homo sapiens
  misc_feature: GYAE6OF01CROWK.15.83.H06.1.454.CMB.1.raw
  modified_base (142)..(142): a, c, t, g, unknown or other
  misc_feature (142)..(142): n is a, c, g, or t
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagtctacgtagccacgaccggtgctcgatttagatcacgtgcgtcgcgggggcaggagtcagtctcagtcaggacacagcatggacatgacgggtccccgctcagctcctggggctcctgctactctggctaccgagganaccaaatgtcgacactccagtatcgacccagtctaccatccctcctgtctgccatcgtagaggagacagaactcacctatctacgttcggaccggtnaaacggtcaagtaaactagttaacggtaatttaatttaagtgtaatacgacgacaacgaaaccgtaggtaaaccncccctaagtcctaccgtagtactaccgtaagtcgggtactacctacttaccgtaaggtttacgaacgtaaacgggttccgggtacccctagttaaccgtaggttactacggtacgggtctaacggggtccgagttaccgggacgggtaacttagttaccgtttaacccgacttaccgttaaccgaaccgttaacgtaaccgtacgggtaaccttaaccgttacccggttaaacctaaccggttttaaggttaaccgggtttaacctttttaaccgggtaaacccctttaaaccggttttaaccgttaaccgggttttaaccccgtaaagttaaacccgggtttacggtttaacccggtttttaaccgaaacccgggggtttaccccggtttaaaccccccgggttaggggttaaaccccgggttaacccgggtaaaaacccggggtaacccgggtaaaaccggtttaccggggtaaaccgttaaaacccgggtaaacgttaaaacgggttacccgttaaacgggttccgggtaacgtaaccggtaaccctaacccgtttaacgtaccgttttacccgtaccgtttaccg

SEQ ID NO: 179138 - DNA, 543 bp, Homo sapiens
  misc_feature: GYAE6OF01C53NI.15.83.H06.1.454.CMB.1.raw
  modified_base (274)..(274): a, c, t, g, unknown or other
  misc_feature (274)..(274): n is a, c, g, or t
  modified_base (487)..(487): a, c, t, g, unknown or other
  misc_feature (487)..(487): n is a, c, g, or t
tcagtctacgtagccacgaccggtgctcgatttagatcacgtgcgtcgcgggggcaggagtcagtctcagtcaggacacagcatggacatgagggtccccgctcagctcctgggggctcctgctactctggctccgaggagccaaatgtgacatccagatgacccagtctccatcctccctgtctgcatctgtaggagacagaatcaccatcacttgccgtcaagtcagacattagaattaatttaaatggtatcagacagaaaccaggaaacncccctaagctcctgatctatggtgcatcctagtttgacgaaaggtcgggcccatcaaggttcaggtgcagtcggctcgtgggacagtatttcactctacacatcagcagtcctacaacctgaagtatttcgactaacttactactgtacaactagtagtttacaggttacgtccccggtacgttccggacgaacgggtaccgtaaggtcgaanacgtaacgaaacgtaacgtggtacggtacgtcgtaccgactagttctgttcttacc

SEQ ID NO: 179139 - DNA, 681 bp, Homo sapiens
  misc_feature: GYAE6OF01A4MPN.15.83.H06.1.454.CMB.1.raw
  modified_base (659)..(659): a, c, t, g, unknown or other
  misc_feature (659)..(659): n is a, c, g, or t
tcagtctacgtagccacgaccggtgctcgatttagatcacgtgcgtcgcgggggcaggagtcagtctcagtcaggacacagcatggacatgagggtcccccgctcagctcctgggggctcctgctactctggctccgaggagccaaatgtgacatccagatgacccagtctccatcctccctgtctgcatctgtaggagacagactcaccatcacttgccggtacaagtcaagaactattaaggaatttattaaattggtatcagcaagaaaccgagggaaacgacccctaagcctacctgattactagtggtcgcactccgtagtttaggaccgtaaagggtccggggacccctagtaccgtaaggttcgtaacggtggacgtaggtcgggtctcggtagggactagtatttcacctctaccgacctatcgactactacgtcctaaccctaacgttacggtaagttacttttcgaaccttaacctttaaccttaccgtttaggtaccctaaacgtaggttaccgttttaccgacgggttaacccggtacccccgggttagggttcccggaaccggtaacggggacccggtaacgggtcggaaacgtaacgtaaccgaaaacggtaccgtcgggtacgtccgtacggtccctaacccgntttcccgtcgttccgttacccg

SEQ ID NO: 179140 - DNA, 753 bp, Homo sapiens
  misc_feature: GYAE6OF01B6VJD.15.83.H06.1.454.CMB.1.raw
  modified_base (238)..(238): a, c, t, g, unknown or other
  misc_feature (238)..(238): n is a, c, g, or t
  modified_base (372)..(372): a, c, t, g, unknown or other
  misc_feature (372)..(372): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgaccctagtcctccatccctccctgtctgcatcgtggtaggagacaagaatccaccatccgtacgttcggaccggtanaacgtacaagtaaactagtttaaggtaaattttaagtttaaaagtttggtaatcgaagtaccaaacggaaaccgaacggggaaaacctacccccgtaaagccttacccgtagtacttacgttaacgtgggtacnccgtaacttccgtaaggtttacggaaccgtaaacgggtccgggtaccccaagttaccggtaagggttactagggtcggacgtaggttcggacgtacggtagggaacctaggttactttccgaaccttctacccgactaacgtcaacggtcctaaccgttaccctaacccgtaaaccgttaggaacctttacgttttaaccgaacctttaaaccttacgttaacttacggtaactaaacgtaggttacgtttaccgtaacggttaccggttcccggtaggttaccggaccggaacgggtaaccgtaagggtcgtaaacgtacggtaaaccgtaacggagttcgaccggtcttacgacctaacacgttcttaccgtcttaccg

SEQ ID NO: 179141 - DNA, 726 bp, Homo sapiens
  misc_feature: GYAE6OF01CXMF3.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatccaccatcacttcgccggtacaagtcagaacagttaaggtaattaatttaaattggtatcagacaagaaaccgagggaaacgacccctaagcctacctgactcttagtggtgtactacgtacctaggtttacgacgtaaacggtcggggacccctagtacgtaacggttcgaggtcggacgtaggttcgggaccttcggtacgggactagtacttttccgtaccttcctacctaaccccgtattaccgaacgtaccgtaaccgttaccctaaccctaaaccgttacggttaaacgttacgtttttacaaccgtttaaccgtttaacgtaaccgtttacgtaacccgtaacgtaacgtttaacggtttaccgtaaccgggtaccggttacccccggtacgggttaccgggtacccggtaaacgggtaacccggtaagggtaccggaacgtaacgtaacgtaaaccggtaacgttcggtaccggtacgacggtaccaaccgtacgttccgtcgttccttaaccg

SEQ ID NO: 179142 - DNA, 637 bp, Homo sapiens
  misc_feature: GYAE6OF01DI611.15.83.H06.1.454.CMB.1.raw
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (414)..(414): a, c, t, g, unknown or other
  misc_feature (414)..(414): n is a, c, g, or t
tcagtctacgtagccacgaccggtgctcgatttagatcacgtgcgtcgcgggggcaggagtcagtctcagtcaggacacagcatggacatgagggtccccgctcagcctcctggggctcctgctactctggctccgaggagccaaatgtgacatccagatcgacccagtctccatcctcctgtctgcatctgtagagaacagaatcaccatcactgccgtanagtcagaactattagtaattaatttaatgtatcagacaagaaacgaggaaacncccctaagctctgatctagtgtgcatcctagttagacgaaaggtcgggaccctaagtacgtaaacggttcaaggtggacgtaggtacggtcctacggtagggactaaggtaactttactacttctaccaaccatacganacgtaagtacgtaaccctaaactgtaagtattttacgaacttaaccttaacttaactacgtaactaacgtaagttacgtttaccaacgggttaccgtacccgggtacgttaccggtacgaacgggtaaacccgtaagggaccggtaacgtaacgtaaaccgtaaacgtaacgtaacggtcgggtacgacgtaccaaccgtacgttaccttcgttccgttaccg

SEQ ID NO: 179143 - DNA, 702 bp, Homo sapiens
  misc_feature: GYAE6OF01CELWX.15.83.H06.1.454.CMB.1.raw
  modified_base (229)..(229): a, c, t, g, unknown or other
  misc_feature (229)..(229): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtctccatcctcctgtcctgcatctgtaggagacagaatcacatcacttgccgtacaagtcanaactattaaggtaattaatttaaattggtaatcaagcaagaaaaccgaggaaacctcccctaagtccttacctgactcgttaagtcggtgacctattccgtaaggttttcgaacgtaacgggttaccgggaccccctaagttacgaaacgggttttcaagggttcggaccgtaaggtggtacctcgggttacgggaactacggttaactttccgaaccttaccgtacctaacccgtattaccgaagacctacgttacccttaacccaaacgttggttaaacttacgttttacgaacctttaaccgttaacttacgttacgtaacaaacgttgtaaccgttgaacgttacccggtacccggtacgttaccggaccgaaacgggtaccgtaaacgggtccgaagtaacgaaccgtaaacggtaacgtcggtacgtacttacgaccgtaacctagttacctgtttacccgttaccc

SEQ ID NO: 179144 - DNA, 714 bp, Homo sapiens
  misc_feature: GYAE6OF01E56QB.15.83.H06.1.454.CMB.1.raw
  modified_base (684)..(684): a, c, t, g, unknown or other
  misc_feature (684)..(684): n is a, c, g, or t
tcagtctacgtagccacgaccggtgctcgatttagatcacgtgcgtcgcggggcaggagtcagtctcagtcaggacacagcatggacagtcggacgggtccccgctcagcctccgtggggcctcctgctactcgtggcctacggaggacgaccaaagtgtgacactaccgagactcgaccctgttcctacctacctcccgtcctgtctgactatcgtaggagaacacaagtacctacctactactaccgtacgtaccgtaccgaactaagtacgtaaacgttaacgttaaggtttaaagtaaacttttaaagtttacggtatacgaccgaacgaaccggtaaaaccgaaaccgggtaaccggtaaccctaaccttcgaccgttagtacgttactacggttaggtacgtacgtaccgttaacgttaccggtaaccgtacgggtaaccggtaccggtaccgtacgtaggtaacgtaggtcggtacgtggtacggtcgtcgtacggtactatacgtacttctaccgctaaccacacttacgacgtacgtacctaacgtacctagtacgttaattcgtactactactctagctagacgttagtcggtacgaccgtaccggtacgacccgacggtacgacggtaagaccgacgtaaccacgaacgtcgtatccggcttcgacccgttancctttcgtaaccctcgttacctcgtacccg

SEQ ID NO: 179145 - DNA, 646 bp, Homo sapiens
  misc_feature: GYAE6OF01BWKEO.15.83.H06.1.454.CMB.1.raw
  modified_base (628)..(628): a, c, t, g, unknown or other
  misc_feature (628)..(628): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtctccatccctccctgtctgcatctggtaggagacagaactccaccatcctacttcggcccggtacaagtacaagaactagttaaggtaatttaatttaaagttggtaatcgagacaacggaaaccgaggggaaacctacccctaagccttaccgtaggtacttcttagtggtgctacttccgtagtttcgaacgtaacgggtccgggaccctagtacgtaaggttcgaggtcggacgtaggtcggtctacggtacgggtaacctaggttactttccgaccttctaccaccgtatcgacgtctacgtaccctacctaacgttagtaacgttctttagaccttaacttactacgttacgtactaacgtagttacgtttacgacggttacccggtacccggtacgtaccggaccgtaacgggaccgtaagggtacgaactacgtaacgaacgtacgtgacgcngtaccactatctgtctcg

SEQ ID NO: 179146 - DNA, 561 bp, Homo sapiens
  misc_feature: GYAE6OF01EBOPQ.15.83.H06.1.454.CMB.1.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (415)..(415): a, c, t, g, unknown or other
  misc_feature (415)..(415): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtnaagtcagaacattagaattatttaaatggtatnagcagaaacaggaacncccctaagctcctgatctatggtncatccagtttgacgtaaaggtcgggaccccatacgaaggttcaggtggcaggtcggctcgtagggactagtactttcgacttctacaccatacacgactacgtcctaccaactagtaattntttacgacttaacttactactgtacaacgtagttacgtttacacggttaccgtacccggtacgttccggacgtaacggaccgtaaggtacgaactaacgtaactaaacgtacgttcgagtcgtacgacactactcttcgtcttacg

SEQ ID NO: 179147 - DNA, 723 bp, Homo sapiens
  misc_feature: GYAE6OF01B2D4N.15.83.H06.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
tcagtctacgtagccacgaccggtgctcgatttagatcacgtgcgtcgcgggggcaggagtcagtctcagtcaggacacagcatggacatgagggtccccgntcagctcctggggctcctgctactctggctccgaggagccaaatgtgacatccagatgacccagtctccatcctccctgtctgcatctagtagganacagaactcaccatcacgttgccgtnaagtcagaactattaggtaattaatttaaattggtatcagacaagaaacaggaaacnccctaagctcctgattctatggtagcatccgtagtttgacgtaaaggtcgggtaccccagttaccgtaaggttccaaggtcggtacctagggttcggtacgtccggtagggtactaacggtactttaccgaaccttcctaccacctaacgttaccgaacggcctaacggttcccttaaccgtaaacccgttaggtaaacgttacgtttttaccggaaccttaaccttttaacctaaccgttacgtaaacccgtaacgttaacgttaacggtttacccgtaacggttacccggttacccccgggttacggttacccgggtaacccgtaaaccgggtaacccggaaacggtacggtaaccgtacgttaaccgaaaccggtaacgtaccggttaggtacccgttacgaccgtaccctaacttaccgttacgttccgtttaacccg

SEQ ID NO: 179148 - DNA, 622 bp, Homo sapiens
  misc_feature: GYAE6OF01C9SEI.15.83.H06.1.454.CMB.1.raw
  modified_base (267)..(267): a, c, t, g, unknown or other
  misc_feature (267)..(267): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagacattagattattaatgtatcagacagaaacaggaacncccctaagctcctgatctagtgtgcatcctagtttagacgtaaaggtccgggaccctagtcgtaaggttcaggtggacgtaggtcggtctcgtgggactagtactttccgacttctaccaacctactaccgacggtctaacggttcctaaccctaacgtgtaaacgtttacgttttacgaacctaacctttaccttaacgttacgtaccgtaacgttaacgttaacgttttacgtaacggttacccggtaccccgggttacggtttaccggaccggtaaacgggaaccgtaagggtacgtacaacgtacgaaaccgtacgtggtacgctacgtaccacctattctgttccttacc

SEQ ID NO: 179149 - DNA, 794 bp, Homo sapiens
  misc_feature: GYAE6OF01BPCIJ.15.83.H06.1.454.CMB.1.raw
  modified_base (197)..(197): a, c, t, g, unknown or other
  misc_feature (197)..(197): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtctccatcctccctgtctgcatctgtaggnacgagaatcacatcacttcgccggtacaagtcaagaacagttaaggtaaatttaatttaaattggtaattcaagacaaacggaaaccgaacggggaaacgtaccccctaagccttcctagtactcgtagtgggtcgactacttaccgtaggtttacgacgtaaacggtccggggacccctaagttaccgtaacggttcgaacggttacggacaagggttcgggtaccgttacggtacggggtaactaaggttaccttttccgaacctttacctacccgtaacccgtaattaccgaacggtccgtaacgttacccgttaacccgtaaaccgttagggttaaaccgtttacgttttacggtaacccttaaacctttaaccgtttaacgtttaccgtaaccgtaaacttaacggtttaacccggttttacggtaaacccggttaccgggtacccccgggtttaacgggttaccccgggaccgggaaaacccgggttacgggaaacgggttacggaaacccgtaacgtaaacccgtaaaggtaacggttccggtacgggtaccttcgtaaccgtaccgtaatccgtttaagttccttaccg

SEQ ID NO: 179150 - DNA, 742 bp, Homo sapiens
  misc_feature: GYAE6OF01DSPSD.15.83.H06.1.454.CMB.1.raw
  modified_base (434)..(434): a, c, t, g, unknown or other
  misc_feature (434)..(434): n is a, c, g, or t
tcagtctacgtagccacgaccggtgctcgatttagatcacgtgcgtcgcgggggcaggagtcagtctcagtcaggacacagcatggacatgacgggtccccgctcagctccgtggggctcctgctactctggctccgaggacgaccaaatgtagacatccagatcgaaccagtcctccactcctcctgtctcgctatcgtaggtaggacgaacgagaactcaactagtctacgtcgacgtacaacgtacgaacgtaactaagttaaggtaattttaattaaagttcggtaacacgagtacgaaacgaaaccggacgggtaaacctaccgttaacgcctacgtacgtacgttacgtagtcgggatacgttacgtaccgttaaggttacgaacggttaacgggtcccgggacctaagtacgtaacggtcgtacggnggtacgtaggtcggtcgaaggtacgggaactagtttacttaccgtacgttacctactaaccctgtaaccgtagtacctaacccggttactaaccggtaacgtaagtttaacctttacgtttacaaaccttacgtttaacctagttacaacgtaactacggtttaacgttacgtacgttacccgggtaccgtacggtacgaccggaacgggtaacgaacggttaccggaacttaacggaaccggtaaagttacggtaacgggccggtcttaccgaacgttacctaacggttccttaacggtcttaaccg

SEQ ID NO: 179151 - DNA, 876 bp, Homo sapiens
  misc_feature: GYAE6OF01BHAVB.15.83.H06.1.454.CMB.1.raw
  modified_base (171)..(171): a, c, t, g, unknown or other
  misc_feature (171)..(171): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtagacatccagatcgacccagtcnccatccctccctgtctgcattctggtaggacgacaagatcacctatcacgttcgccggtacaagtcagaaactagttaaggtaatttaatttaaatggtaactcaagtacgaaacgaaaaccgacggggaaaccgtacccctaaaggcccttaccgtaggtaacttaccgttaagttcgggttacgaccgtaacttcccgttaaggtttcggaaccgtaaacggggttcccggggaacccctaagttaccgtaaagggtttccgtaggtacgggtaccgtagggtacggtaccgttcggtaacggggtaactaacggtttaacttccgtaacccgttaccttaccgactaaaccgtttaccgaaccggtaccgttaccgtttaacccgtaaccccgttaaaaccgtttagggtaaaaccgttttacgtttttaacccggaaaccctttaaaaccgtttacccttaacggtttacgtaaaccctaaacgggttaacgtttaccgggttttaaccgtaaccggggtttaacccccggtttaccccccgggggtaaccgtttaacccgggggtaacccggaaaccggggttaacccgttaaacgggggttaccgtaaaacctacggttaaaacccggaacggttaaaccggttggaacggttaccgtccctaaacggtctactttaccggtcctttccgttaaacccg

SEQ ID NO: 179152 - DNA, 775 bp, Homo sapiens
  misc_feature: GYAE6OF01A52LV.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctccgtggggctcctgctactctggctccggaggacgccaaagtgtagacactccgagatcgaccctagtcctcccatccctccctgtctacatctaggtaggacacgaagtaactcacctatcacgttcgaccggtactaagtcaagtaaacctaagttaacggttaatttaaactttaaagtttaggttaactacgtaacgtaacgaaacggaaaaccggaacggtaaaccgtaaccccgtaacgtacccgttaaccgtacgtaacttacgtacgtacggtacgtaccttacttaccgttaggtttacgaaccggttaaacgggtaccggggtaaccctacggttaccggtaaacggttacgtacgggtaacggtcgacggtcgttaccggtcggttacgggacgtaagtacgtttacgaccgttactaccaacctacgttacacgttacgaacgttacccaaccgtaacgtacggttaacgttacgtttacgtaacttaaccgtttactaccgtacgtaactacgttaacgtacgttactaccggttaccgtacccggttacggtaccgtaccgggaccggtaacgaccgggtacgaaccgtacgtaacgtaacgacggttagtccggtacgtacggaccgttacactacttcgtctacgttaccg

SEQ ID NO: 179153 - DNA, 640 bp, Homo sapiens
  misc_feature: GYAE6OF01A2N4X.15.83.H06.1.454.CMB.1.raw
  modified_base (295)..(295): a, c, t, g, unknown or other
  misc_feature (295)..(295): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcacatcacttgccgtacaagtcagaacattagtaattatttaatgtatcagcagaacgaggaacacccctaagctactgactctagtggtnactatccgtagtttcgacgtaaacggtccgggaccctagtacgtaaggttcaaggttcggacgtaggtcgtacgtacggtagggaacctaaggtactttaccacttaccgtacctactactaccgacgaccgtacgttacctacccgttaaaccgtagtaacgtttacttttacgaaccctttaaacgttaccttacgtaacgttaccaaacgttacgtagtttaccgacggttacccggtacccggttaccgttacggtaaccggaaacggtaccggaacggtggaacctaagtaccaaacggtacgtcgtaggtccacggtcaccttagtctcgttccgttac

SEQ ID NO: 179154 - DNA, 534 bp, Homo sapiens
  misc_feature: GYAE6OF01DXH6F.15.83.H06.1.454.CMB.1.raw
  modified_base (270)..(270): a, c, t, g, unknown or other
  misc_feature (270)..(270): n is a, c, g, or t
  modified_base (355)..(355): a, c, t, g, unknown or other
  misc_feature (355)..(355): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (521)..(521): a, c, t, g, unknown or other
  misc_feature (521)..(521): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtcaagtcagaacattagaattaatttaatgtatcagcaagaacaggaaacnccctaagctcctgatctatggtcgctatcctagtttcgactaaacggtcgggacccagtcgtaaggttcagtggctagtggctgnggatagtattcactcacacntcagctacgtcactaactgtaatntttcgacttaactactactgtacaatagtacttacgagttccgtcccggtagttcggaccgaaggtaaccgtaaggtcgaacgtacgtaaccgtaaagtacgtgtcggactacgtacaactntcgtgttccttac

SEQ ID NO: 179155 - DNA, 679 bp, Homo sapiens
  misc_feature: GYAE6OF01AD29D.15.83.H06.1.454.CMB.1.raw
  modified_base (484)..(484): a, c, t, g, unknown or other
  misc_feature (484)..(484): n is a, c, g, or t
  modified_base (647)..(647): a, c, t, g, unknown or other
  misc_feature (647)..(647): n is a, c, g, or t
tcagtctacgtagccacgaccggtgctcgatttagatcacgtgcgtcgcgggggcaggagtcagtctcagtcaggacacagcatggacatgagggtcccgctcagctccgtggggctcctgctactctggctccgaggagaccaaatgtgacactccagactcgacccagtcctccactccctcccttgtctgcactcgtggtacggagacaagaactccactactcctacgtcgtccggtacaacggtcaagtaactagttaaggtaatttaatttaaagttggtactacgtaacgacgaaacggaaaaccggtaacggggtaaacctacccgtaaacgtcctaccgtacgtaacttccgtaaggttcggtacgtactaaccgttccgttaaggttaccgaacggtaacgggtacccggacccttacgaacggttaagttcgaggtgacgaggttcgggtctacgggtgaactacgtcttacnctacacgtacatacgctcactcccaactaagtcgacttacgtttaccaacttaacttacacgtctaacaagttcgtactacgtacggtacccggtaccggtacgtacccggaacggaacggtacgtagggtacacctaacgtaacgtaacgaacgtgggtacnctacggtacctacgagttcttacgtcttaccg

SEQ ID NO: 179156 - DNA, 548 bp, Homo sapiens
  misc_feature: GYAE6OF01CLYVB.15.83.H06.1.454.CMB.1.raw
  modified_base (222)..(222): a, c, t, g, unknown or other
  misc_feature (222)..(222): n is a, c, g, or t
  modified_base (295)..(295): a, c, t, g, unknown or other
  misc_feature (295)..(295): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatcgtgtaggagacagaatcacatcattcgccgtnaagtcagaacattaggtaattatttaatgtatcagacagaaacgaggaacaccctaagctctagatactatgngcatctagttgacgaagtcgggacctagtacgtaacggttcgacggtgacgaggtcggctcgtagggactagttacttcagtcctcactagtcacgtnacgtactaccaactgaactntttacgactacttactactacgtacaagtgtaatttcgacgtaccgtcccgtaacgttcgaccgaacggacctaaggacgacagaaccgaagtaacgtggtgtacgacgtaccactacttcgtacgttcttaccg

SEQ ID NO: 179157 - DNA, 827 bp, Homo sapiens
  misc_feature: GYAE6OF01EYDIW.15.83.H06.1.454.CMB.1.raw
  modified_base (167)..(167): a, c, t, g, unknown or other
  misc_feature (167)..(167): n is a, c, g, or t
  modified_base (207)..(207): a, c, t, g, unknown or other
  misc_feature (207)..(207): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccggagagccaaatgtgacatccagatacgacccngtacctccactccctcctgtctcgctatcgtggtaagganacgagtaactaccaactatacgtaccgttacggtaccggtaacgtaacgtacgtaacgtaaacttagtttaaacgggtaaattttaacgttttaaagtttaggtaactacgtaacggaccgtaaaacggaaaaccggaacggggtaaaaccgtacccccgttaaaggtcctttacccgttaacggtaactttaccgttaaggtcgttacgcttacgttaccggtaggtttacgaaccggtaaagggtccccgggtaacccctagtaaccgttaacggttaccgaggttcggagtaggtccgggtccttaggggtacggtaactaggttacgttacctaccgtacgttaccaacgtactacgtaaccgtacgtacccgttaccgtaacccgtaacgtaacgtaaagtttaccgtttacggtaaacctttaccgttactaacggttactaacccgtaaagttacgttaacggtttaccaacggggttacccggttaccccgggttaagtacccggaacgggtaaccggaacgtaccggttaacgggacttaacggaacctaaaacgggtacgtacggttcggacctacgtacccgacttaccgttacgttcgttcgtacccg

SEQ ID NO: 179158 - DNA, 661 bp, Homo sapiens
  misc_feature: GYAE6OF01DSNT4.15.83.H06.1.454.CMB.1.raw
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (631)..(631): a, c, t, g, unknown or other
  misc_feature (631)..(631): n is a, c, g, or t
tcagtctacgtagccacgaccggtgctcgatttagatcacgtgcgtcgcgggggcaggagtcagtctcagtcaggacacagcatggacatgagggtcccccgctcagctcctggggctcctgctactctggctccgaggagccaaatgtgacatccagatcgacccagtcctccatccctccctgtctgcatctggtaggagacagaatcaccatcacttgccgtacaagtcagaacagttaagtaatttaatttaaagttgtatcganacgaacgaaaccgagggaaaccnccccgtaagccttaccgtagtacttaccgtaaggtcggtacgtactaacgttaccgtaggtttacggaacgtaaacgggtccgggacccctaagtacggtaaggtttccgaggttcggacggtagtcggaccgttaggtacgggaactacggttactttcaccttccgtaacacctactcacggtcacgttaccaaccgtaactaggttaactttagtttaccacgttaacctttactacgttacgactaagtacgtacttacgacgttccggtacccggtcgttaccggacgaacggtacgagggtacaacgaacgtaaccaaacggtcgtgtacggntaccgactacagttttcgcgttcgttaccc

SEQ ID NO: 179159 - DNA, 769 bp, Homo sapiens
  misc_feature: GYAE6OF01E44BI.15.83.H06.1.454.CMB.1.raw
  modified_base (760)..(760): a, c, t, g, unknown or other
  misc_feature (760)..(760): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggcctccggaggagaccaaatgtgacatccagatcgacccagtcctccactcctccctgtctgcatcgtagtaggagaacagaactccacgtactcacgttcggccgtacaaggtcaagtaactaagtttaaggtaaattttaatttaaagtttaggtactacgaagaaccaaacggtaaaccggaacggggtaaaccgtacccccttaaaggtcctaccgtagtaacttacgtagtgggtacgacctacgtttaccgtaggtttacggaaccggtaacgggtcccgggaaccctacggttaacggtaaacggttcgaacggggtcgtacgttaagggtccggtacggttaccggacgggttaactaagttaccgtttaccacccttaccgtaacccacctaccgtacgaccggtactaccgttacccgtaaccgtaacgtaacggttaagttacgtttaccgttaacctttaacgtttaccgtaacgttccgtaaactaacggtactttaacgggttaccgtaccgggttacccggttacccgtaccggttaccggacggaacggtacggacggtacgacacggtaaacaaggtacgttcgacggtctacccggacacttacgtcgtttcncgtttaccc

SEQ ID NO: 179160 - DNA, 810 bp, Homo sapiens
  misc_feature: GYAE6OF01D50PQ.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcccccctgtctgcatctgtaggagacagaatcaccatcacttcgccggtacaagtcagaactagttaagtaatttaatttaaaatttggtattcaagacaacgtaaaaccgaaggggtaaaccgacccccgtaaggccttacccgtgtaacttaccgttaagttcgggtacgtacctaacgttacccgttaaggttttcgaaccggtaaaacgggttcccgggggaacccccctaagttaccgtaacggggtttaccgtagggtacgggaccgtaagggttcgggtccgttcggtacggggtaactaggttaccttttaccctaaccttcctacctaaccctatacccgaagtacccgtacgttaccctaacccgtaaaccgttaggtaaacgtttaacttttccgaaaccttaaaccgttttaccttaaccgttacggttaaccctaaacgtaaggtttacggtttaccgtaaccgggtttacccggttacccccgggttaacggttacccgggtaccgaaacggggtaacccggtaacgggtaccggaacgttacgtaaaccgtaaaccggtaacgttgggtaccgtacgtaccggtaccgtaccgtacttaccgttcgttcccgttacccg

SEQ ID NO: 179161 - DNA, 845 bp, Homo sapiens
  misc_feature: GYAE6OF01C4XVK.15.83.H06.1.454.CMB.1.raw
  modified_base (278)..(278): a, c, t, g, unknown or other
  misc_feature (278)..(278): n is a, c, g, or t
tcagtctacgtagccacgaccggtgctcgatttagatcacgtgcgtcgcgggggcaggagtcagtctcagtcaggacacagcatggacatgagggtcccccgctcagctccgtggggctcctgctactctggctccgaggagaccaaatgtgacatccagatcgaccctagtcctcctactccctcccttgtctgctatcgtggtagagacagaactcacatctacgtcggaccgtataagtacagaactagttaagtaatttaattaagttggtacncgtacgacgaaacggaaaccgaacggggaaccaccccgttaagcccgttaccgtagtacttaccgtaggtacggtactacctacgtacgtaacgggttacgaaccggtaacgggttcccggacctagttacggtaacgtgtaggtcgagaggtccgtcgtcgggtaggtaacctgttacctttaccaccgttacctaccaacccttacgtaaccgtaacgtacccgtaacgttacccctaaacccgtaacggttaacggttaacggtttacttttaaccggtaaacccttaaaccggtttaaccctttacgttaaaccgttaacgttaaaccggtttagtttacccggttaaccggttaacccggggttacccccggttaaccccggggttacccgggtttaaccgggtaacccgggtaaacgggtaccccgggttaaggggaaacccgttaaaccggtaaaccgggttaaacccggtaaaacggttacgggttccgggtaaccggtttacccgaaccgttaccggtacccgtttaagtccccggtttacttaaccccgttaccccg

SEQ ID NO: 179162 - DNA, 720 bp, Homo sapiens
  misc_feature: GYAE6OF01EEDLG.15.83.H06.1.454.CMB.1.raw
  modified_base (203)..(203): a, c, t, g, unknown or other
  misc_feature (203)..(203): n is a, c, g, or t
  modified_base (709)..(709): a, c, t, g, unknown or other
  misc_feature (709)..(709): n is a, c, g, or t
tcagtctacgtagccacgaccggtgctcgatttagatcacgtgcgtcggcgggggcagggagtcagtctcagtcaggacacagcatggacatgagggtccccgctcagctcctggggctcctgctactctggctccgaggagccaaatgtgacatccagatcgacccagtctccactccctccctgtctgctatctgtagganacagaatccaccatctacgttcggccgtacaagtcaagtaactagttaagtaatttaatttaattggtatcgagacaaacggaaaccgaagggaaccacccccgtaagtccgttaccgtagtacttacgttagtcggtagcctaacttccgttaaggtttacgaacgtaaccgggtccgggacccctaagttaccgtaaggttcgagggtcgtgtacggtcggtcgttacggacggaacttacggttactttacctaacttcctaaccacctacgtacacgtacctaccgttaccgtaaccctaaccgttagtaacgtttattaccgtaacctttaactttaaccgtacttacgttaactaagttacgttacgtttacgaccgggttacccggttaccccgggtaggttacccggaacggtaaccggaacgggtaacggtaggtaaaccgtgtaaaccgtaaagtacggtcggtacgttcgacgtacccgtaactacgtttacgtnttaccttaccg

SEQ ID NO: 179163 - DNA, 709 bp, Homo sapiens
  misc_feature: GYAE6OF01B08YW.15.83.H06.1.454.CMB.1.raw
  modified_base (102)..(102): a, c, t, g, unknown or other
  misc_feature (102)..(102): n is a, c, g, or t
  modified_base (371)..(371): a, c, t, g, unknown or other
  misc_feature (371)..(371): n is a, c, g, or t
  modified_base (635)..(635): a, c, t, g, unknown or other
  misc_feature (635)..(635): n is a, c, g, or t
tcagtctacgtagccacgaccggtgctcgatttagatcacgtgcgtcgcgggggcaggagtcagtctcagtcaggacacagcatggacatgagggtccccgntcagctccgtggggctcctgctactctggctaccgaggagccaaatgtagacatccagactcgacccagtcctcctatccctccctgtctacgctactcgttaggagagacagtaactccaacagtactacgttcggacccgtataacgtacaagtaactaattaaggtaaactttaagtttaaaagttggtaactacgactaacgaacgtaaaaccgtacgggaaacctaccccgtaagtcctacgttacattaccgtagtcggtacnctaacgtacttagttaccgaacggtaacggtccggaccctaataaccggtacgttacgtaaggtcggtacgtacggtacgtcgtacgtacggaccgtagttaccgtctacgtccttacgactacgctacgaccgtacttaccgtaacctaacgtgtaacgtttcgtttacacttaacggttaactactaggtaaccgaacttagttaacgttccgaacgtacggttaccctaggaccgtacggaacgggtaactacggggttanaaccgttacgaaaccggtaagaccgttgggattacccggtcaaccttacgtacttactttcggcctttaaaccc

SEQ ID NO: 179164 - DNA, 768 bp, Homo sapiens
  misc_feature: GYAE6OF01D45KG.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctccgtggggctcctgctactctggctccgagagccaaatgtgacatccagatcgacccagtctccactccctccctgtctgctatctggtaaggagaacaagaactccaacctatcctaccgtttcggacccggttaactaacgtacaaacggaaacttaagttaaaagggttaaatttttaaacgttttaaaagtttcggtaactacgtaaacgaccgtaaaaaccggaaaaccggtaaacggggaaaaccccgtcccccgttaaacgtccttacccgtagtaacctttacgttaggttacgggtacgtacgtaccttacgttacggtttaggaaccggtaaacggggtcccgggtacccctaaggttacgaaacggtttacgacggtggaccgtaggtcgtcgtacggtacggacgttagtacctttcaccgttctaccaactataccgacgcgtaccgtacctacccgtaataggttaacgtttcttacgtaaccgttactttaaccgtacgttacctaagtactaaagttcgttaccggtagttacccggtcccggtaacgttccggaaccggtaacggaccggtaaggtaccgacgtaactaacccggtaagtaaccgtggacctggacaccgtactagtccttgtcctttaaccg

SEQ ID NO: 179165 - DNA, 751 bp, Homo sapiens
  misc_feature: GYAE6OF01CCB8H.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctccgtggggctcctgctactctggctccgaggagccaaatgtgacactccagatcgaccctagtctccatccctcctgtcctgactatctggtaaggagacgaagaactccaacctatacctacttcggtccggtacaacgtcaagaactagttaaggtaaattttaatttaaagttggtaatacgagtacgaaacggaaaccgaacggggaaacctaccccgtaacggtacctccgtagtacttacgttagtgggtacgtaccgtacgttaccgtaggtttaccggaaccgtaaacggggtcccgggtaccctaagtacggtaacggtttacgagggttacggcgtagggttccggtacgttacggtacgggtaactagttaccgtttaccaccgttaccacctaccgtataccgtaacgtccgttacttaccccgtacgtaaccgttacgttaagttaacgtttcgaaacctttaacgttacttacccgtaagtaaccaacgtagtttaccgtacgtaaccggttaccggttacccgggtacgttcccgggaacgtaaccgggtaaccggaacggtacgaacgacgtaaccggtaaagtacggttggacgtcaaccgtcctactagttccttgttcctaccg

SEQ ID NO: 179166 - DNA, 643 bp, Homo sapiens
  misc_feature: GYAE6OF01DSQZY.15.83.H06.1.454.CMB.1.raw
  modified_base (223)..(223): a, c, t, g, unknown or other
  misc_feature (223)..(223): n is a, c, g, or t
  modified_base (286)..(286): a, c, t, g, unknown or other
  misc_feature (286)..(286): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagaccaaatgtgacatccagatcgacccagtctccatcctccctgtctgcatctgtaggagacagatcacatcacttcgccgtanaagtcagaactattaaggtaatttaatttaaattggtatcagacaagaaaccgaacggaaacnccccgtaagctcctgactctagtggtgctagtcctagttcgaacgaacggtcgggaccctagtacgtaaggtcgaggtcggactaggtcggtctcggtacgggaactacggttaactttcctaacgttcctaccgtaacctaacgtcgaacgtactaaccgttccgtaacccttaaacgtacgtaagttactttacgaccttaacctttactacgtacgtacaagtacgttacttacgacggttaccgttcccggtacgtaccggaccggaaacggtaccgtaaggtacggtactaacgtaacggtaaacgacgtacggtacggaccgtagccctaactattccgtattccgtaccg

SEQ ID NO: 179167 - DNA, 798 bp, Homo sapiens
  misc_feature: GYAE6OF01DVGO9.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagaccaaatgtgacatccagatcgacccagtcctccactccctcctgtctgctatcgtggtagacgaacaagtaactccaacctatcctacgttcggccggtacaagtacaagtaactagttaaacggtaattttaatttaaacgttggtactacgagacgaacgaaaaccggaacgggaaaccacccgttaacgtccttaccgtagtaacttcgttagttcgggtactacgtacgttaccgtaagtttacggaaccgtaaacgggtccggaccctaagtaaccggtaaggttcgaaggtcggtacgtaggtcggtacgtacggtacgggactagttacctttacgacgttacgtacctaaccgtacgtacgtacgtacccgttaacgttaccctaaccgtaaacgttacgtaacgttttacgtttaccaaaccgtttaacctttaaccttacgtaaccgtaacgttaaacgtacgggtttaacgtttaccgtaaccgggttacccggttaccccgggtaacggtttacccggaaccgggtaaccggtaaccgggtaacgggtaaccgtaaccgtaacgtaaacccggtaaacgttaacggttcgggtaaccgtacgttaccgaaccctacttaacggttccgttcggttaccttacccg

SEQ ID NO: 179168 - DNA, 679 bp, Homo sapiens
  misc_feature: GYAE6OF01BCYFL.15.83.H06.1.454.CMB.1.raw
  modified_base (229)..(229): a, c, t, g, unknown or other
  misc_feature (229)..(229): n is a, c, g, or t
  modified_base (617)..(617): a, c, t, g, unknown or other
  misc_feature (617)..(617): n is a, c, g, or t
tcagtctacgtagccacgaccggtgctcgatttagatcacgtgcgtcgcgggggcagggagtcagtctcagtcaggacacagcatggacatgagggtccccgctcagctccctggggctcctgctactctggctccgaggagccaaatgtgacatccagatgacccagtctccatcctcctgtctgcatcgtgtaggagacagaactcgaccatccacttcgccggtanaagtcagaactagttagtaattaatttaagtgtatacagacaacgtaaacgacggaaaccgccccgttaaagccttacccgtagtacttacgttaaggtcggtacgtactacgtaccgttaggtttacggaacggtaaacggtccggggtacccctaagttaccggaaggtttcgagggttacggacgtacggttcggtacgtcgttacggggacttaacggtactttaccgaccttacttacccgtacctaagtccgaagtccgtaacttacccaccgtaacgtacgtaagtttcgttaaccacgtttaacttccgtacgtatacccaagtgtaccgttcgtacgttacccggccgttacgttacggaccgtaacggtcaacgggtnaacctacgtaacgaattaacggtcgtcgtaggacctacctaagttctactccgttgtacccc

SEQ ID NO: 179169 - DNA, 877 bp, Homo sapiens
  misc_feature: GYAE6OF01AL8CD.15.83.H06.1.454.CMB.1.raw
tcagtctacgtagccacgaccggtgctcgatttagatcacgtgcgtcgcgggggcgaggagtcagtctcagtcaggacacagcatggacatgagggtccccgctcagctcctggggctcctgctactctggcctacgaggacgccaaatgtagacacttaccagactcgacccgatcctccatccctcctgtacctgacacttcgtaggaggacgaacaagtactccaactctacgtaccgtcggtaccggtactaaacgtacgaagtaaccgttaagttaaggttaaatttaagttttaaacgttgttaactacgaagtaacgtaacgaaacggtaaccgggaaactacccgtaacgtacgtacctacggtactaccgtagttacggtagctataccgtagttacggaacgtaacgggtccgggaacccctgtaaccggtagttaccggtaggacggtaccgttacgggtcggtaccggttaccgggtaggtaccggtaagttaccgtttaccgttaccgtacctaaccgtaccgttaacgtacgtacccggtacgttaaacccggtaccttaaccccgtaaacgttaaccggttaaaccgtttacgttttaacccggtaaaccctttaacccggtttaactttaacccggttaccttaaccgttaaaccgttacgttttaacggtttacccgttaacggtttacccccggtaaccgggttccccgttaacgggttaacccgtaccggggtaaacccttaacgggggttaccgaacgttaaccgggttaaaccgaacggttaaacccggtacgggtacgtaacccggttacgtacccggtacccttaaaggttccgaccgttttaacggttacccc

SEQ ID NO: 179170 - DNA, 734 bp, Homo sapiens
  misc_feature: GYAE6OF01AJBEY.15.83.H06.1.454.CMB.1.raw
  modified_base (221)..(221): a, c, t, g, unknown or other
  misc_feature (221)..(221): n is a, c, g, or t
  modified_base (272)..(272): a, c, t, g, unknown or other
  misc_feature (272)..(272): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtcctccatcctccctgtctgcatctgtaggagacagaatcacatcactgccgtnagtcagactattaggaattatttaatggtatgagcagaaaccgagggaacncccctaagctctgatctatggtgccattaccagttcgacaacggtcgggaccccagtcgtaggttcaggtcggactaggtgctcgagggtactaggttactttctaaccgtacctcgaaccctagtccgaacgtcctaacggttcctaacccaacggtttaacggtaactttaacgttttaccgaaccgtttaaacttttaccgtaaacctttacggtaacttaaaccgtagttttaaaccggtttactaaccgggtttaacccgggttaccccggggttaaccgggttcccgggtaaccggaaacggggttaacccggtaacggggttaacccgggtaaacctaaaccggttaaaccccggtaaaaccgggtaaccgtttcggggtacccgggttaccctaccgggttaacccgtaaccccgtacggttttacccttcgggtttccccttttaaaccccgg

SEQ ID NO: 179171 - DNA, 858 bp, Homo sapiens
  misc_feature: GYAE6OF01DLAUU.15.83.H06.1.454.CMB.1.raw
tcagtctacgtagccacgaccggtgctcgatttagatcacgtgcgtcgcgggggcaggagtcagtctcagtcaggacacagcatggacatgagggtcccccgctcagcctcctggggctcctgctactctggctccgaggagccaaatgtgacatccagatcgacccagtcctccatccctccctgtctgcatcgtgtaggagaacagaactccaccatctacgttcggccggtacaacgtacaagtaactaagtttaaggtaattttaaattttaaagtaggttaactacgaagacgtaaacggaaaacccgaaaggggaaacccgtccccccttaaaaggtccctttaccgtagtacgttaccgttaaggttcggggtcgtacctaacgttacccgtttaaggtttacggaaccggttaaaaccggggttcccgggacccctaagttaccggtaaagggtttccgtaaggggttcggaccgtaagggttccgggtaccgttacggggtacgggggtaaaccttaaggtttaccttttcccaacccgtttcctaacccgtaacccgtacgttaaccgaaccggttaccgtacccgtttacccgttaaaccccgttaaacggttaacggtaaacgtttacgtttttaaccgaaccttttaaacccgtttaacgtttaaccgtacgttaaccgtaaacggttaacgttttaaccggttaccgtaccgggtttaccccggtacccggttaccgggtaccggtaccggaacggtaaccggaaggtacgaacgtaacgtaaacggaacgttacgtcgggtcgtacgtaccgtacccgtaactgttccctcgttcttaacccg

SEQ ID NO: 179172 - DNA, 775 bp, Homo sapiens
  misc_feature: GYAE6OF01DMUZ1.15.83.H06.1.454.CMB.1.raw
tcagtctacgtagccacgaccggtgctcgatttagatcacgtgcgtcggcgggggcgaggagtcagtctcagtcaggacacagcatggacatgacgggtccccgctcagcctccgtggggcctcctgctactcgtggcgtccgaggacgaccaaatgtagacatccagtactcgaccacgtcctccactccctccctgtctcgctactcgtagtaggacgacaacgaactaccacctactctaccgttcggaccggtactaacggtacacgtaacgtaagtttaaaggttaacttttaaagttttaaagttaggttaactacggtaagaaccgaaacggaaaaccggaacggggtaaaccacccccgttaacgtccttacggtacgtacgttacgttaggtcgggtactactacgttaccgtttaaggtttaacggaaccggtaacgggtacccgggtaccctaagttaaccgtaacgggttacgacggcggtacgtaggtcgggtccgtagggtacgggatacgtttcttacctccgttactaccgactacgtaccacgtcgtaactccaacgttacgtattacgttcttactactaaccttcgtacgtacttaaccgaagttcggttacttacggtacccgtacccgggttccggtacggttaccgaccgggtaggtaaccgaagggtacgtaaccaacggtaaaccgtaacggttaggcggttaccggtacacccgtaacttaacccttggttacctcctttcgtaaccccg

SEQ ID NO: 179173 - DNA, 724 bp, Homo sapiens
  misc_feature: GYAE6OF01EOQOO.15.83.H06.1.454.CMB.1.raw
  modified_base (141)..(141): a, c, t, g, unknown or other
  misc_feature (141)..(141): n is a, c, g, or t
  modified_base (170)..(170): a, c, t, g, unknown or other
  misc_feature (170)..(170): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (429)..(429): a, c, t, g, unknown or other
  misc_feature (429)..(429): n is a, c, g, or t
tcagtctacgtagccacgaccggtgctcgatttagatcacgtgcgtcgcggggggcaggagtcagtctcagtcaggacacagcatggacatgagggtccccgctcagctcctggggctcctgctactctggctccgagganccaaaagtgtgacatccagactcgacccngttctcctactcctccctgtctcgcatctgtacggagacagaatccacactcacgtgccgtnaacgtnagaactattaagatttattaagtgtactgagacaacgaaaccgacggaactacccaagctacgtagtactctagtggtttacacttcctaagtttgtacctaaaggcgggtaccccgtatacgtaacggtttccaaggtggacctggtacggctcggtagggtacacggttatttcaacgtctactaaccnctacgacgaccgacgttccgtaaccctaacttcgaaacggttattttacgacctttaacgttaaccttaaaccgttcgttaaccgtaaacgtaacgtttacggttttaacccgacggtttaaaccggggttacccccgggttaacggttaccccgggtttaccggaaacggggaaacccggttagggtaaaccggtaccggtaaaccgtttaacgacggtaaaacccgttacggttaccgggttaccgacggttccgaaacccgttctacggtttcttcccgtttcttaacccgg

SEQ ID NO: 179174 - DNA, 786 bp, Homo sapiens
  misc_feature: GYAE6OF01BFUG5.15.83.H06.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagtctacgtagccacgaccggtgctcgatttagatcacgtgcgtcgcgggggcaggagtcagtctcagtcaggacacagcatggacatgagggtcccccgctcagctccgtggggctcctgctactctggctccgaggagccaaatgtgacatccagatcgaccctagtcctccatccctccctgtcctgctatcgtggtaggagacagaatccacatcacgttcggaccggtnaacgtnaagaactagttaaggtaatttaatttaaagttggtaactcaagacaaacggaaaaccgaacgggaaaccgtacccctaacgtccttaccgtagtacttactacggtgtaccgtactaacgttaccgttaaggtttacgaaccggtaaacgggtcccgggtaacccctagttaacggttaacggttcgtagggtacgacggtaggtcgggtacgtacggtagggaacttaggttacctttccgtacttaccgactactacgtacgaacgtcctaacgttaccctaacgaaccgtttaaggtacgtttacgttaccgtaacccttaaacgtttaccgttaaccgttacgtaacctaacgtttaacggttaccgtttaccggtacgggttaaccccggtaacccgggtttaccggtaaccggggtaaccccgaaacggggttaacccggtaagggtaccggtaaccgtaaaccgtaaacgggtaaacctaacgggtcggtaaccgctacccggtactacccggtatttccttcggttaccttacccg

SEQ ID NO: 179175 - DNA, 173 bp, Homo sapiens
  misc_feature: GYAE6OF01D68ER.15.83.H06.1.454.CMB.1.raw
  modified_base (102)..(102): a, c, t, g, unknown or other
  misc_feature (102)..(102): n is a, c, g, or t
  modified_base (140)..(140): a, c, t, g, unknown or other
  misc_feature (140)..(140): n is a, c, g, or t
  modified_base (148)..(148): a, c, t, g, unknown or other
  misc_feature (148)..(148): n is a, c, g, or t
  modified_base (154)..(173): a, c, t, g, unknown or other
  misc_feature (154)..(173): n is a, c, g, or t
tcagtctacgtagccacgaccggtgctcgatttagatcacgtgcgtcgcgggggcaggagtcagtctcagtcaggacacagcatggacatgagggtccccgntcagctcctggggctcctgctactctggctccgaggancaaatgtnacatcnnnnnnnnnnnnnnnnnnnn

SEQ ID NO: 179176 - DNA, 765 bp, Homo sapiens
  misc_feature: GYAE6OF01ACKUY.15.83.H06.1.454.CMB.1.raw
  modified_base (250)..(250): a, c, t, g, unknown or other
  misc_feature (250)..(250): n is a, c, g, or t
tcagtctacgtagccacgaccggtgctcgatttagatcacgtgcgtcgcgggggcaggagtcagtctcagtcaggacacagcatggacatgagggtccccgctcgagcctccgtggggctcctgctactctggctccgaggagccaaatgtgacatccagatcgacccagtcctccagtccctcccttgctagcacgtctaggtacggagactacgaactccacctatccgtacgttacggccccggtanaacggttacaagtaaactagttaagtaaactttaatttaaagttcggtaattcacggtacaacgtaaaaccgacgggtaaaccgccccgtaaggtcctccgtagtactacgttacgtcggtacgacctaaccgtccgttagttacggaaccgttaacgggcccgggtaacccttacgtaacggttaacggttacgtacggtacggtaggtaacggtcggtcgtaccgtagggtacacgttacgtttcaccgtttacaccgtacacgtacgacgtacctacgtcctaacaaccgggttataacggttactttacggaaccctttaagttacctagtactaacgacgtacggttaacgttccgtaaccgttaccgggtacccggttacgtacccgggttacggaaaccggtaccgggtagttaaccggaacgtaccgtaaaccgggtaacgttaacggttcggtaacgggtcctaacgggtccccaacccttaagtccgttacccacgtttacccgg

SEQ ID NO: 179177 - DNA, 855 bp, Homo sapiens
  misc_feature: GYAE6OF01DRFXQ.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagcctcctggggctcctgctactctggctccgaggagaccaaatgtgacatccagactcgacccagtcctccatcctccctgtcctgcatctaggtaggagaacagaactccaaccatcctacgttcggacccggtacaacgtacgaacgtaaactaagtttaaaggttaaattttaagtttttaaaagttaggtaacgtccgtaagaaccgaaaacggaaaaaccccggtaaacggggaaaaccccgtaccccccgttaaaggtccccgttaccttacggtaacgtttaccgttaaggttacggttcgtaactaacctttaccggtttagtttacgggaaccgtaaaacggggtccccggggtaaccccctaagttaccggttaacgggttacccgtaagggtcgggaccgtaggttaccgggcctttaccggggagggtaacctagttaaccgtttccaaccgttacctaacccaccgtacgtaccgaacgtcgtaaccgttccctaacccgtaaacgttagtaacgttttagttacaacccgtttaaactttaccgtaacgtcgtaacctaacggtacttaacggtttaccgaacggtttaccccgggtaaccccgggttaccgttaaccggggtacccggaacgggtaacccgtaacgggttacgaaccgtaaacgtaaccgtaacgtaacgttgggtacccggtactaccggtacccctacttacgtcgttccgtcccgttaaccc

SEQ ID NO: 179178 - DNA, 824 bp, Homo sapiens
  misc_feature: GYAE6OF01AZN7C.15.83.H06.1.454.CMB.1.raw
  modified_base (141)..(141): a, c, t, g, unknown or other
  misc_feature (141)..(141): n is a, c, g, or t
  modified_base (217)..(217): a, c, t, g, unknown or other
  misc_feature (217)..(217): n is a, c, g, or t
tcagtctacgtagccacgaccggtgctcgatttagatcacgtgcgtcgcgggggcaggagtcagtctcagtcaggacacagcatggacatgacgggtccccgctcagctcctggggctcctgctactctggctccgaggancctaaatgtgacactccgagatcgacccagtcctaccacttccctcccgttgtctcgcctatcgttaggtaggaanacgtaacgtaactccacctatcctacgttcggccggttacaaacgttacgaataaacgtagtttaagttaaattttaagttttaaaagttcggtatacggtaactaacgaaaccggtaaaacggaaccgggtaaacctacccccttaaggtacccttaccgtacttacgtacgttacggtcggtactactaaccttcgtagtttacggaaacgtaccgggtacccgggtcctaaacggttacggtacgtacggtaaggtcggtaacgtacggttcggtaccggttacgggagttaacgtacggttaactcctaccgtactaccgtactagtacacgtacctaccgtacctaaccgaaacgtacgttaacgtttacggttactaacctttaaccgtaacgttctaacggttaaccgtaacggttaagtttaacccgttacgggaaacccgtttacccggttacccggttaccggttaccggaaccgttaaccgggtaccggaaacggttcggaaaccgttaacgtaaaacgtaacccgggttaacgtggttaacccggagttaacccggccttaaacgtccgttaaccgttcggttaaccgttacccg

SEQ ID NO: 179179 - DNA, 1051 bp, Homo sapiens
  misc_feature: GYAE6OF01EWN1G.15.83.H06.1.454.CMB.1.raw
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
tcagtctacgtagccacgaccggtgctcgatttagatcacgtgcgtcggcgggggcaggagtcagtctcagtcaggacacagcatggacagtggacgggtccccgctcagtcctccgtgggcctcctgcctactcgtggcctccggaggacgactaaattggtagactacgtaccgagtactacgaccctagtcctacctacgttccctccgtgtactgactntcgtaggtaagacaacagaactccaacgtctactacgttccggtaccgtaanaacgtacgaacgtaacttagttaagtaacttttaagttaaagttcgaactacgaagtaaccgtaaacggaaacggaacggtaacccgacccttacgtccgtaccgtagtacctacgttaacggtcggtaacgtaccttaacgtttaccgtagttaacggaaccggttaaaccgggtcccgtaaccgtagttaacggttaacggttacgtaccgggtacggtaaccggtcgggttaccggttaccggtaacggttacgggttaaactaccggttttaactaacccgttaaccccggttaccgtaccctaaccggttaaccgtacggttaacccgtaacccggtttaacccggttaaccctaaacccgttaaacgggttttaacgtttaaaccgttttcccggttttaaaccttaaaacccccggttttaacgttttaaaccctttaacccgggggtaacccgttttaaaccgtaaaaacggggtttttcccgttttaaaccggggttacccccggtaaacccgggggtttaacccccgggttaccccggggttttaaacccggggtaacccccggtaaaccggggggttaaaccggtaaaccccgggtttaaacccgggggtaaacttaaaccccggggtaaaaacccgtttaaccggaaaaaccgggtttaaccgggttcggggtaaccccgggtttacccgtaaaccccgaaaccccggtttacgtttaaaccccgggttttccccccgtttaaaggttccccgtttaaaccccg

SEQ ID NO: 179180 - DNA, 762 bp, Homo sapiens
  misc_feature: GYAE6OF01BT1GT.15.83.H06.1.454.CMB.1.raw
  modified_base (104)..(104): a, c, t, g, unknown or other
  misc_feature (104)..(104): n is a, c, g, or t
  modified_base (114)..(114): a, c, t, g, unknown or other
  misc_feature (114)..(114): n is a, c, g, or t
  modified_base (145)..(145): a, c, t, g, unknown or other
  misc_feature (145)..(145): n is a, c, g, or t
  modified_base (744)..(744): a, c, t, g, unknown or other
  misc_feature (744)..(744): n is a, c, g, or t
tcagtctacgtagccacgaccggtgctcgatttagatcacgtgcgtcgcgggggcaggagtcagtctcagtcaggacacagcagtggacatgacgggtccccgntcagctccgngggctcctgctactcgtggcctacggagganaccaaagtgtagacagtccagtatcggacccagtcctcccactcccgtccctgtcctgctagttcgtggaggacaactagaactaccacctagtctacgtcggaccgtaacagtacaagtaaacgtagtttaacgtaaattttaatttaagtgtactaggaacacgaaacggtaaaccgaacggggtaacctaccccgaaggtccttacggtactagtactggtcggtacgaacctcgttcgtaagttcgaacggttacggccgacctagtaacgtacggagtcggagttacgcggtgtccggtagttacggaccgttagttacctttacctcctaccgtaacgtactcggtacctacggtaccttcgttaacccgtaacgttaacccgtaagggttaactttacttaacggtaaccctttaaatacccgtacgtactaagttaacggttaccgttaacggttacgtacccgggtttacccgggacccgttcgggaacccggttaacggaaaccggggtactaaacgggttaacaacccggtcgtaaaccgtaagaccgggtttaccgacgggtttccacggtaacctacgtaccgttnttacccgttacgttaccg

SEQ ID NO: 179181 - DNA, 821 bp, Homo sapiens
  misc_feature: GYAE6OF01B6ZZ1.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggacgccaaatgtacgacactccagactcgacccctagtcctaccactccctccgtgtctcgtctactcgtaggtaggacgacctaagaactaccgaacctagtacctacgttcggaccgttaacgaagttaccgaacgtaaacgtagtttaaaggttaaattttaagttttaaaacgttggtaaccgtcgtaacggaaccgtaaaacgggaaaacccgggtaacggggaaaacccctacccccgttaaaggtcccgttaccgtagggtttaaccttccggttaaggtcgggtaaccacgttaacgtaccgttaaggtttacgaacggtaaacggggtccccggacctaacgtacggttaacggtagtagggtccggtacgtcgggtcgtccggtaacggtagggtaaaccctggtttacccttaccggtaacctttccgaaccgaactaccgtccgaacttacccgtacgttaccaacccgttaaaggtcgttaactttaccgttaacgtaacctttaacttcgtaaccgtttcgaaccctagttacgttaacgtaccggtaccggttacccgaccgggttacgtacccggaacgtaacgggtacgtagtaaccgacgtacgtaaactacgggcgttgtaccggacctacggtaccctccgtagtacccgttcgttaccgtccg

SEQ ID NO: 179182 - DNA, 743 bp, Homo sapiens
  misc_feature: GYAE6OF01CC2NN.15.83.H06.1.454.CMB.1.raw
  modified_base (243)..(243): a, c, t, g, unknown or other
  misc_feature (243)..(243): n is a, c, g, or t
tcagtctacgtagccacgaccggtgctcgatttagatcacgtgcgtcgcgggggcaggagtcagtctcagtcaggacacagcatggacatgacgggtccccgctcacgctccgtggggctcctgcctactcgtggcctccggaggacgaccaaagtgtgacatccagatcgaccctagtcctccatccctccttgtctgcagtcgtaggtagagacagatccaccatcacgttcgaccggtanactacgaagtaactaagtttaaggttaatttaactttaacgttaggtactacgaaggaacgaaacggtaaaccggaacggtaacccgtacccctaaggtcccgttaccagttactacgtaggtcggtacactacgtaccgttggttaacgacgttaaccggggtcccggtaccctaaggttacggtaacggttcgacgggtcggacttagggtccggtacgtacgggacggtaacttacgttacgttaccctacacctactaaccacgtcagtacctacgtccgtaaccgtaacgttacgtaatttcgttaactacccgtttaacttacctagttacctaaccgtagtacgtttacggttaccgtaccggtaccccggttacccggtacggttaccccggacgtaacgggacgttaaccgggtacgacgtaacgaaccggtaagttacccgtgggccctacggtacgtacccgttacactttcctcgtttccttaccccg

SEQ ID NO: 179183 - DNA, 605 bp, Homo sapiens
  misc_feature: GYAE6OF01EV94T.15.83.H06.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtcctccatcctcctgtctgcatctgtaganacagaancacatcagttcgcggtcaagtcaagaactataggaattattaagtgtatnagnagaaacgaggaacgcccgtaagctcctgactctagtggtgcgatcctagtttacgacgaaacggtcggggacccctagtaccgtaaggttacgaggttaggacgtaggtcggtacgtcggtagggtacgtagactttactaactcttacaaccctacgtacacggtactacggtacctaccaactaacgtaagttacgtttacgaacttaacgttacttaactacgtaacaacgtaagttacgttacgtacggttaccgtacccgggttacgtacggtaccgaacggtaacgtaacggtagacgaacgtactaacgaacgtgaggtacagtcactatctcgtgttacc

SEQ ID NO: 179184 - DNA, 762 bp, Homo sapiens
  misc_feature: GYAE6OF01CVWCK.15.83.H06.1.454.CMB.1.raw
  modified_base (279)..(279): a, c, t, g, unknown or other
  misc_feature (279)..(279): n is a, c, g, or t
  modified_base (340)..(340): a, c, t, g, unknown or other
  misc_feature (340)..(340): n is a, c, g, or t
  modified_base (730)..(730): a, c, t, g, unknown or other
  misc_feature (730)..(730): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctatctgctcgaggagccaatgtgacatccagatgacccagtcctcctactcctcctgtctcgactatcgtggtaggagaacgagaaactccgacctatctacttcggaccgtgaagtcgagaacgtattaagttaattaatttaaacgtggttacanacgacaacgaaacgaacggtaaaccaccctaagtcctactaggactctaggttaggcacgngtacgtacgttacgacgaaacgggttccgacctaacgttcggtaaggttacgtaagggcgtaccggtaagtcgggtacctagggtcgggaacttaggtactttaccaccgttcgttaaccggaacctacgtacgaaccgtacttaaccccgaccgttaaaccgaaccgttaaaggtttaaccgtttacggttaaaccgtttaaccgtaacccttaccggtttaactacccgggtaaactaaaccggttagttaacccgtttaccggacggttaaccccggttacccggtacggttaacccggccgtaaaaccgggtaacgttcggggtaaactaacccgtaacggaaacggttaaacaagggtttcggaaccgtactcggttaaaccccncgttaaaccgtttggacccgttttagtacccc

SEQ ID NO: 179185 - DNA, 782 bp, Homo sapiens
  misc_feature: GYAE6OF01ENERW.15.83.H06.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (338)..(338): a, c, t, g, unknown or other
  misc_feature (338)..(338): n is a, c, g, or t
tcagtctacgtagccacgaccggtgctcgatttagatcacgtgcgtcgcgggggcaggagtcagtctcagtcaggacacagcatggacatgagggtccccgctcagcctcctggggctcctgcctatctggctccgaggagcaaatgtgaccatccagatcgacccagtcctccactcccgtcctgtctgctatcgtggtagganacagaatccacatcacttgccgtanagtanaagactaagttagtaattaattttaaagttaggtanactagacaacgaaaccgaacggaaacgtacccccgtaagcctacctagacttacgtaggttcggtancctacttaccgtagtttaccggaacgtaaccgggtaccgggtaacccctagttaacggttaacgggttacgtaggggttcggtaactagggttacggtcgttaaccggttacggggaaacgttaaggttacttttaccgtacccgtttacctaccgaacccgtaacttacgacgttaccggtaaccgtacccctaacccggtaaccgttaagttaacgtttaacggttttaccggtaaacctttaaccgtttaaccttactttaaccggtaaacgtaaccgtaaggtttaacttacggttaaccggtccccgggttaacccgggttacggtccgggttaaccgaaccggggtaacgaacgggttccgaacgttaacgaaccgtaaacggacggttagggacccgtcggtaacgccgttaacgacttacgtttcgtacctttacg

SEQ ID NO: 179186 - DNA, 757 bp, Homo sapiens
  misc_feature: GYAE6OF01BH0OO.15.83.H06.1.454.CMB.1.raw
tcagtctacgtagccacgaccggtgctcgatttagatcacgtgcgtcgcgggggcaggagtcagtctcagtcaggacacagcatggacatgagggtcccccgctcagctcctggggctcctgctactctggctccgaggagccaaatgtgactatccagatcgacccagtctccatcctcctgtctgctatctaggtagagacagaatcacatcgacttcggccgtataacgtcaagaactagttacggtaattaatttaaagtcggtatacgtaagacctaacggaaaccgaagggaaaccgtaccccgtaagtacctccgtaagtactaccgttaacggtacggtcgtaactagttaccgtaaggttacgaaccggtaaggtccggggtaccctaagtaccgtaaggttacgtaaggtggtaccgtagggtacgttcgacggttagggaacctagttaaccttacggtactacgtaaccgtaactcgtaacgtacgtacgtacgtaaccgtaccgtaaactacggtaacgtttacgttaacgaacgtttaacctttaacggtaacctacggtaaccgtaacgttaacggttacgttaaacccgaccgggtttaacccgggacccttacgggttacccggtaaccggttaaccgggaaaccgtacgggtaaaccgtaagtaccgtaacgtaaaacgttacgtaccggtaggtaccgtacgtacccgttaactacgttacgtcgttaccgttaaccg

SEQ ID NO: 179187 - DNA, 506 bp, Homo sapiens
  misc_feature: GYAE6OF02FVDY0.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtgggccccatcaaggttcagtggcagtggctctgggacagatttcactctcaccatcagcagtctccaacctgaacgattttgctaacttactactgtacaacagtagtttcagtacgtcccggacgttcgaccaacggaccgaggtagacgacgtacaaacgaacgtgtaggctcgcaccatctgtcttc

SEQ ID NO: 179188 - DNA, 540 bp, Homo sapiens
  misc_feature: GYAE6OF02H75L7.15.83.H06.1.454.CMB.1.raw
  modified_base (391)..(391): a, c, t, g, unknown or other
  misc_feature (391)..(391): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaatttatttaaattggtatcagcagaaaccagggaaagcccctaagcctcctgatctatggtgcatcctagtttgacaaaggtcggggccccatacaaggttcaggtggcagtggctcgtgggacagtatttcacttctcacatcagcagtcnccaactgaagtattttgactaacttacttactgtacaatagtagtttcagtacgtccccggtagttcggaccaacgggtaccaaggtacggactagtaccgaaacgtaacgtcggttacgcgttagcctaccgtaatcttcgtcttacc

SEQ ID NO: 179189 - DNA, 495 bp, Homo sapiens
  misc_feature: GYAE6OF02IGF6A.15.83.H06.1.454.CMB.1.raw
  modified_base (221)..(221): a, c, t, g, unknown or other
  misc_feature (221)..(221): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctatctgcatctgtaggagacagaatcaccatcacttgccggtnaagtcagaacattaggaattatttaaattggtatcagcagaaaccaggaaagcccctaagctcctgatctatggtgcatccagtttgcaaagtgggccccatcaaggttcagtgcagtggctctggacagatttcactctcacatcagcagtctccaacctgaagtattttgcaaacttactactgtacaacagagtttcagtagtccccggacgtttcggccaaggaccaaggtgacagtcaaacgaactgtagctgacaccatctgtcttac

SEQ ID NO: 179190 - DNA, 498 bp, Homo sapiens
  misc_feature: GYAE6OF02HJNR8.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacaggatttcactctcaccatcagcagtctccaacctgaagtattttgctaacttactactgtacaacagtagttcagtacgtcccgacgttcggcaacggacgaggtgacagtacaacgactgtgctcgacaccatctgtcttac

SEQ ID NO: 179191 - DNA, 544 bp, Homo sapiens
  misc_feature: GYAE6OF02HSJ1V.15.83.H06.1.454.CMB.1.raw
  modified_base (367)..(367): a, c, t, g, unknown or other
  misc_feature (367)..(367): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagccctaagctcctgatctatggtgcatccagtttgcaaagtgggccccatcaaggttcagtggcagtggctcgtgggacagtatttcacttcncacccatcagcagtctaccaacctgaagtattttgactaactttactactgtacaactagtactttcgacgttacggtccccggtacgtttccggacctaaacgggaccgtaagggtacgacgacgtacaaaccggaactggttacggcgtacgacctaccattcgtcgttcttacc

SEQ ID NO: 179192 - DNA, 500 bp, Homo sapiens
  misc_feature: GYAE6OF02IJOXL.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctaccaacctgaagattttgctaacttactactgtacaacagagtttcagtacgtcccggacgttcgccgaaggaccaaggtcgacagtcaaacgactagtggctgcaccatctcgtcttc

SEQ ID NO: 179193 - DNA, 552 bp, Homo sapiens
  misc_feature: GYAE6OF02IM2Q9.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccggtcaagtcagacattaggaattatttaattggtatcagcagaaaccagggaagccctaagctcctgatctatggtgcatccagtttgacaaagtggggccccatcaaggttcagtggcagtggctctgggacagatttcacttctcaccatcagcagtctccaacctgaagtattttgactaactttactactagtactaacagtagttttaccagttacgtaccccggtacgtttccggaccgtaaacgggaccgtaaggtacgggaacacgtaaccgaaaccgaacttacggtcggtacgtcgacacccgtacgtacttcggttacttaccg

SEQ ID NO: 179194 - DNA, 517 bp, Homo sapiens
  misc_feature: GYAE6OF02JBKR4.15.83.H06.1.454.CMB.1.raw
tcagtctacgtagccacgaccggtgctcgatttagatcacgtgcgtcgcggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccggtcaagtcagaacattagattattaaattgtatcagcagaaaccaggaaagcccctaagctcctgatctatggtgcatccagtttgcaaagtcgggcccatcaaggttcagtggcagtggctctggacagatttcactctcaccatcagcagtctccaactgaatattttagactaacttactactgtacaacagtagtttcagttacgtccccggtacgttcggacctaagggaccgaaggtacggaactacgtacaaacgtaacgtacgtaggacgtcgacaccagttactgtcttac

SEQ ID NO: 179195 - DNA, 544 bp, Homo sapiens
  misc_feature: GYAE6OF02H8ZRN.15.83.H06.1.454.CMB.1.raw
  modified_base (222)..(222): a, c, t, g, unknown or other
  misc_feature (222)..(222): n is a, c, g, or t
  modified_base (376)..(376): a, c, t, g, unknown or other
  misc_feature (376)..(376): n is a, c, g, or t
  modified_base (539)..(539): a, c, t, g, unknown or other
  misc_feature (539)..(539): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattagaattatttaaattggtatcagcagaaaccaggaaagcccctaagctcctgatctatggtgcatccagtttgacaaaggtcgggccccatcgaaggttcagtggcagtggctgtggacagtatttcactctcaccatcancagtcctaccaactgaagtatttgacctaacttacttactgtacaactagtagtttcacgttacgtccccggacgttccggccgaagggaccgaacggtaggacgaacgtacgaaaccgtaacgtaggtacggtacgtacgcgaaccctacttacttacgttnttacc

SEQ ID NO: 179196 - DNA, 723 bp, Homo sapiens
  misc_feature: GYAE6OF02GVV4D.15.83.H06.1.454.CMB.1.raw
  modified_base (257)..(257): a, c, t, g, unknown or other
  misc_feature (257)..(257): n is a, c, g, or t
tcagtctacgtagccacgaccggtgctcgatttagatcacgtgcgtcgcgggggcaggagtcagtctcagtcaggacacagcatggacatgagggtccccgctcagcctcgtgggctctgctactcgtggcctcggaggacgaccaaagtgtgacactccaagatcgacccgtagtcctccacttccctccctgtctgctattcgtggtaaggacgaacgaagtaactccaacctatacctacgttcggcccggtanaacgtcaagaactagttaaggtaatttaatttaaagttggtatacagacaacgaaaccggaagggaaccaccccgtaagtcctaccgtagtactactagtcggtcgactactccgttaggttcgaacgtaacggggtccggacccctatacgtaacggttcgaggtcggacgtaggtcggtccgttacggtacggggaactaaggttactttaccgaccttccgtacccaacctataccgacgtacctacgttacctaccctaacgtacgtaaagttacgttttacgaacccttaaactttacctacgtcgtaaccaaacgttaggttacgtttacgaacggttaccggttacccccgggtagttacccggaccggaaacgggtaccgtaagggtacggaactacgtaacgaaacgtacggtggtacgacgtacgacctacctacgttcgttacgttacttaaccg

SEQ ID NO: 179197 - DNA, 535 bp, Homo sapiens
  misc_feature: GYAE6OF02G0SAR.15.83.H06.1.454.CMB.1.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtnaagtcagaacattaggaattatttaaattggtatcagcagaaaccagggaaancccctaagctcctgatctatggtgcatccagtttgctaaaggtcggggccccagtacaaggttcagtggcagtgctgtgggacagtatttcactctcaccatcagcagtcctaccaactgaagtatttgacctaacttactactgtacaactagtatttcaagttacggtcccggtacgttcggaccgaaacgggaccgtaaggtacggactacgtaccgaaacgtaacgtgtacggctacgcaccagtctcgtattaccg

SEQ ID NO: 179198 - DNA, 565 bp, Homo sapiens
  misc_feature: GYAE6OF02JCW16.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcgaagttcagtggcagtggctcgtgggacagatttcactctcaccatcagcagtctccaacctgaagtatttgactaaacgttactacttgtacaactagtacgttttcaacgttacggtaccccggtacgtttccggacccgaaagggacccaacgggtacggaaccacgttacgaaaaccggtaacgttacggtaggtccgtacgacctaaccctaagtccttacgttcctttaccg

SEQ ID NO: 179199 - DNA, 530 bp, Homo sapiens
  misc_feature: GYAE6OF02I318I.15.83.H06.1.454.CMB.1.raw
  modified_base (526)..(526): a, c, t, g, unknown or other
  misc_feature (526)..(526): n is a, c, g, or t
tcagtctacgtagccacgaccggtgctcgatttagatcacgtgcgtcgcgggggcaggagtcagtctcagtcaggacacagcatggacatgggggtccccgctcagctcctggggctcctgctactctggctccgaggagccaaatgtgacatccagatgacccagtctccatcctccctgtctgcatctgtaggagacagaatcaccatcacttgtcggtcaagtcagaacattaggaattattaaattggtatcagcagaaaccaggaaagcccctaagctcctgatctatggtgcatcagtttgacaaagtggggacccatcaaggttcagtggcagtggctcgtgggacagtattcactctcaccatcagcagtctccaaactgaaagtattttagactaaactttactacttgtaccaacagtagtttacgagtacgtcccggacgttccgacgaaacggacgaaggtcggacacgtacgaaacggtaactacggtaggctgacgacctagtctcgttctntacg

SEQ ID NO: 179200 - DNA, 534 bp, Homo sapiens
  misc_feature: GYAE6OF02I9JRI.15.83.H06.1.454.CMB.1.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtcaagtcagaacattaggaattattaatgtatcagcagaacaggaaanccctaagctactgatctatggtgcatccagtttgcaaaggtcgggcccatcgaagttcagtggcaggtcgctcgtgggactagtactttcactctctaccatcagactagtctaccaactgaacgtatttgactaacttactactgtacaacagtagtttacagtacgtccccggtattcggacgtaacggacgtaacggtcgtaccgacttacgaaacgtaacgtagtacggtctacgtacctacctactcgttacgttcgtacc

SEQ ID NO: 179201 - DNA, 513 bp, Homo sapiens
  misc_feature: GYAE6OF02FOP8C.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattatttaaattggtatcagcagaaaccagggaaagcccctaagctcctgatctatggtgcatccagtttgcaaagtgggccccatcaaggttcagtggcagtgctctgggacagatttcactctcacatcagcagtctccaacctgaagtattttgactaacttactactgtacaacagtagtttcagttacgtcccggtacgttcggaccgaacggaccgaacggtaggacagtacaaacgaacgtagtgcgtcgctaccgatctgtcttac

SEQ ID NO: 179202 - DNA, 519 bp, Homo sapiens
  misc_feature: GYAE6OF02HVJZZ.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctagcatctgtaggagacagaatcaccatcacttgccgtnaagtcagaacattaggaattatttaaattggtatcagcagaaaccagggaaagcccctaagctcctgatctatggtgcatccagtttgcaaagtcgggccccatcaaggttcagtggcagtggctcgtgggacagatttcactctcaccatcagcagtctaccaactgaatatttgctaaactttactactcgtacaactagtagtttcaggttacgtccccggtacgttccggcctaaagggaccaagggtggaacagtcaaacgactagtaggctagccaccgatctgtcttacc

SEQ ID NO: 179203 - DNA, 502 bp, Homo sapiens
  misc_feature: GYAE6OF02H8QQN.15.83.H06.1.454.CMB.1.raw
  modified_base (498)..(498): a, c, t, g, unknown or other
  misc_feature (498)..(498): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccaggaagcccctaagctcctgatctatggtgcatccagtttgcaaagtgggcccatcaaggttcagtggcagtgctctgggacagatttcactctcaccatcagcagtctccaacctgaagtattttgactaacttactactgtacaacagtagtttcagtacgtcccgacgttcggcgaaggaccgaaggtacgacagtacaaacgactagtgactcgacgaccatctgtnttac

SEQ ID NO: 179204 - DNA, 511 bp, Homo sapiens
  misc_feature: GYAE6OF02FQ6IT.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaaggtgggccccatcaaggttcagtggcagtggctcgtgggacagatttcactctcacatcagcagtctaccaactgaagtatttgctaacttactactgtacaacagtagtttctagtacgtcccgtacgttcgaccgaacggaccgaaggtgacgagtacaacgaacgtagtcgctcgacaccactctcgtcttacc

SEQ ID NO: 179205 - DNA, 516 bp, Homo sapiens
  misc_feature: GYAE6OF02H0LY6.15.83.H06.1.454.CMB.1.raw
tcagtctacgtagccacgaccggtgctcgatttagatcacgtgcgtcgcgggggcaagagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaacgcccctaagctcctgatctatggtgcatccagtttgcaaagtgggccccatcaaggttcagtggcagtggctcgtgggacagtatttcactctcaccatcagcagtctaccaactgaagtatttgactaacttactactgtacaacagtagtttcagttacgtcccggtacgttcggacgaacgggaccaaggtcggacacgtacaaacgactagtaggctacgcacctatcctgtcttac

SEQ ID NO: 179206 - DNA, 695 bp, Homo sapiens
  misc_feature: GYAE6OF02F2D2Q.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaaaccaccgtaagcctcgtagtactactagtggtcgactactaccgttagttcgaacgtaagggtccgggaccctacgtacgtaacgttacgaggtcggacgtaggtcggtctacgggtacggaacgtagttacgtttaccacttccgtaccctaactactaccgacgtaccgtaacgttccctaaccctaaacgtaccccggaaagtttacgtttacgtaacccttaaaccgtttaaccttaaccgttacgtaacctaaacgtaaggttacgtttacgtaacgggttaccccggtacccggttaccggttaccgtaaccggtaaccggtaaccggtaacgggtacgaacgtaacgtaacgaaaccgtaacggtacggtacggtacgtacgaccgtaccgtacgtcgttacgttaccttaccg

SEQ ID NO: 179207 - DNA, 642 bp, Homo sapiens
  misc_feature: GYAE6OF02JH6O6.15.83.H06.1.454.CMB.1.raw
  modified_base (198)..(198): a, c, t, g, unknown or other
  misc_feature (198)..(198): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatctgtagganacagaatcaccatcacttgccggtcaagtcagaacattaggaattattaaattggtatcagcagaaaccagggaaagcccctaaagctcctgatctatggtgcatccagtttgcaaagtggggaccccatcaaggttcagtggcagtggctcgtgggacagatttcacttctcaccatcagcacgtctaccaacctgtaaacgtattttacgacttaaaccgtttaacctacctttaggtccctaaaacgacgttaacgttttacgaacggtttacggttacccccggggtaacgttttccgggacccgtaaacggggtaaccgtaaaccgggttaggggtaacccaacgttaacccgtaaaaccggtaaaccgttcggttaacgggtacccgttacggtacccgtaacccgtacgtttaccgtttacggttacttttaacccg

SEQ ID NO: 179208 - DNA, 590 bp, Homo sapiens
  misc_feature: GYAE6OF02FXY8D.15.83.H06.1.454.CMB.1.raw
  modified_base (387)..(387): a, c, t, g, unknown or other
  misc_feature (387)..(387): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagttttgctaaagtggggccccatcaaggttcagtggcagtggctcgtgggacaggatttccactctcaccatcagcagtccnccaacctgaacgtattttacgactaaacgttactacttcgtacaaacgtagtaagtttccagttaaccggtccccggtacggtttccggaccgaaacgggtacccgaagggttacggaaccgtaacgttacgaaaaccgtaaaccgttcggttacggacgtacggtaccgaacccgtacttccgttaccggttctttaacccg

SEQ ID NO: 179209 - DNA, 556 bp, Homo sapiens
  misc_feature: GYAE6OF02F6XZ4.15.83.H06.1.454.CMB.1.raw
  modified_base (230)..(230): a, c, t, g, unknown or other
  misc_feature (230)..(230): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccgtcaagtcagacntagattattaatgtatcagcagaaccaggaacgccctaagctcctgatctatggtgcatccagttgcaaagtcgggcccatacgaaggttcagtggcagtggctcgtgggacaggtatttcactctcaccatcagtcacgttcctaccaaccttagaacgttattttagacctaactttaacctaacttcgttaccaacgtagtaagtttcaggttacggtccccggtacgttcggtaccgaacgggtaccgtaggtacggaacgtacgtaaccgaaaccgtaacgtggtacgacgtacgaccgacctacgtcttcgtacgttacc

SEQ ID NO: 179210 - DNA, 557 bp, Homo sapiens
  misc_feature: GYAE6OF02FWSWP.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattagaattattaaattggtatcagcagaaaccagggaaagcccctaagctcctgatctatggtgcatccagtttgcaaagtgggccccatcaaggttcagtggcagtggctctgggacagtatttcactctcaccatcagcagtctccaacctgaagtattttgactaaacgttactactgtacaactagtagttttcaagttacgtccccggtaacgttccggaccgaaacgggaaccgaacggttagggaccgtaagtaaccgaaacggtaaccgtaggtacggtacgtacggcctaacccgactaccgttcgtctttaccg

SEQ ID NO: 179211 - DNA, 502 bp, Homo sapiens
  misc_feature: GYAE6OF02HNM7Y.15.83.H06.1.454.CMB.1.raw
  modified_base (393)..(393): a, c, t, g, unknown or other
  misc_feature (393)..(393): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattattaaattggtatcagcagaaaccagggaaagcccctaagctcctgatctatggtgcatccagtttgcaaagtgggcccatcaaggttcagtggcagtggctctgggacagtatttcacttctcaccatcagcagtctaccaactgaagtntttagctaacttactactgtacaatagtatttcagttacgtcccggagttcggaccaacgggacaaggtgacagtcaaacgtactgtagctcgcactatctgtcttacg

SEQ ID NO: 179212 - DNA, 648 bp, Homo sapiens
  misc_feature: GYAE6OF02J0M15.15.83.H06.1.454.CMB.1.raw
  modified_base (224)..(224): a, c, t, g, unknown or other
  misc_feature (224)..(224): n is a, c, g, or t
tcagtctacgtagccacgaccggtgctcgatttagatcacgtgcgtcgcgggggcgaggagtcagtctcagtcaggacacagcatggacatgagggtccccgctcagctcctggggctcctgctactctggctccgaggagccaaatgtgacatccagatgacccagtctccatccctcctgtctgcatctgtaggagacagaatcaccatcacgttgccggtnaagtcagaacattagaattattaatggtatcagcaagaaaccagggaaacgaccctaagactctagatctagtggtagcattccagtttgacaaaggtcgggacccctatacgtaaggttcgagtggctaggtggtctcgtagggactacggtatttacacttcgtacctaaccgacttcgacgtacgacgttacctaccccgtaaactcggtaaagttaattttcgtaaccttaactttaaccgttaactcgtaaccgtaaactaacgtttacgtttaccgtaaacggttaccggttacccccggtaaggtttacccggacccgaaacggggtaaccgtaacgggtacgtaacgtaaccgtaacgtaaaccaacggttacgacgttacgacgtacgaccttacggtctttacgtacgttaccc

SEQ ID NO: 179213 - DNA, 541 bp, Homo sapiens
  misc_feature: GYAE6OF02H31BF.15.83.H06.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
  modified_base (517)..(517): a, c, t, g, unknown or other
  misc_feature (517)..(517): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtagganacagaatcaccatcacttgccggtnaagtcagaacattaggaattatttaaattggtatcagcaagaaaccagggaaagcccctaagcctcctgatctatgtgcatccagtttgcaaagtcgggcccatacaggttcagtggcagtgctgtggacagtatttcactctcaccatcanctacgtcctaccaacctgtaacgtattttgactaacttactacttnacaatagtagtttacacgttacgttaccccggtagtttcccggacgtaaacgggtaccgaagggtcggaacgtacgtacaaaccggtaactggtacgntacgcgacctagtcttctcgttcc

SEQ ID NO: 179214 - DNA, 502 bp, Homo sapiens
  misc_feature: GYAE6OF02GC3TI.15.83.H06.1.454.CMB.1.raw
  modified_base (418)..(418): a, c, t, g, unknown or other
  misc_feature (418)..(418): n is a, c, g, or t
  modified_base (498)..(498): a, c, t, g, unknown or other
  misc_feature (498)..(498): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaacagggaaagccctaagctcctgatctatggtgcatccagtttgacgaaagtcgggccccatcaaggttcagtggcagtgctgtgggacaggatttcactctcacatcagcagtctccaacctgaagtatttgactaacttactactgtacaanagtagtttcagtacgtcccggtacgttcgacgaacggacgaaggtcgacagtcaaacgacgtagtgcgtgcacactcgtntctc

SEQ ID NO: 179215 - DNA, 544 bp, Homo sapiens
  misc_feature: GYAE6OF02FYDN1.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtgggccccatcaaggttcagtggcagtggctcgtgggacagtatttcactctcaccatcagcagtctaccaacctgaatattttgactaacttactactgtacaactagtagtttcagttacgtccccgggtacgttccggaccgaagggtacccaagggtacggaacgtagtaaccgaaacgaaccgttaggtacggtctaggaccaccgtactcttcgtctttaccg

SEQ ID NO: 179216 - DNA, 517 bp, Homo sapiens
  misc_feature: GYAE6OF02G5EM1.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcgactctcaccatcagcagtctccaacctgaagattttagactaacttactactgtacaacagtagtttacagttacgtccccggacgttccggccaagggtaccgaaggtcggacgatacgaacgtaacgtagtacggtctgcaccatctgtcttac

SEQ ID NO: 179217 - DNA, 551 bp, Homo sapiens
  misc_feature: GYAE6OF02HFUPM.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattatttaaattggtatcagcagaaaccagggaaagcccctaagctcctgatctatggtgcatccagtttgcaaagtcggggaccccatcaaggttcagtggcaggtggctcgtgggacagtatttcactctcaccatcagcagtctaccaacctgtaagtattttgactaacttactactgtacaaacagtagtttacaagttacgtaccccggtacgttccggaccgaacgggtaccgaagggtacggacgtaacgtacgaaacgtaacgtagtacggtactcggacctaccagttctacgttcttaccg

SEQ ID NO: 179218 - DNA, 588 bp, Homo sapiens
  misc_feature: GYAE6OF02IIYXI.15.83.H06.1.454.CMB.1.raw
tcagtctacgtagccacgaccggtgctcgatttagatcacgtgcgtcggcgggggcaggagtcagtctcagtcaggacacagctatggacatgagggtccccgctcagctcctggggctcctgctactctggctccggaggagccaaatgttgacatccagtatgacccagtactccatcctcctgtctgcatctgtagggagacagatcaccagtccattcgccgtcaagtcagaacattaggaatttatttaaattggtatcagcaagaaccagggaaacacccgtaagctcctgactcgtagtggtagcagtccagtttgaacaaaggtcgggaccccagtacgaaggttacagtaggactagtggctcgtggacaggtactttcacttctaccgactactcagcagtaccaccaactgaatactttgactaactttacaactacgtacaacgtagtacgtttacacggttaccgtacccggtaccgttccggacgtaaacgggtaccgtagggtcgaacgacgtaaccgtaaacgtacgtaggtacggtacgtacgtacacctaagtccgttacgtaccttacg

SEQ ID NO: 179219 - DNA, 572 bp, Homo sapiens
  misc_feature: GYAE6OF02JGUQZ.15.83.H06.1.454.CMB.1.raw
  modified_base (67)..(67): a, c, t, g, unknown or other
  misc_feature (67)..(67): n is a, c, g, or t
tcagtctacgtagccacgaccggtgctcgatttagatcacgtgcgtcgcgggggcaggagtcagtcncagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaaagctacctgatctatggtgcatccagtttgcaaagtgggccccatcaaggttcagtggcagtggctcgtgggacagatttcactctcaccatcagtcagtctccaacctgaagtattttgactaacgtttactactcgtaccaaacgtagtacgtttacaagttacgtcccccgggtagtttccggacccgtaaagggacccgtaaggtcgggtaacgacgtaaccgtaaaccgtaacgtacggtacggtaccgtcggtacgacccgattaccgttcggttaccttaccg

SEQ ID NO: 179220 - DNA, 773 bp, Homo sapiens
  misc_feature: GYAE6OF02HSVJP.15.83.H06.1.454.CMB.1.raw
  modified_base (221)..(221): a, c, t, g, unknown or other
  misc_feature (221)..(221): n is a, c, g, or t
  modified_base (282)..(282): a, c, t, g, unknown or other
  misc_feature (282)..(282): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctcctgtctgcatctgtaggagacagaatcaccatcacttgccgtnaagtcagaacattaggaattatttaaattggtatcagcaagaaaccaggaacgaccctaanctcctagatctatggtgctatcctagttttgacgtaaacggtcggggaccccctaagtaccgtaaagggtttaccgaaggttacgggacgtaacggttcgggtaccttcggttagggggtaacctaagggttacctttttaccgaacccgtttccttaaccctaaccccgtaattacccgaagtaccgtaacgttcccgttaacccgtaaaaccccgttaaggtaaacgtttaactttttttaacgggaacccttaaaccgttttaaccgtttaaaccgttacgtaacccttaaaacggtacggttaaaccgtttttacgaaaccgggtttaccggttacccccgggttacggtttacccgggaaccggtaaaccggggaaccggtaaacgggtacggtaaccgtaaccgtaaaccgaaaccggttaaacgttcgggttacggacgttaccgaccgtaacccgtacttacgttaccgttacctttaacccg

SEQ ID NO: 179221 - DNA, 584 bp, Homo sapiens
  misc_feature: GYAE6OF02IL8FY.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattagaattatttaattgtatcagcagaacaggaaacgcccctaagctcctgatctatggtgcatcctagtttgacaaaggtcgggccccagtcaaggttcagtggcagtggctcgtaggacagtatttcactctacaccatcagcagtcctaccaactagaatattttacgactaactttactactgtacaactagtacgtttacgacgttaccggtaccccgggtacgttaccggaccgaaaccgggtaccgaaacgggttacggaaccgtacgtaaccgaaaacggtaacgttacggtacggtaccgttacgaccgtaacccgtacgttaccgttcgttaccttacccg

SEQ ID NO: 179222 - DNA, 510 bp, Homo sapiens
  misc_feature: GYAE6OF02G15DD.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaaggtcgggcccatcaaggttcagtggcagtgctgtgggacagatttcactctcaccatcagctacgtctaccaactgaagtattttgactaacttactactgtacaacagtattcagttacgtcccggtacgttccggccgaaggaccgaaggtcgacacgtacaaacgaactcgtgactgacaccatctcgtcttc

SEQ ID NO: 179223 - DNA, 899 bp, Homo sapiens
  misc_feature: GYAE6OF02FV0CN.15.83.H06.1.454.CMB.1.raw
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccgntccactctccctctctcncgactactcgtaggtagacgacgaagtactaccaactactaccttacgtccgggtaccgtaacgtaacgtacgaaacgtaaacttaaggttaaaggttaattttaaaagttttaaggttagttactacgtacgacgaaaaccgtaaaccggggaaacgggaacccccgtaacccgtaacgtaccccgttaccgtaagtaccttacgttaggttcggtacgtaccttaccgttaccgtttagggtttaccgaaacggttaacggggggtccccgggtaacccctaacgtaaccgggtttaacgttacggtagggtccggagtacgggtcggttaccgttacggggtaacggaacgttaacggtttacctttaaccctaccgttaccctaaccccgtaaacctctaaccggaccgtaaccgttacccgttaccccgtaaacccccgttaagtaaggtaaacggttttttccttaaccgaaaccccttttttaaaccggttaccgttacgttacgaaacccgtaaggttaacggtttaccgttaacgttaacccggggttacccccggttaacccgggtttaccggtacccggtaaaccgggaaacgtaacgggttaaccgggtcgaaaccgtacgtaaaacccggtaaaccgttacggttacggtaccggacgttacgaaccccgttagttaccctcgtttaccgtttccgtaaccc

SEQ ID NO: 179224 - DNA, 513 bp, Homo sapiens
  misc_feature: GYAE6OF02I63SC.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattattaaattggtatcagcagaaaccagggaaagcccctaagctcctgatctatggtgcatccagtttgcaaagtgggccccatcaaggttcagtggcagtggctctgggacagatttcactctcaccatcagcagtctccaacctgaagtattttgctaaacttactactgtacaaacagtagtttcagttacgtccccggagttcggaccgaaggaccgaaggtggacagtacaaacgaactagtaggctacggcaccatctcgtcttacc

SEQ ID NO: 179225 - DNA, 684 bp, Homo sapiens
  misc_feature: GYAE6OF02J1FHK.15.83.H06.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
tcagtctacgtagccacgaccggtgctcgatttagatcacgtgcgtcgcgggggcgaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtcaagtcagacntagaattattaatggtatnagnagaaccaggaaacnccctaagctcngatctagtgtgacatcctagtttgacgaaaggtcgggacccctagtacgtaacggttcaggtggctaggtcgcgtcgacggacaggtactttcaccgttctaccgtacctataccgtagtccgtaacgttcctaacccgtaaaccgttaggtaaacgtttaattttaccgaaccgtttaaacctttaaccgttacgttaccgttaacctaaaccgtaaaggtttacgtttacgtaacggtttaaacccggttccccgggtaacggtttcccggaacccggttaaaccggggtaaaccgtaacgggttaccggaacggttaaccgtaaccgtaaaccggtaagttaaccgggtacggtaccgttacggtacccgaaccgttacttacggttacgttctttaaccgg

SEQ ID NO: 179226 - DNA, 612 bp, Homo sapiens
  misc_feature: GYAE6OF02GVU12.15.83.H06.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtcaagtcagaacattagaattattaatgtatcagcagaaaccaggaacnccctaagctcctgatctagtggtgcatcagtttgacgtaaggtcgggccccatacgaaggttcaggtggcaggtcggctcgtagggactagtactttcgacttcacacctatcagtcacgttccacctaacgtagaagttatttacgaccttaaacttaccttactacgtaccaacgtagttactttaccgtacgttaccgttacccccgggtacgtttcccgggaaccgtaaccgggtaaccgtaacgggttacggaaccgtaacgtaacctaaaacggtaaccgtacggtaccggtactacggtaccgtaacccgtagttaccgttacgttctttaacccg

SEQ ID NO: 179227 - DNA, 550 bp, Homo sapiens
  misc_feature: GYAE6OF02IZH73.15.83.H06.1.454.CMB.1.raw
  modified_base (268)..(268): a, c, t, g, unknown or other
  misc_feature (268)..(268): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccggtcaagtcagaacattagattatttaaatgtatcagcagaacagggaacncccctaagctctgatctatggtgcatcagtttgactaaaggtcgggcccatcaaggttcagtggcagtcggctcgtgggacagtactttcgactctacacccgtatcagcagtcctaccaaccgtgaatagtttgacttaacttactacttcgtacaacgtagttacgtttacaggttaccgtcccgggaacgtttccgggacccgtaaagggacccgaaggtcggaactaacgtacgaaaacgacgtaggtggctacggccaccgtatcttcgtcttaccg

SEQ ID NO: 179228 - DNA, 511 bp, Homo sapiens
  misc_feature: GYAE6OF02G8QGJ.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgacaagtcgggccccatcaaggttcagtggcagtggctcgtgggacagatttcactctcaccatcagcagtctccaacctgaagtattttgactaacttactactgtacaactagtagtttacagtacgtcccggtacgttcggccgaacggacgacggtagacacgtacaacgaactgtagctacgcaccatctcgtctac

SEQ ID NO: 179229 - DNA, 752 bp, Homo sapiens
  misc_feature: GYAE6OF02H54N8.15.83.H06.1.454.CMB.1.raw
  modified_base (226)..(226): a, c, t, g, unknown or other
  misc_feature (226)..(226): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtcctccatccctccctgtctgcatctggtaggagacagaatcaccatcacttgccggtanaagtcagaactattaggaatttatttaaattggtatcagacaagaaaccagggaaacgaccctaagcctacctgatctagtgtgcactccagtttgacgaaacggtcggggacccctagtacgaaggttacaggtggacgtaggtcggctcgtaggacgtagtactttcaccgtctacacctataccgagtaccacgttacctacccgtaaaccgttaggtaaacgttaacgttttacgaccttaaacgtttaccttaaccgtacgtaccgtaaacgttacggttaacgttttaccgaacggtttacccgggttacccccgggttaccggtttacccgggtaaccggtaaaaccggggtaacccggtaaaccggggttaccggggtaaccgtaaccggttaacccggtaaaacccggttaaaccgggttaccgggttaaccgggttaccggttaacccgggtaacccggtaacccccgttaaaccggttttaccgtttaacccggttttacccgttttaaccccgg

SEQ ID NO: 179230 - DNA, 581 bp, Homo sapiens
  misc_feature: GYAE6OF02I880G.15.83.H06.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtcaagtcagacattaggaattattaaattgtatcagcagaacaggaacnccctaagctcctgatctatggtgcatccgagtttgacaaaggtcgggccccatcaaggttcagtggcgagtggctcgtgggactagactttcgactctcaccatcagcagtctaccaacgtgaacgtattttagaccttaacttactactacgtacaactaaggttacgtttacgtacggttacggttaccccgggtacggttaccggacccggtaaacgggaccgtaaacgggtcggaactaacgtaacctaaaccggtaacgtacggtcgtaccgtacgactaccctacgtcgttaccgttcttaacccg

SEQ ID NO: 179231 - DNA, 488 bp, Homo sapiens
  misc_feature: GYAE6OF02FITOR.15.83.H06.1.454.CMB.1.raw
  modified_base (222)..(222): a, c, t, g, unknown or other
  misc_feature (222)..(222): n is a, c, g, or t
  modified_base (482)..(482): a, c, t, g, unknown or other
  misc_feature (482)..(482): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagacattagatattaattgtatcagcagaaaccaggaagcccctaagctcctgatctatggtgcatccagtttgcaaagtgggcccatcaagttcagtggcagtggctcgtgggacagatttcactctcacatcagcagtctccaacctgaagtattttgctaacttactactacgtcaacagtagtttcagtacgtcccggacgttcgcaggaccgagtgacatacaacgaacgtgtgcgtcgcaccatctgtnttaccg

SEQ ID NO: 179232 - DNA, 634 bp, Homo sapiens
  misc_feature: GYAE6OF02IM9ON.15.83.H06.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagtctacgtagccacgaccggtgctcgattttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtnaagtcagaacattaggaattatttaaattggtatcagcagaaacaggaaacgcccctaaagctacctgatctaatggtgcattccaagtttgacgaaagtcggggaccccagtacgaaggttccaggtacggcaggtggctcgtagggacaggtactttcacttctaccacgtatcaagccaagtcctaccaaacctggaaagttacttttagacctaacgttttaacttaactacggttaacaaacgtaaggttacgttttaccgaagttaaccggttaccccggtaccgttaccgggacccgaaaaacgggtaccggaaaggtaccgggaacgtaacgtaacgaaaaccggtaacgtacggtggtaccgtaggtacccacgtaaccgttacttacgttactttaacccg

SEQ ID NO: 179233 - DNA, 510 bp, Homo sapiens
  misc_feature: GYAE6OF02FQYXJ.15.83.H06.1.454.CMB.1.raw
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatctgtaggagacagaatcaccatcacttgccgtnaagtcagacattagattattaattgtatcagnagaacaggaacncccaagctctnatctangtgcatcagttgcaaaggtcgggacccatcgaaggttcagtggcaggtcggctctagggacagtactttcactctccacatcagctacgtctaccaactgaatactttgacttaacttactactcgtacaactagtagtttacgagtaccgtcccggtacgttccgacgtacggaccaggcgacgacgtacgaacgaacgtgtacgcgtgacacatctagtcttacg

SEQ ID NO: 179234 - DNA, 602 bp, Homo sapiens
  misc_feature: GYAE6OF02GTAT3.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaacgcccctaagctcctgatctatggtgcatccagtttgacaaaggtcgggccccatcgaaggttcagtggcagtgctcgtgggacagtatttcactctacaccatcagcagtcctaccaacctgaacgttattttagacttaacttacctacttcgtacaaactagtacgttttacgaacggttaccggtacccccgggtaacgtttccggacccggtaaacggggaaccgtaacggggtacggtaaccgtaacgtaaccgaaacggtaaccgtaggtacgggtacgttacggacctaaccgtacttaccgttacggttacctttaccg

SEQ ID NO: 179235 - DNA, 567 bp, Homo sapiens
  misc_feature: GYAE6OF02HG24E.15.83.H06.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagatcaccatcacttgccggtcagtcagaacattaggaattatttaattggtatcagcagaaacaggaacgccctaagctcctgatctatggtncatcagtttgacaaggtcgggacccagtcgaaggttcaggtggctagtggctgtgggactagtactttcacttccacaccatcagctacgtctaccaacttagaacgttattttcgacttaacttacttactagtacaacgtagttacgtttacgtacgtaccggttaccccgggttacgttaccgggaccgtaaacgggtaccgtacgggtacgacgtacgtaacgaaaccgtaacgtgtacgtactcggactaccgattcgtcgttactccg

SEQ ID NO: 179236 - DNA, 536 bp, Homo sapiens
  misc_feature: GYAE6OF02IP9Q7.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatccacttcgccggtcaagtcagaacattaggattatttaaattggtatcagcagaaaccagggaacaccctaagctctgatctatggtgcatcagtttgacgaaggtcgggacccatcaaggttcagtggcagtggctcgtgggacagtatttcactctcaccatcagcagtctaccaactacgaagtatttcgactacttacttactgtacctaacagtagtttactacgtacgtaccccggtacgttccggaccgtaaacgggaccgtaaggtaggactacgtaacaaacgtacgtagtgtacgtacgcactatcgttacgtctac

SEQ ID NO: 179237 - DNA, 613 bp, Homo sapiens
  misc_feature: GYAE6OF02HQ29P.15.83.H06.1.454.CMB.1.raw
tcagtctacgtagccacgaccggtgctcgatttagatcacgtgcgtcgcgggctagaaagggcttaatatagggaagaagtggggcagggaagggggagggagaagcagaaggtgaaatgtgctggagtcctcctagttatccaataggacagatgttgaggaaggccagggatggagtctggcccagtctcacaagaggggccaacagtggcccagcagacaggcccagtttggtgggggattgtcttgggggtatggggagaagggctactttgagatagggtcaaaggcgtggggtagggaaaagggttacgaggttaaggaacaaggtctaggttttgactaggccatgtccaaggttggatggtagttaagagaggaacagaaataagacgtcatgctagttagaaagtagaggcacaagatcgcagcttctagaggagacagctgacgtgggagtacggttaccaagtaagtgagtagtagaaaacgtggactataaaggagtaatcgtatttgttttgaggtcgaagggacggaacgggtaccgtagggtacgggttagggggtagttacgggttagggtaggaaggtacgacgtagttaaacggg

SEQ ID NO: 179238 - DNA, 656 bp, Homo sapiens
  misc_feature: GYAE6OF02HX9AA.15.83.H06.1.454.CMB.1.raw
  modified_base (223)..(223): a, c, t, g, unknown or other
  misc_feature (223)..(223): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatctgtaggagacagaatccaccatcacttgccgtnaagtcagaacattagtaatttatttaaattggtatcagacaagaaaccagggaaacgccctaagcctcctagatactagtggtgctatcctagtttgacgtaaggtccgggacccctagtacgtaaggttcgaggtcggacgtaggtcggtacgtcggtagggaactagttactttcctaccttacctaccgaaccctacgtaccgtacgtaccgtacgttaccctacccgaaaccgttacgtaaagttacttttacgacttaaacctttacttacttacgtaaccaagtacgttacgtttaccgacgttacccggtacccggttacggttccggaccgaaccgggaaccgtaacggtacggtaacgtacgtaaccgtaaacgtaacgtacggtacggcgttacgacctaacctacgttcttacgtcttaccg

SEQ ID NO: 179239 - DNA, 695 bp, Homo sapiens
  misc_feature: GYAE6OF02GFZPT.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatccacttgccggtcaagtcagaacattaggaatttatttaaattggtatcagcaagaaacgagggaacgacccctaagcctcctgactctagtggtgcatccgtagtttcgacgaaacggtcgggacccctagtcgtaaggttcgaggtcggacgtaggtcggctcgtagggaactacggtacttttccgaacgttcctacctaacctacgtacacgtactacgtccctacccgtaaccgttagaagttacttttacgaccttaaaccttaccttaacgttacgttaaccaaacgtacgttaacgttttaccgtaacggttaaccggttacccccgggtaacggttcccgggacccggtaaacggggtaacccgaaagggttaccgggaaacctaacggtaaccgtaaaaccggtaaccggttaaggtaccggtaccgttaccggacctaacccggtaaccgttccgttacgttaccctttaaccg

SEQ ID NO: 179240 - DNA, 592 bp, Homo sapiens
  misc_feature: GYAE6OF02JLRZF.15.83.H06.1.454.CMB.1.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
tcagtctacgtagccacgaccggtgctcgatttagatcacgtgcgtcgcgggggcgaggagtcagtctcagtcaggacacagcatggacatgagggtccccgctcagctcctggggctcctgctactctggctccgaggagccaaatgtgacatccagatgacccagtctccatcctcctgtctgcatctgtaggagacngaatcaccatcacttgccggtnaagtcagaacatagatattaattgtatnagcagaaccaggaanccctaagctctgatctatgtgcatctagttcgacgtaacgtcggggtacccagtactaagtacgtttcaggttcggacgacggttaggccgttcgtacgggtacgaacggttactttcgtaaccgttcctaccgtacccgatccagtctacgtctaccctaacctcgaagttacgtttcaacgtaacttacttactcgttacaactagtacgtttagtacgtacggttacccgtcggttacggacgtaacgggtaccgtaggtacgtaacgtcgtaacgtaacaacggttacgtacgtcgtactaccgactaccgttcgtgttaccg

SEQ ID NO: 179241 - DNA, 744 bp, Homo sapiens
  misc_feature: GYAE6OF02FR8Q5.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattattaattggtatcagcaagaaaccaagggaaacgcccctaagctacctgactctatggtagctactacctaggttttagacgtaaacggttcgggggaccccctaacgttcgtaaacgggtttccgaaggttcgggaccgtaagggttcgggtcgttcgtacgggggaacctaaggttacgttttaccgaaccttccgtacctaaccctacttccgaacggtaccgtaacggttcccttaacccccgtaaaccttacgggtaaaacgttacgttttttacgaaccttaaaccgtttaaccttaaccgtttgtaacccaaacgtacggttacgtttaccgtaacggtttaacccggtccccgggtaaccgggtttaccggaacccggtaaacggggtaacccgtaacgggtacgggaacgtaaccgtaaccgtaaaccggtaacggttacggtaccggtactacggtaccacccggttactaccgttcgttacgtttaccccg

SEQ ID NO: 179242 - DNA, 546 bp, Homo sapiens
  misc_feature: GYAE6OF02G7HIC.15.83.H06.1.454.CMB.1.raw
  modified_base (274)..(274): a, c, t, g, unknown or other
  misc_feature (274)..(274): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatctgtaggagacagaatcaccatcacttgccggtcaagtcagaacattaggaattatttaaattggtatcagcagaaacagggaanccctaagctcctgatctatggtgcatccagtttgacaaaggtggggaccccatcgaaggttcaggtggacagtggctctggggacagatttccacttctcaccatcagcagtctccaacctgaagtattttcgctaaacttactactagtcaacagtacgtttacagttacgtccccggtacgttccggaccgtaaacgggaccgaacggtacggacaacgtaacgtaaaccgaactagtcggacgtacgccaccgactcgtcgtacttacc

SEQ ID NO: 179243 - DNA, 526 bp, Homo sapiens
  misc_feature: GYAE6OF02FMUPM.15.83.H06.1.454.CMB.1.raw
  modified_base (220)..(220): a, c, t, g, unknown or other
  misc_feature (220)..(220): n is a, c, g, or t
  modified_base (396)..(396): a, c, t, g, unknown or other
  misc_feature (396)..(396): n is a, c, g, or t
  modified_base (493)..(493): a, c, t, g, unknown or other
  misc_feature (493)..(493): n is a, c, g, or t
tcagtctacgtagccacgaccggtgctcgatttagatcacgtgcgtcgcggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtnaagtcagaacattaggaatattaaattggtatcagcagtaaaccagggaaagcccctaaagcgtcctgatcctatggtgcatccagttttgcaaagtggggccccatcaaggttccagtggcagtggctcgtgggacaggatttcacgtctcacatcagcagtctccaacctgaanattttgactaacttacactgtcaacagaagtttcagtacgtcccggacgttcggcgaagggaccaacggttggacagtacgaaaccgtaacgttagnggtactcggtaccaaccactactcgtacgttac

SEQ ID NO: 179244 - DNA, 577 bp, Homo sapiens
  misc_feature: GYAE6OF02FGLEA.15.83.H06.1.454.CMB.1.raw
  modified_base (222)..(222): a, c, t, g, unknown or other
  misc_feature (222)..(222): n is a, c, g, or t
  modified_base (251)..(252): a, c, t, g, unknown or other
  misc_feature (251)..(252): n is a, c, g, or t
  modified_base (267)..(267): a, c, t, g, unknown or other
  misc_feature (267)..(267): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattagaattattaatgtannagcagaacaggaacncccagctcctgatctatggtgcactccgtagtttgacgtaaaggtcgggccccagtcaaggttcagtggcaggtggctcgtagggacagtactttcactctacacatcagcctagtcctaccaacctagtaagttatttcgacttaacttacctacgtgtaccaacgtagtacgtttacgacgttaccggtacccggtacgttccggaccgtaacgggaaccgtaagggtcggaacctaacgtaacccgaaacggtaacgtcggtacggtaccgtacggacctaacctacgtccttacgttaccttaccg

SEQ ID NO: 179245 - DNA, 593 bp, Homo sapiens
  misc_feature: GYAE6OF02IZN69.15.83.H06.1.454.CMB.1.raw
  modified_base (197)..(197): a, c, t, g, unknown or other
  misc_feature (197)..(197): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttcgccggtcaagtcagacattagaatattaatgtatcagcagaacagggaacgaccctaagctctagatctagtggtgctatccagtttagacgaaggtcgggccccatacgtaaggtcaggtggcaggtcggtctcgtgggaactagtatttcacttcctacacctagccagcgtacgttacctaccaaccgttagtaaacgttacttttagaccttaacgttaccttactacgtacaagtacgttagtttcgaagttaccggttacccgtacgttcggacccgaacgggaaccgtaacggtaggaaccgtaagtacccgaaaacgttaacgtacggttcggtactacggacctaccacgttctcggtttccttaccg

SEQ ID NO: 179246 - DNA, 621 bp, Homo sapiens
  misc_feature: GYAE6OF02F0WSF.15.83.H06.1.454.CMB.1.raw
  modified_base (197)..(197): a, c, t, g, unknown or other
  misc_feature (197)..(197): n is a, c, g, or t
  modified_base (248)..(249): a, c, t, g, unknown or other
  misc_feature (248)..(249): n is a, c, g, or t
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtcaagtcagacatagattattaatgtannagnagaacaggaacaccctagctccngactctagtgcgcatccgtagtttcgacaaaggtcgggaccccagtacaacggttcaggtggacgtaggtcggtctcgtagggactaggtactttaccacttacctacctaacctacgttaccaggtacctaacgttcctaacccgtaaaccgttacggtaaacgttacgtttttacggaaccttaacgtttaacctacgttaacgtactaaacgtagttaacgtttacgtaacgttaaccggtaccccgggttagttacccggaccggtaaacggaccgtaaggtcggaacacgtaaacaacgtacgtaggtcggctaccgtacaccgtactcgtcttaccttac

SEQ ID NO: 179247 - DNA, 680 bp, Homo sapiens
  misc_feature: GYAE6OF02H1CQE.15.83.H06.1.454.CMB.1.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtnaagtcagaacattaggaattattaaattggtatcagcaagaaaccagggaacnccctaagctctagntctatggtanctatccgtagtttgactaaggtcggggacccctagtaccgtaaaggttctaaggtcggacgtagtcgggtaccttgtacggggaactacggtacttttaccgacctttactacccgtaacctagttaccgacggtaccgtacggttaccttaaccctaaacgtacgtaaacggttaaccttttcggaaccttaaacgtttacccttaagtaccgtaacctaacgtacgttagtttaccgtaacggttacccggtaccccgggttacgttaccgggtaacccgtaacgggtaaccgtaacgggtagtaaccgtaacgtaccgtaaaccgtaacggtcgtacggtaccgtacgtacgtaccctagttccgttacgtccttaccg

SEQ ID NO: 179248 - DNA, 653 bp, Homo sapiens
  misc_feature: GYAE6OF02JAZ0G.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccggtcaagtcagaacattaggaattattaaattggtatcagcagaaaccagggaaacgcccctaagctcctgatctatggtgcatcctagtttgacgtaaaggtcgggcccatcgtaaggttcaggtggacgtagtcggctcgtagggactaggtatttccgaacttcgtacctacctactcgtaagccagttcctaccctaaacctcgaacgttagttttacgaccttaaactttactacgttacgtaccgtaaacgtacggttacgtttacgaacggtttaccggtcccccggtaaggtttacccgggaccgtaaacggggtaaccgtaacgggtacgggtaaccaacggttaaccgaaaaccggtaaccgttagggtacggttaacccgttaggacccgtaaccgttaccgtaacgttccgttacctttacccg

SEQ ID NO: 179249 - DNA, 551 bp, Homo sapiens
  misc_feature: GYAE6OF02FNLD0.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatatgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctcgtggacagattttcgactctaccaccatcagcagtctaccaacctgaatatttgactaacttactactgtacaacgtagtacgtttcagttacgtccccggtacgttcggaccgaacgggtaccgaacggtacggaacacgtaaccgaaacgtaacgtcggtacggtccgtacgtccaaccgtattacgtcgttacttacccg

SEQ ID NO: 179250 - DNA, 555 bp, Homo sapiens
  misc_feature: GYAE6OF02GN3O2.15.83.H06.1.454.CMB.1.raw
  modified_base (301)..(301): a, c, t, g, unknown or other
  misc_feature (301)..(301): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcaagaaaccagggaaacgcccctaagctcctgatctatggtncatccagtttgactaaaggtcgggaccccagtacaaggttcagtggcaggtggctcgtggacagtatttcactctcaccatcagcacgtctaccaaccgtgaatattttcgacttaacttactactcgtacaacgtagtacgtttacagttaccggtccccggtaagttccggaccgtaaacgggaccgaagggtacggacgtacgtaacgaaacgtacgtagtcggcgtcgaccaccgtatctcgtcttaccg

SEQ ID NO: 179251 - DNA, 697 bp, Homo sapiens
  misc_feature: GYAE6OF02JN1CK.15.83.H06.1.454.CMB.1.raw
  modified_base (227)..(227): a, c, t, g, unknown or other
  misc_feature (227)..(227): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatcgtgtaggagacagaatccacctatcacttcgccggtanaagtcaagaactattaggaattaatttaaagttggtaattcagtacaagaaaccgtaagggaaacgacccctaaagcctacctagattaccgtaatggtacgactactaccgtagtttgacgtaaaggtcggggacccctagtacgtaacggttacgaggtcgacgtaggtacggtcttcggtagggtacgtacgttagtttaccgacgttcctacaccgtaacttcgaacggcctaacgttcctaacccgtaacttacgaagtttacgttttaccggaaccttaaaccgttacttaaccgttacgtaacgtaaccgttagttacgtttaccgtaacgtttacccggtccccgggttaacgtttaccggaccggaaaccgggttaccgtaaacgggtccggtaactaaccgtaacggtaaaccgtaaggtcgtacggtcgtacggacaccgtctacgttctaccggttac

SEQ ID NO: 179252 - DNA, 683 bp, Homo sapiens
  misc_feature: GYAE6OF02GHLJU.15.83.H06.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagtctacgtagccacgaccggtgctcgatttagatcacgtgcgtcgcgggggcgaggagtcagtctcagtcaggacacagcatggacatgagggtccccgctcagctcctggggctcctgctactctggctccgaggagccaaatgtgacatccagatgacccagtctccatcctccctgtctgcatctgtagganacagaatcaccatcacttgccggtnaagtcagaacattagattattaatgtatcagcagaaaccagggaagccctaagctcctgactctatggtgcatccagtttcgacaaaggtcggggacccctatacgaacggttcgaagttcggactaggtcggtctcgtagggacctaaggtacttttccacgttcctactaaccctattacaacgtccaacgttcctacccgaaaccgtacggtaaacgttagtttttacgaacttaaaccgtttaacgttacgttaggtacctaaacgttagtacgtttttaccgaacggttaaccgggttacccccgggtaacgtttaaccgggtaccccggtaaacggggtaacccgtaacggggttacggtaacgtaacggttaaccgaaaaccggttaacggtacggttacgggtaccgtacgggtacctaaccggtacttaccgttacggttcctttaacccg

SEQ ID NO: 179253 - DNA, 794 bp, Homo sapiens
  misc_feature: GYAE6OF02G8PA6.15.83.H06.1.454.CMB.1.raw
  modified_base (169)..(169): a, c, t, g, unknown or other
  misc_feature (169)..(169): n is a, c, g, or t
  modified_base (328)..(328): a, c, t, g, unknown or other
  misc_feature (328)..(328): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtcnccatccctccctgtctgcatctgtaggagacagaatccaccatcacttcgccggtacaagtcaagtaactaattaaggtaatttaatttaaagttggtaatcagacaagaaaccgaagggaaaccaccccgtaaagcctaccgtgactacttagtggtnactatccgtagtttcgaacgtaaaggtccggggacccctagtacgtaacggttacaggtcggacgtaggtggtacctacggttacggggaactaacgttacgttttccaaccgttcctacctaacccgtaacgttaaccgacggtacctaacgttacccgtaaacccgtaaaccgttacggtaaaacggttttcgttttaaaccggtaaccctttaaaaccggttttaacccttaaacccgtttacgttaaaccctaaaccggttaaggtttaaaccggttttacccgtaaaccgggttacccggttacccccgggtttacggtttaacccgggaacccggtaaaacgggtaacccgtaacggggttacggtaccgtaaacggtaacccgtaaaacggttaaaccgttacggtacggttaaccgtacggaccctaacccgtagtttaccgttcgttaccgttaccg

SEQ ID NO: 179254 - DNA, 622 bp, Homo sapiens
  misc_feature: GYAE6OF02I3QNK.15.83.H06.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (272)..(273): a, c, t, g, unknown or other
  misc_feature (272)..(273): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagtctacgtagccacgaccggtgctcgatttagatcacgtgcgtcgcgggggcaggagtcagtctcagtcaggacacagcatggacatgagggtccccgctcagctccgtggggctcctgctactcgtggctccgaggacgaccaaatgtagacatccagatcgacccagtcctccacttccctccctgtctgctatcgtagtaggagacancggaactcaccattcgaccttgaccggtcaagtcaganactattaagattataatgannaagngagaccaggacncctagctacngagtcatgtnatatacaaggttcgaactaagtcggacctagacgtaggtcgaagtcggacgtacggtcggactagtacggtactaggtacttactacgtactactacgtacgtacgtacgtacgtaacgtacgtaacgtaacgttacgtaacgttaacgtttaacgttaacatttacgtaacctacgtacgtaaccgtaacgtaacgtttaccgtacggttaacagggttccccggtaacggttacgtaccggtacgggtacgtaaacgtacggtaaccgtaacgtacgtaacgtaacgtacgtacggacgtacgtacgtacg

SEQ ID NO: 179255 - DNA, 666 bp, Homo sapiens
  misc_feature: GYAE6OF02F2HFP.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgcggtcaagtcagaacattaggaattaatttaaattggtatcagcaagaaaccaagggaaacgcccctaagcctcctgactctagtggtgctatcctagtttcgacgtaaacgggtccgggacccctatacgtaagggttcgaaggtcggcgtaaggtgggtcctcggtacgggaactaggttacttttaccaacttccgttaccaacctataccaacggtactacgttcccttaacccaacccgttagtaacgtttattttccgaaccttaaacctttaccttacgttacgtaacctaacgtaacgtacgtttacgtaacgttaccggtacccgggtacgttaccggtacccggaaacgggtaccgtaagggtacgaacgtacgtaaccgaaacggtaaccgtacggttacggtacgtacgacctaaccgtactcgttacgttcttaccg

SEQ ID NO: 179256 - DNA, 702 bp, Homo sapiens
  misc_feature: GYAE6OF02H74RQ.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagcctcctggggctcctgctactctggctccgaggagccaaatgtgacatccagatcgacccagtctccatcctccctgtctcgcatccgtgtaggagacagaactccaccatccacttgcccggtacagtcagaacagttacgaatttaatttaaattggtatcagcaagaaacgaaggaacacccctaagtctaccgagtacttctacttggcgtaccattaccgtaggtttacgacgtaaacgggtccgggaccctactacgtaacgggttacagggttacggactggtacggtctacggtgggtaacgtagttactttccacggttcctaccgaacctacgtaccgaacgtacctaccgtacccttaccaaccggttagtaacggtttactttcgaaccttaaccgtttaccacgtttacgtacctaaacgtcggttaaccgttttaccgaacgttacccggttacccccggggtaaggtttacccgaacccgggtaaggtaacccgggtaggtaccgtacgaaactcccggtaaaccgacggttacgtcgtaccgtacaacccgtacctaacgttcgtttacccgtcttaccg

SEQ ID NO: 179257 - DNA, 643 bp, Homo sapiens
  misc_feature: GYAE6OF02HOBUO.15.83.H06.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
tcagtctacgtagccacgaccggtgctcgatttagatcacgtgcgtcgcgggggcaggagtcagtctcagtcaggacacagcatggacatggagggtccccgctcagctccgtggggctcctgctactctggctccgaggacgcaaatggtgacatccagatgaccagtctccatcctcctgtctgcatctgtaganacagaatcacatcacttgccgtnaagtcagaactattagtaattatttaaattggtatcagcagaaaccaggaaacnccctaagctcctagatctatggtgacatccgtagttagacgtaaaggtcgggacccctagtaccgtaagttcgaaggtggacgtaggttacgggtctcgtagggtaactagttacgtttacactcctacctaacctagtaccaagtactacggttcctaaccctaacctaggtaaacgtttactttacggtacttaaacttttacaacgttactaactaaacctagttaacttttcgaagtttcccggtaacccgttacggttaccggtaacccgaaacggtaacgacggtacggtaacctaacgtaacgaacccggtaagttacgtacggtactcggtacaaccgtacgttcgttacgtccgttaacc

SEQ ID NO: 179258 - DNA, 723 bp, Homo sapiens
  misc_feature: GYAE6OF02HMD5R.15.83.H06.1.454.CMB.1.raw
  modified_base (229)..(229): a, c, t, g, unknown or other
  misc_feature (229)..(229): n is a, c, g, or t
  modified_base (318)..(318): a, c, t, g, unknown or other
  misc_feature (318)..(318): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccggaggagaccaaatgtgacatccagatcgacccagtcctccatccctcccgtgtctgcatctggtaggagacagaatccacatcacttgccgtanaagtcagaacattaggtaatttaatttaaattggtatacagacaagaaaccgagggaaacgacccctaagctcctagatactagtggtnactattaccgtagtttcgacgtaaacggtccggggaccctaagtacgtaaggttcgaggtcggcgaggttgcgtacggtaggacgtaggtactttacgaccttctaccacctagtacacgactacgtcctaacctaaaccgtaggtaaagttacgttttaaccgaccttaaaccgtttaaccttacgttaccgtaaccgtaaacctagggtttaacgttttccggtaaccggtttacccgggttaacccccggggttaccgtttaacccgggacccggtaaacgggtaacccggttaagggaccggtaacgtaaaccggttaccggaaaaccggtaaccgtagggttacggaccggttacggaaccctaaccggaaccgtttaccggttactacccgtttacccg

SEQ ID NO: 179259 - DNA, 514 bp, Homo sapiens
  misc_feature: GYAE6OF02HPW8Y.15.83.H06.1.454.CMB.1.raw
  modified_base (222)..(222): a, c, t, g, unknown or other
  misc_feature (222)..(222): n is a, c, g, or t
  modified_base (391)..(391): a, c, t, g, unknown or other
  misc_feature (391)..(391): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtnaagtcagaacattaggaattatttaaattggtatcagcagaaaccagggaaagcccctaagctcctgatctatggtgcatccagtttgcaaagtggggccccatcaagttcagtggcagtggctctggacagatttcacttcgtcaccatcagcagtctcaacctgaanatttgctaacttactactgtaccaacagacgtttacacgttacgtccccggagttccggcgaaacgggaccaagggtcggacactacaaacgtactagtaggctcgacgaccatctgtcttac

SEQ ID NO: 179260 - DNA, 641 bp, Homo sapiens
  misc_feature: GYAE6OF02HEBTZ.15.83.H06.1.454.CMB.1.raw
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcacatcacgttgccggtacaagtcagaacatagaattaattaattgtatcagcaagaacgaggaacncctaagctctgatcgtatggtncactccgtagtttgacgtaaaggtcggggaccccagttacgtaagggttcgaaggttcgggacgtaggttcggtaccgttggtacggggtaactaacggttagtttacctaaccttccgtacctaccctaacgttaccgtacgaccgtacgttacccttacctaacccgtaagttaacgttacgtttacgaaccttaacgtttactaacttacgtaactaacgtacgttaacgttcgtaacgtaccggttacccggttacgttaccggaccgaaacggtaccgtaggtacgacaacgtaacgaaaccgtagtcgtacgtctacgtacgacctacgtactcgttactacg

SEQ ID NO: 179261 - DNA, 683 bp, Homo sapiens
  misc_feature: GYAE6OF02F4I88.15.83.H06.1.454.CMB.1.raw
  modified_base (255)..(255): a, c, t, g, unknown or other
  misc_feature (255)..(255): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtcaagtcagaacattagaattatttaaattggtatnagcaagaaaccagggaaacgccctaagctcctgatctatggtgctatcctagtttacgacgtaaacggtcgggacccctaagttacgtaacggtttcaaggttcggacgtaggttcggtccgtcgtaggggactagtaatttcctacgtctacaacctatacagtacctacgtcctacccaaaccgtgtaaacgttacgttttagaccctttaaactttaccgtaacttcgtacctaaacgttagtaaccgttttacgtaacgggtttaacccgttaccccgggtacggtttaccggaaccggtaaaccgggtaaccgttaacgggtacggaaaccgtaaccgtaaaccgtaaaaccggtaaaccgttacgggtaccggtaacgtaccgtacccaaaccgttctaccgtttacgttccctttaacccg

SEQ ID NO: 179262 - DNA, 604 bp, Homo sapiens
  misc_feature: GYAE6OF02GJ3VG.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtcctccatccctccctgtctgctatctggtaggagacagaactcaccatccacttgccggtacaagtcagaactatagtaattaattaattgtatcagcaagaaaccaggaacgacccctaagctaccgtgtactctagtcggtgctactaccgtagttagacgtaaggtccgggtacccagtacgtaacgggtacaggtcggacgtaggtcggtacgtcgtagggactagtacttcctactctaccgaccactacacgactacgtacctacctaaccgtacgtaacgttgtttacgaccttaaacttaccttactcgtaacaatacgttagttactacgttccgtacccggtcgttaccggacgtaacggacgtaagtgtacgacgtaacgacgtaacgtggtacgcgtacgaccgtactacgtcgttctctaccg

SEQ ID NO: 179263 - DNA, 693 bp, Homo sapiens
  misc_feature: GYAE6OF02FTUIP.15.83.H06.1.454.CMB.1.raw
  modified_base (312)..(312): a, c, t, g, unknown or other
  misc_feature (312)..(312): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtcctgcatctgtaggagacagaatcaccatcacttgccggtcaagtcagaactagttaggaattatttaaattggtaatcagacagaaaccgagggaacgaccctaagctcctgactacgtatggtgacnctcctagttttgacgtaaaggtccggggaccccagtacgtaacggttccgaggtggacgtaaggtcgggtctacgtggggactaggtacttttacgaccgttcctacccgtaacctatccagtacctaacgttcctaaccacccgtaaggtaacgttacgtttttacgacctttaaccgtttacctaaccgtttacgacctaaactacggttaacgttttaccgacgttacccggttaccccgggttacgttaccgggacccggtaacgggaacccgaacgggttaccgggaaccgtaaccgtaaccgtaaacggtaaccttacggtaccggtacggtcggtaccgtaacccttaacgtcccgttacgtccgtttaacccg

SEQ ID NO: 179264 - DNA, 580 bp, Homo sapiens
  misc_feature: GYAE6OF02F7D2V.15.83.H06.1.454.CMB.1.raw
  modified_base (272)..(272): a, c, t, g, unknown or other
  misc_feature (272)..(272): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattagaattattaattggtatcagcagaaaccagggaacncccctaagctcctgactctatggtgctatcctagtttgacgtaaaggtcggggacccctagtacgtaaggttcaggttcggcgtaggtggtctcgtgggacagtactttcacttcctacacctactcagctagtcctacccaacctagaagttatttgactaacttactactgtacaactagtacgtttacgacgttaccggtaccccggtacgttccggaccgaaagggaccgtagggtacgaacgtaacgtaacctaaacgtacgtacggtacggtacgtcgaccgacctactcgttctcttaccg

SEQ ID NO: 179265 - DNA, 531 bp, Homo sapiens
  misc_feature: GYAE6OF02F0YV4.15.83.H06.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (251)..(252): a, c, t, g, unknown or other
  misc_feature (251)..(252): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggngacagaatcaccatcacttgccggtnaagtcagacattagattattaatgtatnannagaacaggaacgccctaagctcctgatctagtggtgcatccagtttgacaaaggtggggaccccagtctaaaggttcaggtggacaggtggctcgtgggacagtatttccgacttctcaccatcagcagtctaccaactgacttatttcgactaacttactactgtaccaatgagtttcagttacgtccccggtagttcgaccgaacggtaccgaaggtagactagtaccgaaacgtaacgtcgtacggactgaccaccgtatccgttactcttacccg

SEQ ID NO: 179266 - DNA, 732 bp, Homo sapiens
  misc_feature: GYAE6OF02FP4OC.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtcagtcagaacattagtattattaatgtatcagcagaaccaggaacgaccctaagctctgatctagtggtgacactcctagtttgacgtaaacggtcgggacccctagtaccgtaaaggtttcgagggttacggacgtaaggttcgggtaccgtcggttacgggggaactaacggttaacttttaccgaaccttccgttaccctaaccgtacttaccgaacggtacctacggttaccctaccccgtaaacccgttaggtaaaccgtttacggttttacgaaccctttaaacctttaccttacgttacgtaaccaaacgttacggtttaaccgttttaaccggtaccggttaacccgggttcccccgggtaacgtttacccgggtaaacccgtaaccggggtaaacccgggtaacggttaccgggaacctaaccggttaaacgtaaaacccgttaacgtacggttcggtacgtacggacccgtaaccgtacgttacgttaccgttcttaacccg

SEQ ID NO: 179267 - DNA, 672 bp, Homo sapiens
  misc_feature: GYAE6OF02GSEDK.15.83.H06.1.454.CMB.1.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
  modified_base (264)..(264): a, c, t, g, unknown or other
  misc_feature (264)..(264): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccaagatcgacccagtcctccacgtccctccctgtcctgccatctgtagganacagaactcacatcacttgccgtnagtcagactagttagtaattattaagtgtatcganacaacgaacgagggaacctccccgtaagtctcctagactcgtagtcggcgtacgtactcgttagttcgaacgtaacgggtccgggaccctagtacgtaacggttcgaaggtcggaacgtcggttgtcgtcgtacggtactacgttacgttcctactctacccgataccgtacgactccacgttacctaaccgtacgtaagtatttacgttacaacgttaaccttactacgttaactaccgtagttacgttacgttaccgtacggttaccccggtaaccggttcgttaccggaaccgaaacggtccggtaaacggtcgaacgttacccgtaaacggtaaacccggttaggtacggtaccggttacgtaaccctcgtaaccgttaccttcggttaccttccgtttaaccg

SEQ ID NO: 179268 - DNA, 605 bp, Homo sapiens
  misc_feature: GYAE6OF02GI34Y.15.83.H06.1.454.CMB.1.raw
tcagtctacgtagccacgaccggtgctcgatttagatcacgtgcgtcgcgggggcaggagtcagtctcagtcaggacacagcatggacatgacgggtccccgctcagctcctggggctcctgctactctggctccgaggagccaaatgtgacatccagatgacccagtctccatcctcctgtctgcatctgtaggagacagaatcaccatcacttgccggtacaagtcaagaactagttagtaattatttaaatggtatcagcaagtaaaccaagggtaaacgcccctaagcctcgtagtactctatggtgctatcctagttgactaaggtcgggcccatcgaagttcagtgcgtagtgctagtcgggacagtacttcactctacaccatcagtctacgtactaccctaaaccgtagtaacgttacttttacgaccttaacgttaactacgtcgtaacaaacgtacgtactttacgtaagttacccggtacccggtacgttaccgaaccggaacgggtaaccgtaaggtacggaactaacgtaccgaaaaccggtacgtaacgtcggtaaccgtcgaccgtaaccgtataccgttgtacttaccg

SEQ ID NO: 179269 - DNA, 624 bp, Homo sapiens
  misc_feature: GYAE6OF02J1BYP.15.83.H06.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
tcagtctacgtagccacgaccggtgctcgatttagatcacgtgcgtcgcgggggcgaggagtcagtctcagtcaggacacagcatggacatgagggtccccgctcagctcctggggctcctgctactctggctccgaggagccaaatgtgacatccagatgacccagtctccatccctccctgtctgcatctgttagganacagaatccaccatcacttgccggtcagtcagaacntagaattaattaaattggtatcagcaagaaacctaggaaagcccctaagacctcctagactactaagttggtacgcaacttccgagttttacgacgtaaaggtccggggtccccaattcgaaacgggtttcaaggtcggtacgtaggttcgggtcttacgtacgggactaggtaactttcgtactcgttccaacacttcgancgtactcgtcccaacttagatctttanctaacttactactntaccaataacgtctttacgacgtacgtaccccggacgttcggtaacccgaaaggtaccggaacggttacgggaactaaacttccggaaaagttaccggtacgtacggcgttaccgactaacccgtattacgttccgtacgttacc

SEQ ID NO: 179270 - DNA, 761 bp, Homo sapiens
  misc_feature: GYAE6OF02HZWSM.15.83.H06.1.454.CMB.1.raw
  modified_base (226)..(226): a, c, t, g, unknown or other
  misc_feature (226)..(226): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctcatccctccctgtctgcatctgtaggagacagaatccaccatcacgttcgccggtanaagtcagaacagttaggtaaatttatttaaattggtattacagacaagaaaccagggaactacccgtaacgctacctggtactactagtggtgacacttaccgtagttttacgaccgtaaaggttccggggacccctaagttaccggtaaggtttacgaggttacgggtacgtagggttacggtaccggtacggttaacggggaacctaagggttaccttttaccgaacctttacctaccgtaaaccctagtacccgtaacggaccgtacgtttaccctaaaccccgtaaacccggtttagtaaacggttaacgtttttaccggaactttaaaccgtttaaccgttaacgttacgtaaacctaaacgttagttaacggttttaccacgggtttaacccgtaccccgggtacgttacccgggtaacggaaacggggttaccaacggggttagtaactacggaaccggtaaaccggtaagttaccgggtacgaccgttacggacccgtaaccgttacgtccgttcgtcttaaccccg

SEQ ID NO: 179271 - DNA, 650 bp, Homo sapiens
  misc_feature: GYAE6OF02GUF55.15.83.H06.1.454.CMB.1.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (435)..(435): a, c, t, g, unknown or other
  misc_feature (435)..(435): n is a, c, g, or t
  modified_base (466)..(466): a, c, t, g, unknown or other
  misc_feature (466)..(466): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggcgccaaatcgtgacatccagatgacccagtctccatcctccctgtctgcatctgtaggacacagaatcacctatcacttgccgtanaagtcaagtaacattaaggaattaatttaagttaggtatanagtacaagtaacgaaggtaacgacccgtaagactaccgtagtataccgtagtggtacgtactagtaccgttagttcgtaacgtaacggtacgggaccctagtacgtaacgtactaggtaggtactggtcgtcgagtcggacgtatacttacactacctacacgtcaacgnactacgtactaccaactaggtaatccgttanacgttaaacttacgtactacggaacctaagtagttaacgttacgtacgggttaaccgtacccggtaccggttacgtaaccggttaacgtaaccgggtaacgacgtttacggacgttaaacggtaaacaaccggttcgtacggtaacgttcgtaacccgacgtaactccgttacggtacttaccg

SEQ ID NO: 179272 - DNA, 624 bp, Homo sapiens
  misc_feature: GYAE6OF02IJZD5.15.83.H06.1.454.CMB.1.raw
  modified_base (599)..(599): a, c, t, g, unknown or other
  misc_feature (599)..(599): n is a, c, g, or t
tcagtctacgtagccacgaccggtgctcgatttagatcacgtgcgtcgcgggctagaaagggcttaatatagggaagaagtggggcagggaagggggagggagaagcagaaggtgaaatgtgctggagtcctcctagttatccaataggacagatgttgaggaaggccagggatggagtctggcccagtctcacaagagggccaacagtggcccagcagacaggcccagtttgggtgggggattggtcgttgggggtatggggagagggtctacgttggagatagggtcaaaggcgtggggtagggaaaagggttacgaggttaggaacgaaggtcgttaagggttttgacgtaggcctatcggtaccaagggtttggaattgggtaattaaggagaaggaaaccaggaaaataagacgtccatgacctagtggaaatagagacaccagatgcagctacgtgagagaccagcgtcgagtggattggtaccagaaagtgatagagaaaacgtgggacctagtaagagtatacttattggtttgacggacgacgggtacgtaagggcctaaggggttgtacgggggtagtacggttagggnggtaacggagaccggtagtaacggg

SEQ ID NO: 179273 - DNA, 746 bp, Homo sapiens
  misc_feature: GYAE6OF02IGE0D.15.83.H06.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagganacagaattcaccatcacttgccggtanaacgtcagaactattaggaatttatttaaagttggtatcagtacagaaaccgaagggaaancccctaaagcccttcctaggtacttacgtaagttcggtacgactacttaccctagtttacggacgtaaacgggttcggggacccctaagtcgtaaacgggtttcaacggtcggacgtaggtacggggtccttacgggtacgggtaacgtagttacctttacgtaccgttcctaaccgaccgtaacttccgaacggtacctaggttaccctaccgtaaacccgttggttaaaacgtttacgtttttaccggacctttaaaccgttttaccgttactacggtaacctaacgtaaggttacgttttaccgaacgggtttccggtaccccgggttacggttaacccggtaacccggtaacgggtacccgttaaggggtaccgtaactaccggttaaacgaacccggtaaggttacgtacgggtccttacggaaccgtaaccttaggttccttacgtactttaccg

SEQ ID NO: 179274 - DNA, 825 bp, Homo sapiens
  misc_feature: GYAE6OF02H0FXL.15.83.H06.1.454.CMB.1.raw
  modified_base (222)..(222): a, c, t, g, unknown or other
  misc_feature (222)..(222): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgctatctgtaggagacagactcacatcacttcgccgtanaacgtcaagaactagttaaggtaaattttaacttttaaagttgggtattacaggacaaacggtaaaccgaaggggaaaaccgtccccttaaaggacccttcccgttaaggaaccttttaccgtaggttcggttacgccttaaccgttaccgttaagttttaccgggaacgttaaaaccgggggtcccggggtaaccccctaaggttacccggttaaggggttaccgtaacgggttggtacccgtagggttccggtaccgtttccggggtaacccggggtaagtaacggtttaacttttccccggacccttttaccggtaaccttaacccgtacggtttacccggaacgttacccggtaacgtttaccccgtaaccgttaaacgggttacgggttaaactttagttttaacccggaccttttaaactttaccgttaacgttccgtaactaaaccggttagtttaaccgtttaccgtaacggttacccgggttaccccggtaaggtacccggtaacgtaaccgggaacgttacgtacgaaccgtactaaacgtaccggtactgggtacgacgtcgtaacaccgttaacgtctacgttccgttaac

SEQ ID NO: 179275 - DNA, 562 bp, Homo sapiens
  misc_feature: GYAE6OF02H2QTM.15.83.H06.1.454.CMB.1.raw
  modified_base (221)..(221): a, c, t, g, unknown or other
  misc_feature (221)..(221): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtagagacagaatcaccatcacttgccggtnaagtcagaactagttaaggaatttatttaaattggtatcagcaagaaaccagggaactacccctaagctacctgatctagtggtgctatcctagtttgacgaaggtcgggacccatccgtaaggtcagtcgcgtaggtgctcgtagggactagtatttccactctaccacctatcagctacgttcctaccaactgaacgttatttcgactaacttactacgtagtaccaatagtacgtttacgacgttaccgtcccggtacgttccggaccgaaggacctagggtacgactagtaacaaacgtacgtagtacgcgtagaccactagtccgtacgtctaccg

SEQ ID NO: 179276 - DNA, 672 bp, Homo sapiens
  misc_feature: GYAE6OF02GX5UR.15.83.H06.1.454.CMB.1.raw
  modified_base (224)..(224): a, c, t, g, unknown or other
  misc_feature (224)..(224): n is a, c, g, or t
tcagtctacgtagccacgaccggtgctcgatttagatcacgtgcgtcgcgggggcaggagtcagtctcagtcaggacacagcatggacatgagggtcccccgctcagctcctggggctcctgctactctggctccgaggagccaaatgtgacatccagatgacccagtctccatcctccctgtctgcatctgtaggagacagaatcaccatcacttcgccggtnaagtcagaactattaggtaattattaatgtatcagcaagaaaccgaggaacgaccctaacgctactagactctagtggtagctactccgtagttagacgtaaacggtcgggacccatacgtaagttacgaagtcggacagtcggactcgtggacgtagtactttcacttacctacgaaccctactaccgacgtccgtaacgttacccttaaccctaaccgttagtaaacgtttacgttttaacgtaccttaaacctttacttaaaccgtctaaactaacgtaacgttacgtttacacgggtttaaccggttaccccgggtaccgtttacgggacccggtaaacgggtaccgaaacggggtactacccggaaacgtaaccgtaaaaccggtacgttacgtacgggtacctacgtaccgtaaccgtacgttacgttccgtaccgttaccc

SEQ ID NO: 179277 - DNA, 530 bp, Homo sapiens
  misc_feature: GYAE6OF02F2O2K.15.83.H06.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctcctgtctgcatctgtaggagacagaatcaccatcacttgccgtnaagtcagaacntagatattaatgtatcagcagaaacagggaacgcccctaagctcctgatctatggtagcatcagtttgcaaagtgggccccagtcaaggttcagtggcagtggctcgtgggacagtactttcgactctcaccatcagcagtctccaacctgaacgtatttcgactaacttactactcgtacaacgtagtagtttcagtacgtccccggtacgttccgaccgtaagggaccgtaacggtagaccgaataacgaaaccgactacggtggtacgtacgacgacctactcgtagttacttccg

SEQ ID NO: 179278 - DNA, 744 bp, Homo sapiens
  misc_feature: GYAE6OF02I84RL.15.83.H06.1.454.CMB.1.raw
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (692)..(692): a, c, t, g, unknown or other
  misc_feature (692)..(692): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacataccagatcgacccagtcctccatccctcctgtctgcatcgtagtagagacaagaatccacctatccgacttcggccggtacaagtcaagtaacctaatttaacgtaatttaatttaaagtggttaactcagacgaaagaaaccgagggtaaaccnccccttaagcctccgtagtacttcgtagtggtacnctactaccgtagttcgaacgtaacggggtccgggaccctaagtaccggtaacggttacgacggttacggacgtttacgggtcgtaccggttaccggtacggtaaacggttaccgttaacgttttaccaaccggttacctcccggtaaacctacgtaccggaacgtacccgtaaccgttaccgtaacccgtaaacccgtagttaaaccgtttgttaacctaacccgttaacttaaccgttctaacgaacctaacgttacggttaccgttacgtaccggttaccggttacccggtacgtacccgacgggaacgtaaccgggtagttacgaacccttaaggaaccgtaaacncggtacggagtaccctacggaacctacgtaccgttctacgtttactacccgg

SEQ ID NO: 179279 - DNA, 801 bp, Homo sapiens
  misc_feature: GYAE6OF02HZZEI.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtagacatccagatcgacccagtctccatccctccctgtctgctatctaggtagagacagaatccaccatctacttcgaccggtacaagtcaagaactagttaggaactttaagtttaaagttggtatacacgactaacgaaaccgaacggaaactccccgtaaagtcctaccgtatacgttcgtagttcgggtactacgtacgttaccgtaggtttacggaacgtaacgggtccgggacccctaagtaccgtaacggttacgaacgggttcggacgttacggtcggtaccgttacggtacgggtaactacggtttacgtttaccgtaaccgttacctaccgtaacctacgtaccgtaacgtacccgtacggttacccttaaccgtaacggttagttaaacgtttacgtttaccggtaacccgttaaccttttaacgtaaccgttacgtaaacccgtaagttaacggtttaccgtttaaccggtacggtttaaccccgggttacccggttaaccgggtttaccccggtaaacggtaaaccccggggttaacgaaccgggttacgtacccgtaaccgtaaccggtaaaccgtacggtttaacgccggttacgtaccgtaccggtacctaacgttttcgtaccgttaccgtttaccg

SEQ ID NO: 179280 - DNA, 764 bp, Homo sapiens
  misc_feature: GYAE6OF02HI3DI.15.83.H06.1.454.CMB.1.raw
  modified_base (142)..(142): a, c, t, g, unknown or other
  misc_feature (142)..(142): n is a, c, g, or t
tcagtctacgtagccacgaccggtgctcgatttagatcacgtgcgtcgcggggggcaggagtcagtctcagtcaggacacagcatggacatgagggtccccgctcagctcctggggctcctgctactctggctccggagganccaaatgtgacatccaggatcgacccagtctccactccctccctgtctgctatctgacggaagacaagtactcaccatctacgttcggccggtacaacgtacaagtaactaagttaaggtaattttaaagtttaaagttaggtaactacgacgacgtaaaacggaaacccggaacgggtaaacccgtaacccccgtaaaggtccctaccgtacggtactaaccttaggtcgggtcacctacgttaccgtagttacgaacggtaaccgggtccggacccctagtacgtacggtacgtaggtcggtacgtacggtcggtaccggtcgggtaacgggtacgttaacgttacttaccgtacctaccgtacctaccgtactacgtacgtacgtacccgtacctaacctaacgttacgttaaccgtttagttactaaaccgttaattaacccggttattaccgtactaacgtagttaacgttacgtaccgttaccggggtcccgttaaccggtaccggaacggtaaccgggtaaccgtaacgggaggtaacgtaaccgtaacgtaacggtaacgttacgggacctcggtaacccgcgtaaccgtcgttaacggttcgttacttaccgg

SEQ ID NO: 179281 - DNA, 629 bp, Homo sapiens
  misc_feature: GYAE6OF02FQ6JI.15.83.H06.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatccctccctgtctgcatctgtagganacagaatcaccatccacgttcgccggtanaagtcaagaacattaggaattatttaaattggtatcagcaagaaaccgagggaacgaccctaagctccgngatctatggtgctatcgtagttcgacgtaagtccgggaccctatacggtaagttcgagtggactaggtcggtctacggtagggtaactaggtactttccacttccgtacaaccgtatacgacgcgtaacgtccctaacccgaacgttagtaacgtttatttaccgacttaaaccttaccttacgtactacaacgtagtacgtttacacgttacccggtacccggaccgtaccgaccggtaagggaccgtagggtcgaactaccgtaaccggaaacgttaccggttagccgggtctacggaccgtaacctacgttcgttcgtaccgttacccg

SEQ ID NO: 179282 - DNA, 718 bp, Homo sapiens
  misc_feature: GYAE6OF02G5R2A.15.83.H06.1.454.CMB.1.raw
  modified_base (275)..(275): a, c, t, g, unknown or other
  misc_feature (275)..(275): n is a, c, g, or t
  modified_base (708)..(708): a, c, t, g, unknown or other
  misc_feature (708)..(708): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactcgtggctccgaggagccaaatgtgacatccagatcgacccagtcctccatccctccctgtcctgcatctggagagacagaatccacctatcacttcgaccgtacaagtccagaactagttaaggtaatttaatttaagttaggtaactnaacgtacaacggaaaccggaaagggaaaccgaccccgtaacgcctaccgtgtacttacgtagttggcgtacctacttaccgttagttcgaacggtaaacgggtcccggggtacccctaagtaccgtaaaggttaccgaagggttccggtagtaacgggtcggtaccgttacgggtacgggtaacgtacggtttaccgttacctacggttacctaaccgtaaccctacgttaccggaaccgtaccgtaccgtacccgttaacctaaccgggttaacgttaacgtttacgttaacggtacctttaaaccgttaccttaacgtacgtaactaacgtgttacgttacgtacgtaccgtccgaccgttcggaacggaaccggtagtaacggcgtaactacgtaacgtaacgtacgtagtcgacgtcgacacgtacctnttcaccgttc

SEQ ID NO: 179283 - DNA, 794 bp, Homo sapiens
  misc_feature: GYAE6OF02G7BDG.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggacgccaaatgtgacatccagatcgacccagtctccatcctcctgtctgcatctgtaggagacaagaactccactatcacgttcggccggtacaagtcaagaactattaggtaatttaatttaattggtactcgagtacaacgaaaccgaggaacgacccctaagcctcctagtacttctagtggtcgactacgttcctaggtttacgaacgtaacggttcgggacccctaagtaccgtaaacggttcgaaggttcggacgtacggtcgggtaccgttacggtaacggggtacttaacggttacgttttaccgtaccttaccggtaccaacccttagtaccgaactcggtaaccgttacccgtaaacccgtaaccgttaacgggttaaacgtttaccgttttaacggtaaccctttaaaccgtttaaccttaacggttacgttaaaccgaaaccgttagtttaaccgggttaccgtaaaccgggtttacccggtaccccgggttacggtttacccgggaacccggttaaaccggggtaacccgggtaacgggttaccgggtaacctaaacggttaacccggaaaaccggtttacggtaacgggttaccggaccgttccgaaccgttacccggtacttaccgttcggtttacctaccg

SEQ ID NO: 179284 - DNA, 572 bp, Homo sapiens
  misc_feature: GYAE6OF02IY19L.15.83.H06.1.454.CMB.1.raw
  modified_base (273)..(273): a, c, t, g, unknown or other
  misc_feature (273)..(273): n is a, c, g, or t
  modified_base (408)..(408): a, c, t, g, unknown or other
  misc_feature (408)..(408): n is a, c, g, or t
  modified_base (549)..(549): a, c, t, g, unknown or other
  misc_feature (549)..(549): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaactcacatcacttgccggtacagtcaagaacattaggaattatttaatgtatcagcaagaacaagggaacnccctaagcctaccgtgactctagtggtacgcactctagtttcgacgtaaggtcgggaccctagttacgaacggttacaggtgacgtaggtggctacgtagggacagttaactttccacgttactaccgaacctanactacgactacgttcacctaacgtagtattactttacgacttaacttactacgtctacgaactaggtacttcgaacgttcgtacccggtacgttcgaccggtaagacgaggtcgacgagtacgaagtacgtcgaggtgacnccgtactagacttcgtcttaccg

SEQ ID NO: 179285 - DNA, 537 bp, Homo sapiens
  misc_feature: GYAE6OF02JFSOJ.15.83.H06.1.454.CMB.1.raw
  modified_base (221)..(221): a, c, t, g, unknown or other
  misc_feature (221)..(221): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccgtnaagtcagacatagaattattaatgtatcagcagaacaggaacgccctaagctctgatctagtgtgcatccagtttgactaaggtcgggaccctatcgaaggtcagtggcagtcgctagtggacagtcttcactctacactatcagtctatactccaacctagtaagtactttgaccttaacttactactctacaactagtacttacgacgttaccgtcccggtacgttccggaccgtaaggaccgaacggtacggaacacgtaacgaagaaccgttggtacgtcgtagacctaaccgtactacgttgtccgttacg

SEQ ID NO: 179286 - DNA, 734 bp, Homo sapiens
  misc_feature: GYAE6OF02GX498.15.83.H06.1.454.CMB.1.raw
  modified_base (207)..(207): a, c, t, g, unknown or other
  misc_feature (207)..(207): n is a, c, g, or t
  modified_base (328)..(328): a, c, t, g, unknown or other
  misc_feature (328)..(328): n is a, c, g, or t
tcagtctacgtagccacgaccggtgctcgatttagatcacgtgcgtcgcggggggcaggagtcagtctcagtcaggacacagcatggacatgagggtccccgctcagctcctggggctccgtgctactctggctccggaggagaccaaatgtgacatccagatcgacccagtcctccactccctccctgtctagcatcctgtagganacagaactcaccatactacgttcggccggttacaaggtcaagaactagttaagtaaattatttaaaattggtatcaagacaacgaaaccgacgggaacctaccccgtaaagcctaccgtanactaccgtagtcggtacactaactccgtagttagacgaacggtccgggacctaagtacggtaagttcgaggttcggacggtagtcggccgtaggagggaacctaggttaccttctacctacgtaccaacctagtacgtaacgtccgtaacgtacctaacccgtaaccgtaagtaacgttacgttttacgtaaccttaaaccttacttaaccggttctaaacgtaaccttagggttaacctttacggtaaaccggttaccccgtacccggggttacgtaacccggaacggtaacgggttaccggtaaggtacggtaactaacgttaaacccgaaacggttacgttccgtaacggtaccgttaccgaccggtaacctttaacccgtggttttaccctacgtttaaccc

SEQ ID NO: 179287 - DNA, 636 bp, Homo sapiens
  misc_feature: GYAE6OF02GUB7M.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtcctccatcctccctgtctgcatctgtaggagacagaatcaccatcacttgccggtcaagtcagaactattaaggaatttaatttaaagtggtaatcagtacaacgaaaccgagggaaccacccctaagccttaccgtagtactcgtagtggtacgctatccgtagtttcgacgtaaggtccgggacccagtacgtaaggttcaggtcgacgaggttacggcttcgaggtactagtcttacgacttcacctactatcgagactacgtctaccctaacgtagtaacgtttctttaacgaccttaacttacttacgtacgtacctaaacgtcgttaactttacgacgttaccggtacccggtacgttaccggaacccgtaaacgggaccgtaacgggtacgaacgtacgtaaccgaaaccgtgtacggtagtaccggtacgaccgtaccgtacgtcttacgtctttaacccg

SEQ ID NO: 179288 - DNA, 691 bp, Homo sapiens
  misc_feature: GYAE6OF02G7RR6.15.83.H06.1.454.CMB.1.raw
  modified_base (102)..(102): a, c, t, g, unknown or other
  misc_feature (102)..(102): n is a, c, g, or t
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
tcagtctacgtagccacgaccggtgctcgatttagatcacgtgcgtcgcgggggcaggagtcagtctcagtcaggacacagcatggacatgagggtccccgntcagctccgtggggctcctgctactctggctccgaggagccaaatgtgacatccagatgacccagtctccatccctccctgtctgcatcgnggtagganacagaatcaccatcgacttgccgtaaagtcagaactagttaggtaattaatttaatggtatcgagtacagaaaccgaaggaacgacccctaagctacctgtactcgtagtcggtancgtactaccgtagttaggacgaaacgggtccgggacccctaagtacgtaacggttacgaagggttcggactaggtacggcttacggtaacgggtacgtaacgttacttacgtaaccttccgtacctaccgtataccgaggtcctaacgtaccctacctaacgtaggtaaacgttgtttacgaaccttaacgttactaacgttccgaactaacgtagttaccgtttacgtaacgttacccgggtaacccggtaccgttccgggaaaccggacgggtaaccggaacggtacgggtaacacgtaaacctaaaccggtacggttaccggtaggtaccgtacgtaccgtaacgtcccgttagttaccgttcttaacccg

SEQ ID NO: 179289 - DNA, 782 bp, Homo sapiens
  misc_feature: GYAE6OF02JIWLU.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggcgccaaatgtgacatccagatcgacccagtcctccatccctcctgtctgcatctggtaggagacagaactccacctatcctaacgttcgccggtacagtacagaactattaggtaatttaactttaaagtgtactacacgactaaagaaaccgtaagggaaccgtaaccccgtaagtacccgtaccgtgtaacgtaccttacggtcgggtacgtcctaagttaaccccgtagggttttaccgaccggtaaacggggtcccggggtaacccctaggttaaccgtaaacggttacgtacggttaccgggtccggttacgtacgtcggtacgggtacgtacgttaacgtttccgaccttcccgtaccgtaaccgacgttaccgacgtacccgtacgtacccttaaccgaacgttaacgtaacggttactttaacgtaacctaaacctttaacgtacttaaccgtaacgttaaacgtacgggttactttacgtaacgggttacccggtaccccgggttacggttaccgggaacgtaaaccggggaacgtaacgggtaccgtactaacgtaaccgggtaacctaaaggtcggtcgggtactaaccggccctaactacccggtttactacgtttaccttacccgtaaccg

SEQ ID NO: 179290 - DNA, 682 bp, Homo sapiens
  misc_feature: GYAE6OF02GBGQ9.15.83.H06.1.454.CMB.1.raw
  modified_base (102)..(102): a, c, t, g, unknown or other
  misc_feature (102)..(102): n is a, c, g, or t
  modified_base (140)..(140): a, c, t, g, unknown or other
  misc_feature (140)..(140): n is a, c, g, or t
  modified_base (221)..(221): a, c, t, g, unknown or other
  misc_feature (221)..(221): n is a, c, g, or t
tcagtctacgtagccacgaccggtgctcgatttagatcacgtgcgtcgcgggggcaggagtcagtctcagtcaggacacagcatggacatgagggtccccgntcagctcctggggctcctgctactctggctccgagganccaaatgtgacatccagatgacccagtctccatcctccctgtctgcatctgtaggagacagaatcaccatcacttgccgtnaagtcagacattagaattattaattgtatcagcagaaccaggaacgcccctaagctcctagtatctagtggtgcactcctagtttcgacgtaaacggtcggggccccaagtaccgtaaggttccaaggttcggacgtaggtggcctcgtagggactaggtactttccgaccttccgtaccaacctatacgacgtctacggttccctaacccgtaaccgtacggtaaacgttacgttttacgaccttaacgttaccttacttacgtacctaaacgtacggttacgtttaccgtaacggttacccgtaccccgggttacggtttacccggaacccggtaaacggggtaaccgtacgggttacggtaaccgtacgttaaaccggaaaccggttaacgttacgggttaccggtacgttaccggaccgtaacccgttaagttcccgtttacggtccctttaaccgg

SEQ ID NO: 179291 - DNA, 794 bp, Homo sapiens
  misc_feature: GYAE6OF02GC01N.15.83.H06.1.454.CMB.1.raw
tcagtctacgtagccacgaccggtgctcgatttagatcacgtgcgtcgcgggggcaggagtcagtctcagtcaggacacagcatggacatgagggtccccgctcagctcctggggctcctgctactctggctccggaggagccaaatgtgacatccagatcgacccagtcctccactccctccctgtctgactatctggtaggagaaccagtaactccacctatctacgttcggccggtacaagtcaagaactagttaaggtaatttaagtttaaagttggtactaccgagacgtaacgaaaacggaagggtaaacccgtaccccgtaaaggcccttaccgtaggtacttactaacggttgggtacgtactaacgttccgttaggtttaccgacggtaaacggggtccgggacccctagtaccggttaaggtccgtaggtccggtacgtagggtcgtccgtacggtacggtactaacggttactttacccacttccgtacccgtaaccgtactaccgtaacgtacgtaccgttaccctaacccgtaaccgttaacgtaacgttaacgtttaccgttaaccttaaccttaacttaccgttacgtaccgtaaacgttaacgttacgttaccgttaaccggtacccgggttacccggttaccggttaccggtaacccggtaaccgggtaacgggtaaccggtacggtaaccgtaagtaaccccccccccggtaaagtaaccggtacgtacggtaccgtaccgtaccgtacctacgttccgttcgttaccgttacccg

SEQ ID NO: 179292 - DNA, 733 bp, Homo sapiens
  misc_feature: GYAE6OF02HWOAS.15.83.H06.1.454.CMB.1.raw
  modified_base (162)..(162): a, c, t, g, unknown or other
  misc_feature (162)..(162): n is a, c, g, or t
  modified_base (482)..(482): a, c, t, g, unknown or other
  misc_feature (482)..(482): n is a, c, g, or t
  modified_base (538)..(538): a, c, t, g, unknown or other
  misc_feature (538)..(538): n is a, c, g, or t
tcagtctacgtagccacgaccggtgctcgatttagatcacgtgcgtcgcgggggcaggagtcagtctcagtcaggacacagcatggacatgagggtccccgctcagctccgtgggctcctgctactctggctccggaggagaccaaatggtagacatccagntcgacccatctacctactcctccctgtctgctatcgtgtaggacacgaagtactcaacctatacacgtttcgaccggtactaacggtacaacgtaactagttaacggttaattttaattttaaacgtttggtacgtcaacgtacgaaacggtaaaacggaacggaaccggtacccgtaagtcccttaccgtgtactcgtagtacgacgtacacgttacgttagttcgaaccgtaacgggtccggacctacgtacgtaacgggttcagggttcgacgtagtacggtctacggagtacgtactacgttcactctcactcacncgtctactcctacgtacgtatacgttactacgtacttaccttacgtactactaacnacgtttactacgtacggttacccgtacggttaccgttccggaacgttaaccgggacgttaacgggacgttaaccggtaacgtaaaaccgtaaccggttaaacggtcggggtaacccttaacccgggtttacccgttaaacccgaccgggttttaacccttttcccgtttacggggttaaacccctttttccccgg

SEQ ID NO: 179293 - DNA, 924 bp, Homo sapiens
  misc_feature: GYAE6OF02GV5JC.15.83.H06.1.454.CMB.1.raw
  modified_base (140)..(140): a, c, t, g, unknown or other
  misc_feature (140)..(140): n is a, c, g, or t
  modified_base (195)..(195): a, c, t, g, unknown or other
  misc_feature (195)..(195): n is a, c, g, or t
tcagtctacgtagccacgaccggtgctcgatttagatcacgtgcgtcgcgggggcaggagtcagtctcagtcaggacacagcatggacatgagggtccccgctcagcctcctggggctcctgctactctggctccgaggngccaaatgtgacatccagtatcgacccagtcctccatccctccctgtctgcatcngtagagacagaatcacctatcctacgttcgaccggtacaacgtcaagaacagttaaggtaatttaatttaaagttggtactcgaagtacgaacggtaaaaccgaagggaaaccgtacccccgtaaacgtcccgttaccgtagaccgttacgtacggtggtacgtcctacttaccgttacggtttagaaccggtaaacggtcccggggtacccctaacggtacgttaaacgggttacgtacggtacggtacgtagggttcggccgttacggtacgggtaacgtacggttaaccgttttacccacccgtttacccgtaacctaacccgtaaacgttaacccgaacgttacccgtaacgttaaccccgttaacccgtaaaccggttacgtttaaaaacgtttacgttttttaaaacccggtttaaaccgttttaaacccgttaaccgttaacgtttaaaccgtaaactttaacgggtttaaccgttttaaaccggtacggtttaacccccgggttaaccccgggttaaccgggtttaacccggggtaaaacccgggtaaaccgggttaaccccgttaaaggggggttaacccgtaaccggttaaacccgttaaaccggggtaaaaccttaaccgggtttagggtaccccggtaaccgggtttacccgaaccccggttaaccgttcgggtttaaccccgttttcccggtttaccttaccccggttaaccccgg

SEQ ID NO: 179294 - DNA, 603 bp, Homo sapiens
  misc_feature: GYAE6OF02H81YH.15.83.H06.1.454.CMB.1.raw
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (390)..(390): a, c, t, g, unknown or other
  misc_feature (390)..(390): n is a, c, g, or t
  modified_base (428)..(428): a, c, t, g, unknown or other
  misc_feature (428)..(428): n is a, c, g, or t
  modified_base (476)..(476): a, c, t, g, unknown or other
  misc_feature (476)..(476): n is a, c, g, or t
tcagtctacgtagccacgaccggtgctcgatttagatcacgtgcgtcgcgggctagaaagggcttaatatagggaagaagtggggcagggaagggggagggagaagcagaaggtgaaatgtgctggagtcctcctagttatccaataggacagatgttgaggaaggccagggatggagtctggcccagtctcacaagagggccaacagtggcccagcagacaggcccagtttggngggggattgtcttgggggtanggggagaagggctacgtttgagatagggtcaaaaggctaggggtaggaaaaggttacaggttaggaacaaggtactaggttttgactaggccatgtccaaggttggatggtagtaagagaggaaacaggaaaanaagacgtcatgacctagtagaaagtgagacaccaaagntagcagctctgagacgcagctgatcggatgttaccagaaagttgagtntagaaaacgtagggactagtaagacgtatacgtattgttttagagtcgaaggggtcgaaagggtaccacgggtaggtagggggtacgtcggttaacgggtggaacggtacgtacgtagttaaacggg

SEQ ID NO: 179295 - DNA, 655 bp, Homo sapiens
  misc_feature: GYAE6OF02GPXHC.15.83.H06.1.454.CMB.1.raw
  modified_base (221)..(221): a, c, t, g, unknown or other
  misc_feature (221)..(221): n is a, c, g, or t
  modified_base (279)..(279): a, c, t, g, unknown or other
  misc_feature (279)..(279): n is a, c, g, or t
  modified_base (624)..(624): a, c, t, g, unknown or other
  misc_feature (624)..(624): n is a, c, g, or t
  modified_base (649)..(649): a, c, t, g, unknown or other
  misc_feature (649)..(649): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccggaggagccaaatgtgacatccagatgacccagtcctccatcctcctgtctgcatctgaggagacagaatcaccatcactgccgtanaagtcaagaacattaggaattaattaaattggtaatcagcaacgaaaccgagggaacnccctaagcctctagatcgtatggtagctactacctagtttacgacggtaacggtcgggacccctagttaccgtaacggttcgtaaggtggacgtagggtcggtccgttacggtacgggtacaaggttacctttacctaaccgttcctaccgtaacccgtataccgaacggtactacggttcctaaccccggtaacctaggtaaacgtttagttttacctaacgttaacgttaccttaacgttacgtaacctaagtacgttacgttcgtaacgtccggtacccgtacggttaccggaccaacggggactaggtacgacacgtaacgaacgtaacggtcggttacgngtaccgacacgtattcgttccggtnttaccg

SEQ ID NO: 179296 - DNA, 689 bp, Homo sapiens
  misc_feature: GYAE6OF02I158L.15.83.H06.1.454.CMB.1.raw
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (429)..(429): a, c, t, g, unknown or other
  misc_feature (429)..(429): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtcctgcatctgtaggagacagaatcaccatcacgttgccgtnaagcagaacattagattattaatgtatnagnagaacaaggaacnccctaagctacctagactactactggtgctacgtaccagtttagcgtaaaacgtcggggacccaacgttacgaaacggtttacgaaggtagtacgtacgttaggacgttcgtaggggtaccaaggttactttacgaccgttctacctaccaacttcgaacgngttaaccggttctaacccgtaaccgttagaagttaacctttggaaccctaaactttactaacttcgaactaaccaagtacgtttagtaaaccggttaacgcccgggggttaaaccttcgggtacccgtaaaccgggtaacgttaacggggttaaccgaacggttttaaccgaacgtaaacccgttaacggtaacgttaaccgggtaccgtccggttaaccgggaactaccccgtaacgtttagtaccccggttttaaccg

SEQ ID NO: 179297 - DNA, 732 bp, Homo sapiens
  misc_feature: GYAE6OF02GND7E.15.83.H06.1.454.CMB.1.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
tcagtctacgtagccacgaccggtgctcgatttagatcacgtgcgtcgcgggggcaggagtcagtctcagtcaggacacagcatggacatggagggtccccgctcagctcctggggctcctgctactctggctccgaggagccaaatgtgacatccagatgacccagtcctccactcctccctgtctgctatctgtaggagacagactcacatcacttcgccgtnaagtcaagacagttaggtaattactttaagtgtatcagcagaacagggaacncctaagctcgtagtactctagtcggtgactactaccgtggttacacgtaacggtccgggaccctagttacgtaagttcgaacggtcggacgtacggtcgtcgtcggtagggtactaggtttacttaccgacgttctaccgtaccgtaactccgtaagtccggtaacgttaccgtaacccgtaaacgttaggtaaacgtttaacgtttttcgaacccgtttaacgttaaccttacgtaccttaacgtaacgttaacggtttaccgtttaccgtaaccgggttacccggttaccccgggttacggttacccggtacccgggaaaacgggttacccgtaaagggttaccggtaaccgtaaacgttaacccggtaaaaccggttacgggttaccggtacggtaccgttaacggacccgttaaccggtttaacgttacccgttacgttacccttacccgg

SEQ ID NO: 179298 - DNA, 815 bp, Homo sapiens
  misc_feature: GYAE6OF02JSXVZ.15.83.H06.1.454.CMB.1.raw
  modified_base (779)..(779): a, c, t, g, unknown or other
  misc_feature (779)..(779): n is a, c, g, or t
tcagtctacgtagccacgaccggtgctcgatttagatcacgtgcgtcgcggggggcaggagtcagtctcagtcaggacacagcatggacatgagggtccccgctcagctcctggggctcctgctactctggcctccgaggagaccaaatgtgacataccgagatgacccagtcctccactcctcctgtactgctatcgtaggtaggacgacaacgtaactaccacctactactaacgttcggtaccggtactaagtacaacgtaactagttaaacgttaatttaaactttaaggttgtaactaccaaggtaccgaaaacgaaaccgggaagggtaaccctaccccgttaagtcccttacggtaacgtacgttacgtacggttaggtaccgactaccgttacgtacgttacgaccggtaacggtccggacctagtacggtacggtacgtggacgacggtacggtgtccgtacgggtacgtaacgtacgttacttacccgtactacctaccgttaacctagaccgttaacgtacccgttacgtacccgtaacgtacggttaacggttaaccttaggtttaacccgtaacgttaaaccgtttaccttaaaccgtaggttaaccctaaacgggtttccgttaacgttaccgttaaccgggggttacccccggttaacccgggttaccggttaacgggtaacccggtaaacgggaccgggttaaaacggtccgttaaactacgggtaaaccggtaactacggggtcggtacgtacggtaacccnccgttaaagttaccgaacctttcgggttaaccctcg

SEQ ID NO: 179299 - DNA, 715 bp, Homo sapiens
  misc_feature: GYAE6OF02IBXGK.15.83.H06.1.454.CMB.1.raw
tcagtctacgtagccacgaccggtgctcgatttagatcacgtgcgtcgcgggggcaggagtcagtctcagtcaggacacagcatggacatggagggtccccgctcagctcctggggctcctgctactcgtggctccggaggagtaccaaatgtgacatccagtatcgaccctagtcctccacttccctccctgtcgtgcctatcgtaggtaggacgaacaagtactccaacctatactacgttcggaccggtacaacggtacaacgtaactagtttaaggtaaattttaagtttaaagttggtactacgacgtacgaaaacggaaaccggaacgggaacctacccctaaggtcctacgtagtactcgtagtcgtacgactacgttacgttagttacgacggtaacggtccggacctaagtacgtaggtcgaggtcgacgtggtcgacgttacggacggtactacgttactttaccgacttacctaaccgtactacgtacgacgtacctacgtacctaccgtaaagtgttaacttacttccgtaacttaccttacgttacgtctaacgtagtacgttacgtacgtaccggttacgtacccggttagtccggaaaccgaagggttacccgaggtacgtaaccgtataaaccggtaacgtgggtaccgttacggacctacggtaccgtaaccttacggttcttacccgtacgttaccg

SEQ ID NO: 179300 - DNA, 727 bp, Homo sapiens
  misc_feature: GYAE6OF02IPL33.15.83.H06.1.454.CMB.1.raw
tcagtctacgtagccacgaccggtgctcgatttagatcacgtgcgtcgcgggggcaggagtcagtctcagtcaggacacagcatggacatggacggggtccccgctcagctccgtggggctcctgctactctggctccgaggacgccaaatggtgacactccaagactcgaccctagtcctccatccctcctgtctgcatctaggtaggacgacgaagactccacctactctacgttcgccgtacgtaacgtcaagtaactagttaagtaattttaattaagttaggtacttcgacgacgtaaagaaaccggtaaagggaaacctacccgtaacgtccttaccgtagtaccttgtaagtcggtacacctacgtctacggttacgaacgtaacgggtccggaccctagtaccgtaacggttcgtacggtcggacgtacggtcggtcgtacgtacggggtaactacgtttacgtacgtaaccttcgtaacccaaccgttctaaccggagttaacccgtacgtacctaaacccgttaaccggtagtttaaacttacggtttacccgaaatttaccttaaccgtactacgtaacgtaacgtacgtttacgtaccgtaacgtcccggttcccgaacgtccgtaaccggaacgtacgacggtacgaacgtacgtaaaccgtaacggtacgacggtagtccgtagccctacgtacgtaccttcgtaactttccg

SEQ ID NO: 179301 - DNA, 830 bp, Homo sapiens
  misc_feature: GYAE6OF02HBIM3.15.83.H06.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagtctacgtagccacgaccggtgctcgatttagatcacgtgcgtcgcggggggcaggagtcagtctcagtcaggacacagcatggacatgagggtccccgctcagctcctggggctcctgctactctggctccgaggagccaaatgtgacatccagtatgacccagtctccatccctcctgtctgcatctgtaggaganaagaatcaacatacacgttcgccgtanaagtacaagtaactagttaaggtaaattttaatttaaagttaggtataccgaagaccaaacggaaaccgtacgggaaaccgtcccctaaacggccttaccgtagtaacttacgtacggtcggtacaccgtaacttccgttaaggtttacaaccgggtaaaaccggggttcccgggggtaaccccctaaagttaaccggtttaaaccggggttacgtacgggttaccggacgttacgggtacggtccgttaacgggtacgggaaacgttaacgttaacgtttacccttacccgttaacccttaccgtaacctaaccttaccggaacgtaccgttacccggttaaccctaacccgtaaaaccgtttaagggttaaacgttaacgtttttacccgaacctttaaaccgtttaacgttaccgttaacggtaaccttaacggttaacggtttacgtttaccgtaaaccggttacccgggttaccccgtagggttacccgaaaccggtaaagggtacccgtaaggtacgaacgttacgtaaaccgaaacggtactacgggtcgtaccgtaccggtaacctacgtacgtacttaccgttccttaaccgg

SEQ ID NO: 179302 - DNA, 677 bp, Homo sapiens
  misc_feature: GYAE6OF02G6N91.15.83.H06.1.454.CMB.1.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgaccctagtctccatccctcctgtctgacattcgtagtaggagacagaactcacagtcactgccgtanacgtcagtaactagttaagtaatttagtttaagttggtactacgagacaaggtaaaccgaagggaaaccncccgtaagtcctacctaggtacttacgtaggtggtacgactacgttaccgtaggttacgaacgtaaccggggtcggaccctaagtacgtaaacggttcgtaggtcggtagtaggtccgcgtacgtaacggtacgtagtacgttcactactaccgtacacgtcgacgctacttccaacgtactaggtactttagtcgtaacttacgtctactacgtaactaacttagttacttaccggtacgtaccccggttaccgtaggtacccgtaaggaaccggttacggtaacggtcgtaaaccgtacggtaaacgaaccggttaacggtcgtacggtaccgtaaccggtctaccgtttacggtacgttcccgtttaacgtacccg

SEQ ID NO: 179303 - DNA, 770 bp, Homo sapiens
  misc_feature: GYAE6OF02JBH72.15.83.H06.1.454.CMB.1.raw
  modified_base (189)..(189): a, c, t, g, unknown or other
  misc_feature (189)..(189): n is a, c, g, or t
  modified_base (375)..(375): a, c, t, g, unknown or other
  misc_feature (375)..(375): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatcgacccagtcctccatccctcctgtctgcntctgtaggagacagaatcaccatccacttcgccgtacaagtcaagaactagttaggtaatttaatttaaattgtatcagacaagaaacgaaggaaactaccctaagctacctagtactactagtggtcactactccgtagttcgacgtaacgggtccggaccctagtacgtaaggttcaggtcggntacggtcgtcgtacgtggtactacgtactttaccgacgttacctacaccctaagtccgaacggccttaacgtacccttaacccgaaaccgtttacgggtaaacgttttacgtttaccgtaaaccgtttaaaccctttaacttaaccggtttcgtaaaacccgtaaacgtttaacggtttaaccggttttacccggaacccgggtttacccgggttaacccccgggttaccgggtttaacccgggaacccggtaaaaccggggtaccggtaaacggggttaccggtaaaccgttaaaccgtaacccgggaaaccggttaaccgttaacgggtaccgggtaaccgttaccggacccttaaccgttacctttacccggttacttttacccgttacccg

SEQ ID NO: 179304 - DNA, 860 bp, Homo sapiens
  misc_feature: GYAE6OF02I4QSM.15.83.H06.1.454.CMB.1.raw
  modified_base (176)..(176): a, c, t, g, unknown or other
  misc_feature (176)..(176): n is a, c, g, or t
  modified_base (826)..(826): a, c, t, g, unknown or other
  misc_feature (826)..(826): n is a, c, g, or t
  modified_base (851)..(851): a, c, t, g, unknown or other
  misc_feature (851)..(851): n is a, c, g, or t
tcagtctacgtagccacgaccggtgctcgatttagatcacgtgcgtcgcgggggcaggagtcagtctcagtcaggacacagcatggacatgagggtccccgctcagctccgtgggctcctgctactctggctccgaggacgccaaatgtgacactccaagatcgaccctagtaccnccacttccctacccgtgtctcgactatccgtaggtaacggaacgtaagaaagtaactcctaaccgtaacttaccgtaccggtttacggacccggttaacgaaacggttaccgaaacggaaaccgtttaaaggtttaacgggttaaaactttttaaaacgttttaaaaacggtttaagggttaacttaaccggtaacgtaaaccggtaaaaacggtaaaaacccggtaaaacggggtaaaccgtaaccccgttaaaggtacccgttaaccgtaagtacgtttaacgttaggtacggtaacgtactaaccgttaccgttacgtttacggaaaccggtaaacggggtcccggaccccttaataaccggtaacggtaacgttacggtacggacgtagggacggttaccgttacgggtaacggggaacttaaggttaacccttttacgaacccttaccgtaaccgtaaccgtaacgttaaacgaccgtacgtaccgttaacctaacccgtaaacggtacgtaaagtttacttaacgtaacttaacgttactacgtacttacggaactaacggttaactacgttacggtacccgttaccggtaccgtcggaaacggtaacgtaacggacgtacggactacgtaacgacgtaacgtntacggatccgaacgtcactacgttntacgttacc

SEQ ID NO: 179305 - DNA, 738 bp, Homo sapiens
  misc_feature: GYAE6OF02JC1UM.15.83.H06.1.454.CMB.1.raw
  modified_base (175)..(175): a, c, t, g, unknown or other
  misc_feature (175)..(175): n is a, c, g, or t
  modified_base (250)..(250): a, c, t, g, unknown or other
  misc_feature (250)..(250): n is a, c, g, or t
  modified_base (336)..(336): a, c, t, g, unknown or other
  misc_feature (336)..(336): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccggaaggcgaccaaatgtagacatccagatcgacccagtccnccactccctccctgtctgcctactcttaggaggagtacaacgtaatccacctactacctacttcggaccggttanaacgtacaaacgaacgttaagttaaggtaaatttaattaaagttcggtaatcgtaacgaacaaacggaaaccgtaaggggaaaccnccccggtaaatccgaacccgtgtacgttaccgtagttagggctaccgttaattccgttaacggtttcggaaccgtaaaggggtcccgggaaccctaagtaccgttaaagggtaccgtaggggtacctagggacggttcggaccgttacggtaggtaaacgttccgttacttttaaccgccttaaccttcgtaaccctacgtaaccgtactacgtacctacgtacccgtaactagtaacgttcgtttaactacttaccttactacgacttacgaacgttacgtacgttacgtacgtaaccggtaccggttaccgttacggaccgtaacggacgtaacggagtaactaaccgtaacgtaaacgtcgaagttccgtgtacgacctacgtactacgttctacgtac

SEQ ID NO: 179306 - DNA, 690 bp, Homo sapiens
  misc_feature: GYAE6OF02GDD8E.15.83.H06.1.454.CMB.1.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
tcagtctacgtagccacgaccggtgctcgatttagatcacgtgcgtcgcgggggcaggagtcagtctcagtcaggacacagcatggacatgagggtccccgctcagctcctggggctcctgctactctggctccgaggagaccaaatgtgacatccagatgacccagtctccatcctccctgtctgcattctaggtaggagacagaactcaccatcacttcgccgtnaagtcaagaactattaggaatttaatttaaattggtatcacgacaacaaacgaagggaaccnccctaagctacctagtactactagtggtctactactccgtagtttcgaacgtaagggtcggtaccccagttacgaaggttcaggtggtctacggtggtacgtcggtacgggaactacggttactttactacgttccgtactacctagtacaagtccgtaaggtccctaaccctaacgtacgtaacgttacttttacgaacctttaactttaaccttaacgtacggttaaccaaacgttaaggtttaaccgtttaccggtaaagtacccggttaccccgggtacgtttaaccccgggacggaaaccgggaccgtaacgggtaggtacctaacggaacgtaaaccgtacggtaacggtcggacctaggacctaacccgtacttccgttacgtttaccttaccg

SEQ ID NO: 179307 - DNA, 415 bp, Homo sapiens
  misc_feature: GYAE6OF01AFSVL.23.10.A10.1.454.CMB.1.raw
  modified_base (410)..(415): a, c, t, g, unknown or other
  misc_feature (410)..(415): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagattttgcagtttattactgtcagcaccgtgacaactggcccactttcggccctgggaccagactggacatccaacgaactgtggctgcaccatctgtcttcatcttcccgccatctgaatactcgcgtctgagcgggctgggcaaggcgcatagnnnnnn

SEQ ID NO: 179308 - DNA, 553 bp, Homo sapiens
  misc_feature: GYAE6OF01ES25M.23.10.A10.1.454.CMB.1.raw
  modified_base (362)..(362): a, c, t, g, unknown or other
  misc_feature (362)..(362): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcaccatttcactggagccgtccaagaaccagtacctccctgaggctgcggtctgtcgacccccgnggacacggccgtatattactgtgcgggcttaggtcattgtgttggcgatgtctgcactaccgcgcgcaattatacgtgggcgtttggggcacgagggaccacggtccaccgtctcctcagcctcaccaggcccatccggtccttcccctcggccacccctccctccgaacgacaccaccctcgtcggggcc

SEQ ID NO: 179309 - DNA, 616 bp, Homo sapiens
  misc_feature: GYAE6OF01D78V6.23.10.A10.1.454.CMB.1.raw
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaaccccttctacattccgtccctgagagtcgagtcaccatttcactggagccgtccaaagaccagtactccctgaggctgcggtctgtgacccccggnggacaccgggccgtatacttacngtgcgggcttaaggtcattcggtgttggcgtatgtctgcactaccgcgcgctaattatttacggtgggtcgtttggggccacgacggaccacggtccaccgtctcctcgacgccctacccaccgaaacggggcccctaacgttccgggtaccctttccccccgtgggacccctacccccgttccctaccccgaaaacggacgccccaaccccgttccggtcgggggtaaccccg

SEQ ID NO: 179310 - DNA, 246 bp, Homo sapiens
  misc_feature: GYAE6OF01DA4IN.23.10.A10.1.454.CMB.1.raw
  modified_base (245)..(246): a, c, t, g, unknown or other
  misc_feature (245)..(246): n is a, c, g, or t
tcagacgcgagtatcacgaccggtgctcgatttagcgtcgatctcagggtcttcgtggctcacgtccaccaccacgcatgtgacctcaggggtccgggagatcatgagggtgtccttgggttttgggggaagaggaagactgacggtcctcccaggagttcaggtgctgggcacagcggccctgggctgcctggtcaaggactacttccatactcgcgtctgagcgggctggcaaggcgcatagnn

SEQ ID NO: 179311 - DNA, 431 bp, Homo sapiens
  misc_feature: GYAE6OF01E35XW.23.10.A10.1.454.CMB.1.raw
  modified_base (420)..(431): a, c, t, g, unknown or other
  misc_feature (420)..(431): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagattttgctagtttattactgtcagcaccgtgacaactcggccctacgtttcggccctgggaccagactggacatccaacgaactgtggctgcaccatctgtcttcatccttcccgcatctagaatactcgcgtctgacggcgggctcgggcaacgggcacatagnnnnnnnnnnnn

SEQ ID NO: 179312 - DNA, 577 bp, Homo sapiens
  misc_feature: GYAE6OF01BRWOO.23.10.A10.1.454.CMB.1.raw
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagacgcgagtatcacgaccggtgctcgatttagcgtcgatctcagggaggtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttntacattccgtccctcgagagtcgagtcaccatttcactgganccgtccaagaaccagtactccctgaggctgcggtctgtcgacccccgnggacacgggcctatattactgtcgcgggtcttaggcattgtgttggcgatgtctgcactaccgcgcgcaattattacgtgggcgtttggggcacgacgggaccacgggtcaccgtctacctcacgccctccaccgacggccccagtcccggtccttcccccgcggccctacccctcccgtacccaacgacgacctacccgtccggtgggggaccc

SEQ ID NO: 179313 - DNA, 562 bp, Homo sapiens
  misc_feature: GYAE6OF01A2WC1.23.10.A10.1.454.CMB.1.raw
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggagagcctggagttggttgcgagtatccattatcatgggcgaacccccttctacattccgtccctcgagagtcgagtcaccatttcactggagccgtccaagaaccagtactccctgaggctgcggtctgtgacccccgnggacacggccgtatnttacngtgcgggcttaggtcagttgtgttggcgtatgtctgcactaccgcgcgcaattattacgtgggtcgtttgggcacgagggaccacggtcaccgtctcctcacgcctccaccgacggcccagtaccggtccttcccccgtcggcccaccctccctcccaacgacgccacccgtcgtcgggggcc

SEQ ID NO: 179314 - DNA, 602 bp, Homo sapiens
  misc_feature: GYAE6OF01EI7J3.23.10.A10.1.454.CMB.1.raw
  modified_base (272)..(272): a, c, t, g, unknown or other
  misc_feature (272)..(272): n is a, c, g, or t
  modified_base (363)..(363): a, c, t, g, unknown or other
  misc_feature (363)..(363): n is a, c, g, or t
  modified_base (567)..(567): a, c, t, g, unknown or other
  misc_feature (567)..(567): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggccgaacccccttntaccattccgtccctcgagagtcgagtcaccatttcactggagccgtccaaagaaccagtactccctgaggctgcgtctgtcgacccccgnggacacggccgtatacttactgtgcgggcttaggtctattgtgttggcgtatgtctgcactaccgcgcgctaattacgttacggtgggtcggtttggggccacgacgggacccgtacgggtcgtacccgtcgtccctcacgccctacccaccgaacgggtccccaagtccggttccttccccccgcggtcccacccccttcccnccctaaacggacgaccaccctcggtcgggggaccc

SEQ ID NO: 179315 - DNA, 415 bp, Homo sapiens
  misc_feature: GYAE6OF01BT9FR.23.10.A10.1.454.CMB.1.raw
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (412)..(415): a, c, t, g, unknown or other
  misc_feature (412)..(415): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcaggtgggtctgggacagacttcactctcaccatcagcagtgtagagcctgaagtattttgctagtttattactgtcagccacgtgacaacgtcggccctacgtttccggcccgtgggaccagactggacataccaacgaactgtgctgcacatctgtctcatcctcccgcatctanatctcgtcgtcngcgcggctggcaggcgcatgnnnn

SEQ ID NO: 179316 - DNA, 562 bp, Homo sapiens
  misc_feature: GYAE6OF01A25KA.23.10.A10.1.454.CMB.1.raw
  modified_base (358)..(358): a, c, t, g, unknown or other
  misc_feature (358)..(358): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggagagcctggagttggttgcgagtatccattatcatgggccgaacccccttctacattccgtccctcgagagtcgagtcaccatttcactggagccgtcaagaccagtactccctgagctgcggtctgtcgacccccgnggacacggccgtatacttactgtgcgggtcttaggcattgtgttggcgagtgtctgcactaccgcgcgcaattattacggtgggtcgtttcgggcacgagggaccacggtcaccgtctcctcacgcctccaccgacggcccagtccggtccttcccccgtcggccacccctccctaccaacgacgaccaccctcgtcggggacc

SEQ ID NO: 179317 - DNA, 579 bp, Homo sapiens
  misc_feature: GYAE6OF01A71LJ.23.10.A10.1.454.CMB.1.raw
  modified_base (528)..(528): a, c, t, g, unknown or other
  misc_feature (528)..(528): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcaccatttcactggagccgtccaagaccagtacctccctgaggctgcggtctgtcgaccccgcggacacggccgtatattactgtgcgggcttaggtcagttgtgttggcgatgtctgcacgtaccgcgcgctaattattacggtgggtcgtttggggcacgagggaccacgggtcacccgtctcctcacgcctccgaccaacgggccccagtcccggtccttccccccgnggccctacccctccctacccaacgacgacccgaccctcggtcgggggaccc

SEQ ID NO: 179318 - DNA, 451 bp, Homo sapiens
  misc_feature: GYAE6OF01EI4F2.23.10.A10.1.454.CMB.1.raw
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
  modified_base (435)..(451): a, c, t, g, unknown or other
  misc_feature (435)..(451): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctggggacagacttcactctcaccatcagcagtgtagagcctgaagattttgcagtttattactgtcagcaccgtgacaactgccctactttccggccctgggacccagactacggacactaccgaaacgaacgtgtgtcgtcgccaccactctcgtcttctacttccttcccgtcctactctacgtactactcgtcgtcgtgnggcggcgtgacgagcgcanannnnnnnnnnnnnnnnn

SEQ ID NO: 179319 - DNA, 571 bp, Homo sapiens
  misc_feature: GYAE6OF01EH7MT.23.10.A10.1.454.CMB.1.raw
  modified_base (271)..(271): a, c, t, g, unknown or other
  misc_feature (271)..(271): n is a, c, g, or t
  modified_base (361)..(361): a, c, t, g, unknown or other
  misc_feature (361)..(361): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttntacattccgtccctcgagagtcgagtcaccatttcactggagccgtccaagaaccagtactccctgaggctgcggtctgtcgacccccgnggacacggccgtatacttactgtgcgggtcttaggtctattggtgttggcgtatgtctgcactaccgcgcgctaattattacgtgggtcgtttggggcacgagggaccacggtcaccgtctcctcacgcctccaccaacggcccagtccggtccttcccccgtcggcccacccctcctaccctaacgacgaccaccctcgtcgggggacc

SEQ ID NO: 179320 - DNA, 596 bp, Homo sapiens
  misc_feature: GYAE6OF01EG8K4.23.10.A10.1.454.CMB.1.raw
  modified_base (368)..(368): a, c, t, g, unknown or other
  misc_feature (368)..(368): n is a, c, g, or t
  modified_base (552)..(552): a, c, t, g, unknown or other
  misc_feature (552)..(552): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggccgaacccccttctacattcccgtccctcgagagtcgagtcaccatttcactggacgccgtccaagaaccagtacctccctgagctgcggtctgtcgaccccgcggacnccggccgtatactactggtgcgggctttaggtctaagtttggtgttcgggcgagtgtctgcctacgtaccgcgccgactaattacgttacggtcgggtcgtttggggactacgacgggacctacggtccaccgttcctcctcacgtcccaccaccgaacggcccagtccggtcccttcccccgnggccccaccctcccacctaacgacacccgactccggtggggacc

SEQ ID NO: 179321 - DNA, 665 bp, Homo sapiens
  misc_feature: GYAE6OF01CF2P8.23.10.A10.1.454.CMB.1.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (641)..(644): a, c, t, g, unknown or other
  misc_feature (641)..(644): n is a, c, g, or t
  modified_base (646)..(665): a, c, t, g, unknown or other
  misc_feature (646)..(665): n is a, c, g, or t
tcagacgcgagtatcacgaccggtgctcgatttagcgtcgatctcaggggtctccaggggaaagagcccaccctctcctgcagggccagtgacaatgttaggaagttgttagcctggtatcaacacaaacatggccaggcctccccggctcctcatctatgatgcatccaatagggccactggcactcccagactaggttcagtggcaggtgggtctgggacagtacttcactcncaccntcagcagtgtacgagtcctagaaggttattttcgacttaagttttattacgtgtcacgccgtaccgtagaacctaacgtccggtaccccttacgtttcccggcccgtaggggaacccctaaggtacccgttaggaacctaaccgtacccgaaaaccggtaacgttcggtaacggtccgttacggaacccctaaccgttaacgttccttacggttttaccttacccttaaccgttccccctttacccccggaccttaactttcccgtaacggtttaaaaccttccccggttccgggttaccccgttacggttacgggtaaccggggtcccgggggtacgttaccgggggaaccccggtaaagggccccggtaacctaaggttaaggtcacggcgngncgctnnnncnnnnnnnnnnnnnnnnnnnn

SEQ ID NO: 179322 - DNA, 606 bp, Homo sapiens
  misc_feature: GYAE6OF01B35JF.23.10.A10.1.454.CMB.1.raw
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggccgtaaacccccttctacacttcccgtccctcgagagtcgagtcacctatttcactggacgtcccgtccaaagaaccagtacctcccngagctgcgtctgtcgaccccgnggacacggcgtatagtactgtgcgcttaggtcattcgtgtggcgatgtctgcacgtcgcgcncaattattacgtggtcgttgggcacgacgggaccgacggtcaccgtcctccgtcacgccctccgaccgtaacggcccctaagtcccggtcccgttacccccgtccgggtacccacccccgttcccgtacccgtaacggtacgtaccccacccgttccggtccggggggaaccccg

SEQ ID NO: 179323 - DNA, 465 bp, Homo sapiens
  misc_feature: GYAE6OF01B49SQ.23.10.A10.1.454.CMB.1.raw
  modified_base (435)..(435): a, c, t, g, unknown or other
  misc_feature (435)..(435): n is a, c, g, or t
  modified_base (440)..(465): a, c, t, g, unknown or other
  misc_feature (440)..(465): n is a, c, g, or t
tcagacgcgagtatcacgaccggtgctcgatttagcgtcgatctcaggggtctcccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctggggacagacttcactctcaccatcagcagtgtagagcctgaagattttgctagtttattactgtcagctaccgtgacaactcggccctactttccggccctgggaacccagactggactatacccaaacgaactggtacggctgaccaccatctgttcttccattcttcccgccattctagaatactcgcgtctggagcgggctagggacaagggccgtanagtgnnnnnnnnnnnnnnnnnnnnnnnnnn

SEQ ID NO: 179324 - DNA, 460 bp, Homo sapiens
  misc_feature: GYAE6OF01CG9HY.23.10.A10.1.454.CMB.1.raw
  modified_base (286)..(286): a, c, t, g, unknown or other
  misc_feature (286)..(286): n is a, c, g, or t
  modified_base (430)..(430): a, c, t, g, unknown or other
  misc_feature (430)..(430): n is a, c, g, or t
  modified_base (433)..(460): a, c, t, g, unknown or other
  misc_feature (433)..(460): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtggtctgggacagacttcactctcaccatcagcagtgtagagcctgaagtattttgctagtttattactgtcagctacgtnacaactcggccctacgtttccggcctgggaccagactggacactaccaacgactgtgctgcacatctgtcttcactcctcccgctatcgtataactccgtcgcgtcgtgacggtccgggctacgggcaaggccgactaagtcgncgnnnnnnnnnnnnnnnnnnnnnnnnnnnn

SEQ ID NO: 179325 - DNA, 655 bp, Homo sapiens
  misc_feature: GYAE6OF01EZHD4.23.10.A10.1.454.CMB.1.raw
  modified_base (274)..(274): a, c, t, g, unknown or other
  misc_feature (274)..(274): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggagagcctggagttggttgcgagtatccattatcatcggggaccgaacccccttntaccattcccgtccctcgagacgtcgagtcacctatttccacgtggacgcccgtaccaacgaacccagtacctccctgacggctgcggtctgtcgaccccgnggacncggcctatacttacgtgtcggcgggtcttaggtctagttgttaggttggcgtatcgtctgctacgtaccgcgcgtactaagttagttacggtgggtcggtttcggggactacggacgggaccgtaccggtccgtaccgtcctccgtcgtacgtccctccgaacccgaacgggtccccaacggttcccggtcccttaccccccggtcggcccctaccccgttcccgtaccccgtaaacggaccgaccctacccggttcgggtcgggggtaccccg

SEQ ID NO: 179326 - DNA, 419 bp, Homo sapiens
  misc_feature: GYAE6OF01D7O05.23.10.A10.1.454.CMB.1.raw
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (409)..(419): a, c, t, g, unknown or other
  misc_feature (409)..(419): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggcctccccggctcctcatctatgatgcatccaatagggccactggcatcccagacaggttcagtggcagtgggtctgggacagacttcactctcaccatcagcagtgtagagcctagaagtattttgactaagtttatactgtcagcacgtgacacgtgccctacttcggccctggacagactgacatccaaacgactgtgctgcacatctgtctcatccttcccgctatctagactactcgctctgacgcgggntggacaaggcgtnatgnnnnnnnnnnn

SEQ ID NO: 179327 - DNA, 645 bp, Homo sapiens
  misc_feature: GYAE6OF01BJ6IR.23.10.A10.1.454.CMB.1.raw
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattggcctggatccggcacgcccccgagggaagagcctggagttggttgcgagtatccattatcatcggggccgaacccccttcgtacactttcccgtcccctcgagagtcgagtccacctatttcactggacgccgtccaagaaccagtacctccgngagctgcggtcngtcgaccccgnggacacggcctatcttacgtgtgcgggtacttaggtctagtttggtgttcggcgtagtgttcgtgccgactacccggcgccgactaacgtttacgttacggtcgggttcgggtttcgggcgtacgacgggaccgtaccgggtaccgtacccgttccttcccgtcgacgcccctacccgaccgaaccgggccctacgtccggttcccgttcccccgtcggtcccctacccgtcccctaccgaaccgacgacccaccgttccgtcggggtacccg

SEQ ID NO: 179328 - DNA, 570 bp, Homo sapiens
  misc_feature: GYAE6OF01EANZS.23.10.A10.1.454.CMB.1.raw
  modified_base (359)..(359): a, c, t, g, unknown or other
  misc_feature (359)..(359): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggagagcctggagttggttgcgagtatccattatcatgggcaacccccttctacatttcccgtccctcgagagtcgagtcaccatttcactggagccgtccaagaaccagtactccctgagctgcggtctgtgacccccgnggacacggccgtatattactgtgcgggcttaggtcattgtgttggcgtatgtctgcactaccgcgcgctaattatacgtgggcgttttggggcacgagggaccacggtcaccgtctcctcgagccctccaccgacgggcccagtccggtccttcccccgtggcccacccctccacccgaacgtacgacccgtaccctccgtcgggggaccc

SEQ ID NO: 179329 - DNA, 624 bp, Homo sapiens
  misc_feature: GYAE6OF01ALQ8B.23.10.A10.1.454.CMB.1.raw
  modified_base (578)..(578): a, c, t, g, unknown or other
  misc_feature (578)..(578): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcagtgggccgaacccccttctacattcccgtccctcgagacgtcgagtcacctatttccactggacgccgtaccaagaaccagtacctccctgacggctgcggtctcgtcgacccccggcggacacggccgtatacttacgtgtcggcggcgtttaggtctagttggtgttggacgtagtcgtcgtcgcctaccgtacccgcgccgtactaagtttacgttacggtgggtccggtttggggcacggacgggacccgtacggtctacccgtctccctcgacgcccgtaccaaccgtacggccctagttcccggtcccttcccccgnggccctaccccgtccacccgaacgcgaccctcgtccggtggggacc

SEQ ID NO: 179330 - DNA, 628 bp, Homo sapiens
  misc_feature: GYAE6OF01AJZ43.23.10.A10.1.454.CMB.1.raw
  modified_base (382)..(382): a, c, t, g, unknown or other
  misc_feature (382)..(382): n is a, c, g, or t
  modified_base (527)..(527): a, c, t, g, unknown or other
  misc_feature (527)..(527): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcacgcccccgagggaagagcctggagttggttgcgagtatccattatcagtcgggccgtaacccccttctactacttcccgtccctcgagacgtcgagtccacctatttcactggacgccgtaccaacgaaccacgtacctcccgtgacggctggcggtctcgtccgaccccgnggaccgacggccgtatacgttacgtggtcggcgggtcttaggtctagttggtgttggcgtatgtctgccacgtccgcgacgctaattacgttcggtggtcggtttcgggcacgacgggaccgaccggtcctaccgtcctccgtcncgcccgtacccgaccgaccgggccctacggtcccggttcccttccccgcggccccaccccgtccctacccgaacgccgacctcccgtccggtcggggaccc

SEQ ID NO: 179331 - DNA, 758 bp, Homo sapiens
  misc_feature: GYAE6OF01DFFBF.23.10.A10.1.454.CMB.1.raw
  modified_base (257)..(257): a, c, t, g, unknown or other
  misc_feature (257)..(257): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcacgcccccgagggaacgagccgtggagttggttgcgagtatccattancagtggccgtaacccccttctactacttccgtccctcgagtagtcgagtcacctatttcacgtggacgcccgtaccaaacgaacccagttaacctccccgtagacggacgtggccgggttctcggtaccggacccccggcggacccgtacgggacccgtattaaactttacgtcggttcggcgggtacgtttacgggtacttagtttcgggttggtttacgggtccgtagttcggttcgttcggacctaaccggttaccgccggccggtactaacgttttaacgttaccgggttcgggttccgggtttacggggacgtacgggtacgggaacccgtaccgggtccgtacccgtccgtcctaccgaccgtccctacccgacccgtaaaccgggcccctacgttcccgggttcccctttccccccgtacgggccccctaccccgttacccgaccccgtaaacggacccgacccggttacccgtccgggtcgggggtaaccccg

SEQ ID NO: 179332 - DNA, 755 bp, Homo sapiens
  misc_feature: GYAE6OF01DDHB3.23.10.A10.1.454.CMB.1.raw
  modified_base (282)..(282): a, c, t, g, unknown or other
  misc_feature (282)..(282): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgtactccttcagtaacacagattattagttgggcctggatccggcagcccccgagggaagagccgtggagttgggtgcgagtactcctattatcagtcgggaccgtaaaccccttntaacctacttcccgtcccgtacgagacgtcgacgtcacctattcaacgtggacgccgtaccaaacgaaccacgtacctcccgtagacggtctcggcggtctcggtaccgcccccggtacggaccgaccggtaccgttatacgtttaccgtcggtcggacgggtcttaggtctaacggtttggtaggttcggacgtagttacgtctacggtcaacgtaccgcgtacgtactaagtttacggtacggtcggggtttcggtttacggggaccaacgggtacgggtaaccccgtacggttccccggaaccgttcctccccgtcgtaaccgtcccttaacccggaaacccggtaaccggggcccctacggttcccgggtttcccccttccccccgggtaggtcccccgttaaaccccccggttcctaaacccggaacggtaccgaccccgttaccggtcccgggttacgggggaaccc

SEQ ID NO: 179333 - DNA, 1008 bp, Homo sapiens
  misc_feature: GYAE6OF01EF5K1.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctcgtccctcatttgcttctgtctctggtcgactccttcaagtaacactagtatttatttagttcgggcctggacgtcccggcaccggacccccgagggaagacgtccgtagggtaggtttggttcggacgtagttactccgtaatttacgcgtaggtccgggggaacccccttaaaccccccgtttctaaccgtaccgttttccccggtaccccgttaggacggtaccggttaccggtaacgtttcccaaccgtttattttaccccgacggtttacggggaccgttacccccggttaaccgtaaaaaccgggaacccctaacggtttaaccccgtccccgtagggtaccgggtccttacgggtccggtttccgtacggaccccgggacccccggacggtaccgacccgggtacttaagttaccgttaccggtggtcgggtaccggttacgtttacggtcgttagtttgggttcggttacgggacgttagttcgttacccgtcggtacccgtaacccttacccgggccgtaccgttaaccgtttaaagttttacccggggttacgggttcgggggtttaaccgggttttacggggaacccgtaccgggaacccggggttaccccgtaaccggtttacccccggacccgttttacccgtacccgttacccggaccccggtttaccccctaacccgggtaaaccccgggtacccccggttacccgttaaacccgggtttccccccggttaccccccgtttacccccgggtacccggtacccccccttacccccgttaaccccggtacccggtaaaccggtccccgttaaccccggttaccccggggttcccgggggaacgggtacccccgg

SEQ ID NO: 179334 - DNA, 748 bp, Homo sapiens
  misc_feature: GYAE6OF01EVT4J.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagccctgcggagaccctgtccctcatttgctctgtctctggtgactccttcagtaacacagattattattgggcctggactccggcacgcccccgagggaagacgcctggagttggttgcgagtatccattactcgagtcggggaccctaaaccccctttctaactacgttcccgtccccttcggacgacgtcgacgtccacctatttccgacgtcgggacgtcccggtaccaaacggaacctacggtaccctcccgtaggacggtctggtccggtctcggtccggacccccgcggaacgccgggtacctattacgttacgtggtcgggtcgggtactttacggtactaggtttggtggttcggacgtagttcgttcgtcgtacccgtaccgttaccggcggtaccgtacttaagtttacgttacgggttcggggtcggtttacggggacctaccggacgggtacccgtacgggtcccgtaccgttccgtaccgtcgacccgtccctaccgaccggtacgggtacccctcggttacccggtccccttaccccggcggtaccccacccccgttcccgacccgtaaacggtcccctacccgacccggttcgggccggggtaaccc

SEQ ID NO: 179335 - DNA, 683 bp, Homo sapiens
  misc_feature: GYAE6OF01BLI0O.23.10.A10.1.454.CMB.1.raw
  modified_base (263)..(263): a, c, t, g, unknown or other
  misc_feature (263)..(263): n is a, c, g, or t
  modified_base (639)..(639): a, c, t, g, unknown or other
  misc_feature (639)..(639): n is a, c, g, or t
  modified_base (646)..(646): a, c, t, g, unknown or other
  misc_feature (646)..(646): n is a, c, g, or t
  modified_base (651)..(651): a, c, t, g, unknown or other
  misc_feature (651)..(651): n is a, c, g, or t
  modified_base (653)..(654): a, c, t, g, unknown or other
  misc_feature (653)..(654): n is a, c, g, or t
  modified_base (656)..(658): a, c, t, g, unknown or other
  misc_feature (656)..(658): n is a, c, g, or t
  modified_base (660)..(665): a, c, t, g, unknown or other
  misc_feature (660)..(665): n is a, c, g, or t
  modified_base (667)..(667): a, c, t, g, unknown or other
  misc_feature (667)..(667): n is a, c, g, or t
  modified_base (669)..(671): a, c, t, g, unknown or other
  misc_feature (669)..(671): n is a, c, g, or t
  modified_base (673)..(681): a, c, t, g, unknown or other
  misc_feature (673)..(681): n is a, c, g, or t
  modified_base (683)..(683): a, c, t, g, unknown or other
  misc_feature (683)..(683): n is a, c, g, or t
tcagacgcgagtatcacgaccggtgctcgatttagcgtcgatctcaggggtctccagggggaaagagcccaccctctcctgcagggccagtgacaatgttaggaagttgttagcctggtatcaacacaaacatggccaggcctccccggctcctcatctatgatgcataccaaagtacgggccctactggcactccccaagacgtaggttcgaggtggcgtagggtgggtctaggggacagtacctttcactcctaccactancgagctaggtgtagacgtaccttaggtaaagtttagttttggaccgtttaaagtttttacgttaacgttcgttaccaacggtaccctaaccggtgaacccttaacggtcccgacccccgtttaccggttttcccggacccggttacgggacccgtaagtaccggtacgaactaccaacccgaacggtaacgttcggtcgtaccgtcgaaccctacccgtagtttccttcgttacccctttctaccgttttcccccgtaccgtaccttacgtttacgtaacgtaacccgtttaccccgcgggttacccgtttcggtaacggcccggggtacggtccgggttaacggaaccccgggttaagccgggtaacttacggtncggactncgcgngnngnnngnnnnnngncnnncnnnnnnnnngn

SEQ ID NO: 179336 - DNA, 483 bp, Homo sapiens
  misc_feature: GYAE6OF01D4FFZ.23.10.A10.1.454.CMB.1.raw
  modified_base (466)..(483): a, c, t, g, unknown or other
  misc_feature (466)..(483): n is a, c, g, or t
tcagacgcgagtatcacgaccggtgctcgatttagcgtcgatctcaggggtctccagggggaaagagccacccctctccctgcagggccagtgacaatgttaggaagttgttagcctggtatcaacacaaacatggccaggcctccccggctcctcatctatgatgcatccaatagggccactggcatcccagacaggttcagtggcaggtgggtctggggacagtacttcactctcaccatcagcagtgtagacgcctgaagtattttgcctaagttttattactgtcacgcaccgtgactaacgtcggccctacgtttccggccctcgggaccagactggacactaccaacgacgtggtgctgccaccatctgtcttcactcccttcccgactactctacgtaactaccgtccgtcgttacgtggacggccgggtctacgggacgtaacgggcgactagtacgnnnnnnnnnnnnnnnnnn

SEQ ID NO: 179337 - DNA, 901 bp, Homo sapiens
  misc_feature: GYAE6OF01BW5B5.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctctatttgctctgtctctggtacgacctccttcagtaacacagtattattagttcggcctggactccggacacgccccgaagggaagacgccgtggtaggtttggtaggacgtaagtactaccgtattacgtacgacggtacgggaccccgttaaccccctttacgtaacccgttaacccgttttcccccggtaccccggtaccggtaacggtaaccggttaccggtaaccggttaccctaacccgttaacttttacccgaaccggttacggggtacccgtaaccccggtttaaacccgaaacggtaaaccccgtaacggttacccgtaccccgtaggtaaccgggtctacgggtccgttacgtcggtacccggacccgccggaacgaccggtaccgttaagtaacgttcgtggtccgggtacggtacgttaggtacttagttacggtggtttacgggcgtagttcgtcgtaggtacccgtaaccgtccgtacgacccgttaagttaacgtttaacgggttacgggtcggggttacggttacgggactaccgggacggtaaccccgtacggtacccgttacccgtaccgtccgtaccggacccgtacccttaacccgggaaccgtaacccggggtccccttaacgggtttccccggtacccccgttaccccgacgggttacccccctacccgttaaccccgacggtaacccggtaccgacccccgtaacgggtccggggtaaccggaaccccggg

SEQ ID NO: 179338 - DNA, 626 bp, Homo sapiens
  misc_feature: GYAE6OF01E0NM8.23.10.A10.1.454.CMB.1.raw
  modified_base (364)..(364): a, c, t, g, unknown or other
  misc_feature (364)..(364): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattggcctggatccggcagccccagggagagcctggagttggttgcgagtatccattatcatcgggccgaacccccttctacacttccgtccctcgagacgtcgagtcacctatttcactggacgccgtcaagaaccagtacctcctgagctgcggtctcgtcgacccccggnggacgacggtccgtatacttacgtgtcgcgggtcttaggtctagttgtgttggcgtatgtcgtgtcgtactacgcgtacgtacgtaattacgttacggtgggtcggttttggggcgtacgacggggtaccgtacggtaccgtaccggtcctcccgtacacgtaccctccacccggacggtcccgtacgtcccggttcccgttccccgtcggccctacccctcctaacccgacggtaccaccctcccgtccgtcgggggaccc

SEQ ID NO: 179339 - DNA, 831 bp, Homo sapiens
  misc_feature: GYAE6OF01AU50M.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagcctggcggagaccctgtccctcatttgctctgtctctggtgactccttcagtaacacagtattattattagggcctggactccggcacgcccccgagggaagacgcctggagtttggtgcgtagtactcctattactcgagttcggggacctaaacccccgtttcgtaacctacgtttccccggtaccccttcggacggtacgttaccggacgtacctaccctaacttttccgaacgttacgggacttccccggtaaccaaaacggtaaacccctaggtacccctacccgttacgggaacggtccctacgggtaccggttccgttacggtacccggacccccccggacggggaacccgtaacccggggtcccgtttaaattaccgtttaacggtcgggtttacgggcccggggttaacggtttaacgggtctaacggtttggtacggttcggtaccgtagttcgtcgtacgtcctaacgtaccggtcgaccgtactaagttacgttaccggtggggttcggtttcgggactaccggagggtacccgtacgggtcctaccggtccgttcccgttacaccgtaccccgtacccgaacccggtaccggaccccgtaggttccccgttcccgttcccccctcgggtccccaaccccgttccctacccgtaaaccgacccgacccgtacccgtccggccggggtacccg

SEQ ID NO: 179340 - DNA, 817 bp, Homo sapiens
  misc_feature: GYAE6OF01C25VQ.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtccgggcccaggactggtagaagcctggcggacgaccctcgtccctctatttgctctcgtctcgtgggtcacctccttacaacgtaacacagtatttacttagttcgggccttaggacctccggaccaccggacccccggaagggaacgagtccggtggtaggttggtgcgtagtactacattagcacggtccggacccgtaaccccttactactaccgttcccgtacctacgagtacgtacggtactcgtaacctattaccgacgtacggaccgtaccgtaaccaacggaacctacggttacccgtccgtaggaccggtctaccggtacggttccgtaccggtaccccggaacccccggaacgacccggtaaccgggtaccgttaaacgtaacccgtttacggtcggttaccggggtaccgggtttacgttacgggttacgttaaggtttcgggtacggtccggtagtaacggttcggttcgtaccgacctaccggtaccggccgacgtaacttaacggttacggttaacggtcggggttcggttacgggacgaccgggacggtaacccgtacgtcccgtaccgtaccgtacctacggaccctacccgtacccgacgaccggtcccgtacgtccgttccccctacccggccgtaccctaccccgtaccaccgtaaccgaccgaccctcccggtacggggtccggaaccgg

SEQ ID NO: 179341 - DNA, 672 bp, Homo sapiens
  misc_feature: GYAE6OF01BYHBM.23.10.A10.1.454.CMB.1.raw
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
  modified_base (645)..(672): a, c, t, g, unknown or other
  misc_feature (645)..(672): n is a, c, g, or t
tcagacgcgagtatcacgaccggtgctcgatttagcgtcgatctcagggggtctccagggggaaagagccaccctctcctgcagggccagtgacaatcgttaggaagttgttagcctggtatcaacacaaacatggccaggcctccccggctcctcatctatgatgcatccaagtacgggccactggccatcccagacgaggttcaggtggcgaggtgggtcgtggggacacgtacttccgactcctaccaaccatcacgcgtagtacggtagacgtcctaggtaacgtttagttttgacttaagttttacttacgtggtaccacgccgtaaccggtacgtaacccgtacgtcccgggtccccttaccggtttccccgggccccggttacgggaacccctagggtacccgtacgggtaacccaaccgttaaccccgaaacggttaaccgttcggggtacggtaccgttaccggaccctaaccgttacttccgttacgttccctttacctaccgtttcccccgtaccccgtactaacgttaccgttaacgtaaacccttccgttaccggtaccggttcgtaccggggacgggtcccgggttaccggtcgggaaccggtacgggccgtaacgtagtacggncgcngnnnnnnnnnnnnnnnnnnnnnnnnnnnn

SEQ ID NO: 179342 - DNA, 877 bp, Homo sapiens
  misc_feature: GYAE6OF01ADIPE.23.10.A10.1.454.CMB.1.raw
  modified_base (717)..(717): a, c, t, g, unknown or other
  misc_feature (717)..(717): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctggcggacgaccctgtccctcatttgctctgtctcgtggtgactccttcaagtaacacagtattattagtcgggcctggactccggcacgcccgagggtagacgccgtggtagttggtgacgagtactcctattactcgacggtcgggacccgtaaccccttctaccgttacgttcccgtccgtacgtacgtcgtaccgacgtcctaaccgtactttaccgaccggtcgggaccgtcccgtaaccgaaaccgtacctacgttaccctcccgtagggtacggaccgttcggcgggttcctaccggtacccggacccccggacgggtaacccggtaccgggtaccgtttaacgttaccggttacggtcgggtaccggggtccggggtttacgtttaacggttcgttacgggttttcgggttacgggttgggtacttacggtttacggtcgttaacccgtcccgtaacccggtaccggtccggttacgtaacgtttaagtttacggggttacccggggtgggtttaccggggttcgggaaccgtaccggggtaacgggtcccgttacccgggtcccgtaacccgtttcccnccgggtaccgtaccccgtcccgtaacccgggaccgggtacccggtaccccgtcggtttcccccggtttacccgtccccccggtaggaccccccttaccccggtcgttaaaccccggcggtaccccgtacccggttcccgggtcggggtcccggggaaccc

SEQ ID NO: 179343 - DNA, 629 bp, Homo sapiens
  misc_feature: GYAE6OF01DODSR.23.10.A10.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (467)..(467): a, c, t, g, unknown or other
  misc_feature (467)..(467): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggtgcgagtatccattancatgggcgaaccccttntaactacgttccgtccctacgagacgtcgacgtcaacctactttccaactcggacgcccgttacaaagaaccagtactccctgacggctgccggtctgtcgaccccgtgacacggccgtatacttacgtgtcgcgggtcttaggtctagttggtcgttggctagtgtctcgctactacgcgcgactaattcgttacgngggtcgtttgggctacgacgggaccgcggtacgtaccggttcctacctcacggccctaccgaaccgtacggcccctagtcccggtacccgttcccccgcggtaccccacccgttcccgtaacccgaacgtaccgccgtaaccctccgggtacgggggaaccc

SEQ ID NO: 179344 - DNA, 249 bp, Homo sapiens
  misc_feature: GYAE6OF02I6X2Y.23.10.A10.1.454.CMB.1.raw
  modified_base (244)..(249): a, c, t, g, unknown or other
  misc_feature (244)..(249): n is a, c, g, or t
tcagacgcgagtatcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccatactcgcgtctgagcgggctggcaaggcgcatagnnnnnn

SEQ ID NO: 179345 - DNA, 522 bp, Homo sapiens
  misc_feature: GYAE6OF02GYNFS.23.10.A10.1.454.CMB.1.raw
  modified_base (248)..(251): a, c, t, g, unknown or other
  misc_feature (248)..(251): n is a, c, g, or t
  modified_base (253)..(255): a, c, t, g, unknown or other
  misc_feature (253)..(255): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (288)..(290): a, c, t, g, unknown or other
  misc_feature (288)..(290): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (299)..(300): a, c, t, g, unknown or other
  misc_feature (299)..(300): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
tcagacgcgagtatcacgaccggtgctcgatttagcgtcgatctcagggtcttcgtggctcacgtccaccaccgacgcatgtgacctcaggggtccgggagactcatgagggttgtccttgggttttgggggaagaggaagactgacggtcccccaggagttcaggtgctgggcacagcggccctgggctgcctggtccaaggctacttccatactcggcgtctgagcgggctggcaaggcgcatagnnnntnnntcntagnantntntgcacnagcagcacncncannnctnatgngnntcncngcgtcgcngcntcgncngngntgcgtactactcnctcgacactgtacagtcncgtagcgtacgtactagtatcgtcgtacgtactacgttcttagtacgtacgtacgtacgtacgtacgttacgttacgtacgttacgtacgtacgtacgtacgtacgttcggtacgtacggtacgtacgtacgtacggtacgtacgtacgtacgtacgtacgtacg

SEQ ID NO: 179346 - DNA, 238 bp, Homo sapiens
  misc_feature: GYAE6OF02FFUOJ.23.10.A10.1.454.CMB.1.raw
  modified_base (238)..(238): a, c, t, g, unknown or other
  misc_feature (238)..(238): n is a, c, g, or t
tcagacgcgagtatcacgaccggtgctcgatttagcgtcgatctcagggtcttcgtggctcacgtccaccaccacgcatgtgacctcagggtccggagatcatgagggtgtccttgggtttgggggaagaggaagactgacggtcccccaggagttcaggtgctgggcacagcggccctgggctgcctggtcaaggactacttccatactcgcgtctgagcggctggcaggcgcatgn

SEQ ID NO: 179347 - DNA, 413 bp, Homo sapiens
  misc_feature: GYAE6OF02F1B36.23.10.A10.1.454.CMB.1.raw
  modified_base (405)..(413): a, c, t, g, unknown or other
  misc_feature (405)..(413): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagattttgcagtttattactgtcagcaccgtgacaactggcccactttcggccctgggaccagactggacatccaacgaactgtggctgcacatctgtcttcatcttcccgcatctgaatctcgctctgagcgggctggcaaggcgcatagnnnnnnnnn

SEQ ID NO: 179348 - DNA, 592 bp, Homo sapiens
  misc_feature: GYAE6OF02H2Q21.23.10.A10.1.454.CMB.1.raw
  modified_base (359)..(359): a, c, t, g, unknown or other
  misc_feature (359)..(359): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattcccgtccctcgagagtcgagtcaccatttcactggagccgtccaagaccagtactccctgaggctgcgtctgtcgaccccgnggacacggccgtatattacgtgtgcgggcttaggtcagtttgtgttggcgtatgtctgcactaccgcgcgcaattattacgtgggtcgtttggggcacgagggaccacggtcgaccgtctcctcagccctaccgaccgaacgggccctaacgtccgggtccctttccccccgtcggtccctaccccctcccgttacccgaacggtaccgacccacccgttcgtcgggggaccc

SEQ ID NO: 179349 - DNA, 411 bp, Homo sapiens
  misc_feature: GYAE6OF02F0NOE.23.10.A10.1.454.CMB.1.raw
  modified_base (404)..(411): a, c, t, g, unknown or other
  misc_feature (404)..(411): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagattttgcagtttattactgtcagcacgtgacaactggcccactttcggccctgggaccagactggacatccaacgaactgtgctgcacatctgtcttcatcttcccgcatctgaatactcgcgtctgagcgggctggcaaggcgcatgnnnnnnnn

SEQ ID NO: 179350 - DNA, 564 bp, Homo sapiens
  misc_feature: GYAE6OF02GDDRS.23.10.A10.1.454.CMB.1.raw
  modified_base (359)..(359): a, c, t, g, unknown or other
  misc_feature (359)..(359): n is a, c, g, or t
  modified_base (479)..(479): a, c, t, g, unknown or other
  misc_feature (479)..(479): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcaccatttcactggagccgtccaagaaccagtactccctgagctgcggtctgtgacccccgnggacacggccgtatattactgtgcgggcttaggtcattgtgttggcgatgtctgcactaccgcgcgcaattattacgtgggtcgtttggggcacgagggaccacggtcaccgtctcctcncgcctccaccgacggcccagtccggtccttcccccgtggccctaccccgtcctcccaacggacgccaacccgtcgtcgggggacc

SEQ ID NO: 179351 - DNA, 586 bp, Homo sapiens
  misc_feature: GYAE6OF02JTTOG.23.10.A10.1.454.CMB.1.raw
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattatgggcctggatccggcagcccccagggaagagcctggagttggttgcgagtatccattatcatgggcgaaccccttctacattccgtccctcgagagtcgagtcaccatttcactggagccgtccaagaaccagtactcctgagctgcgtactgtcgaccccgcggacacggccgtatagttactggtacgcgggcttacggctagttgtgttggcgatgtcngcacnccgngcgctaagttntacgtggcgtttgggcacgagggccacggtccaccgtctccgtcacgcctaccgacgtaacggcccagttccggtcccttacccctcgggccctaaccccgttccgtacccgaacggtccgacccgtaaccccgtcgggtaccgggtaccc

SEQ ID NO: 179352 - DNA, 605 bp, Homo sapiens
  misc_feature: GYAE6OF02H1EUU.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacacttcccgtccctcgagagtcgagtcaccatttcactggagccgtccaagaaccagtacctccctgacggctgcggtctgtcgacccccgcggacacgggccgttatattacgtggtcgcggggtctttagggtctagtttggtgtttggtcgtattcgttctgcacgtaccgcgcgactaattagttacggtgggtcggtttggggcacgagggaccacggtcaccgtctccgtcacgcctccaccgacgggccctacgtccggtcccttccccgcggtacccacccctccctacccgaacgaccgccgtacccgtccggtcggggaccc

SEQ ID NO: 179353 - DNA, 579 bp, Homo sapiens
  misc_feature: GYAE6OF02FXPLM.23.10.A10.1.454.CMB.1.raw
  modified_base (270)..(270): a, c, t, g, unknown or other
  misc_feature (270)..(270): n is a, c, g, or t
  modified_base (359)..(359): a, c, t, g, unknown or other
  misc_feature (359)..(359): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatggcgaacccccttntacattccgtccctcgagagtcgagtcaccatttcactggagccgtccaagaaccagtactccctgaggctgcggtctgtcgaccccgnggacacggccgtatattactgtgcgggtcttaggtcagtttgtgttggcgtatgtctgcacgtaccgcgcgctaattatacgtgggcgtttggggcacgagggaccctacgggtcacccgtctcctccgacgccctaccaccgtaacggcccagtcccggtccttcccccgtcggccctacccctccgtacccacgaccgccacccgtcgtcggggaccc

SEQ ID NO: 179354 - DNA, 438 bp, Homo sapiens
  misc_feature: GYAE6OF02JDBY5.23.10.A10.1.454.CMB.1.raw
  modified_base (422)..(438): a, c, t, g, unknown or other
  misc_feature (422)..(438): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagtattttgctagtttattactgtcagcacgtgacactggcccactttccggccctgggaccagactggacatccaaagactgtgctcgcacatctgtcttcacttccttcccgctatctagtaactctccgcgttctgacggcgggtctcggcaacgggccacatagnnnnnnnnnnnnnnnnn

SEQ ID NO: 179355 - DNA, 609 bp, Homo sapiens
  misc_feature: GYAE6OF02IYGA8.23.10.A10.1.454.CMB.1.raw
  modified_base (272)..(272): a, c, t, g, unknown or other
  misc_feature (272)..(272): n is a, c, g, or t
  modified_base (362)..(362): a, c, t, g, unknown or other
  misc_feature (362)..(362): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggccgaacccccttntacattccgtccctcgagagtcgagtcaccatttcactggagccgtaccaagaaccagtactccctgaggctgcggtctgtcgaccccgngacacggccgtatacttactgtcgcgggtcttacggtacagtttgtggtttcgggcgtatcggttctcggctacgtaccgcgaccggactaagtttacgttacggttgggtcggtttggggtcacgagggacctacggtcaccgtctcctcgacgtcctccgaaccgaacgggcccacgtcccggtccttcccccgtcggacccacccgtaccctccgtaacgacgcctaccgtccgtcggggtacc

SEQ ID NO: 179356 - DNA, 557 bp, Homo sapiens
  misc_feature: GYAE6OF02IWQVU.23.10.A10.1.454.CMB.1.raw
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcaccatttcactggagccgtccaagaaccagtactccctgaggctgcgtctgtgacccccgnggacncggccgtatacttactgtgcgggcttaggtcattgtgttggcgatgtctgcactaccgcgcgcaattattacgtgggtcgtttggggctacgagggaccacggtcaccgtctccgtcacgcctccaccgaacggcccagtccggtccttcccccgtggcccacccctctcccaagcgcaccctcgtcggggcc

SEQ ID NO: 179357 - DNA, 560 bp, Homo sapiens
  misc_feature: GYAE6OF02FO44K.23.10.A10.1.454.CMB.1.raw
  modified_base (313)..(313): a, c, t, g, unknown or other
  misc_feature (313)..(313): n is a, c, g, or t
  modified_base (359)..(359): a, c, t, g, unknown or other
  misc_feature (359)..(359): n is a, c, g, or t
tcagacgcgagtatcacgaccggtgctcgatttagcgtcgatctcagggagtactggttcttggacggctcccagaagggtcctgtcccatttccagttgtgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcaccatttcactgganccgtccaagaaccagtactccctgaggctgcggtctgtgaccccgnggacacggccgtatattactgtgcgggcttaggtcatttgtgttggcgatgtctgcactaccgcgcgcaagttattacgtgggcgtttgggcacgagggaccacggtcaccgtctcctcacgcctccaccgaacggcccacgtccggtccttcccccgtcggccctaccctcctaccaacgacgccaccctcgtggggacc

SEQ ID NO: 179358 - DNA, 584 bp, Homo sapiens
  misc_feature: GYAE6OF02IU63F.23.10.A10.1.454.CMB.1.raw
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (482)..(482): a, c, t, g, unknown or other
  misc_feature (482)..(482): n is a, c, g, or t
  modified_base (504)..(504): a, c, t, g, unknown or other
  misc_feature (504)..(504): n is a, c, g, or t
  modified_base (525)..(525): a, c, t, g, unknown or other
  misc_feature (525)..(525): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcgacgcccccgagggaagagcgtggagttggttgcgagtactccattatcgatcggggccgaaaccccctttctacatttcccgtcccctcggagacgtcggacgtcacccgtatttcaacngggacnccggtccaaagaaccagtactccctgagctgcggtcttgcgaccccgngacncggccgtatacgttactggngcggtcttaggtcattgtgtgtcgatgtcgtgcacgtaccgcgcgctaattcttacgtgggtcgttgggcacgnggaccgaggtccaccgtctccncgagcctaccacgacggcccngtcggtcccttcccctcggcctccccgtcgaccaacgcgaccacccgtcgtcgggaccg

SEQ ID NO: 179359 - DNA, 616 bp, Homo sapiens
  misc_feature: GYAE6OF02FQ730.23.10.A10.1.454.CMB.1.raw
  modified_base (359)..(359): a, c, t, g, unknown or other
  misc_feature (359)..(359): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcacctatttcactggagccgtccaagaccagtactccctgagctgcggtctgtcgaccccgngacacggccgtatattactgtcgcggtcttaggtctagtttgtgttggcgtattgtctgctacgtaccgcgcgcaattagtacggtgggtcgtttggggctacgacgggaccacgggtccaaccgtcgtccctcgacgtccctaccgaccgaccgggtccctacggttcccgggttcccttccccccggtggtaccccctaccccgttacccgtacccgaacggtccgtaccctacccggttcggacgggggtaccc

SEQ ID NO: 179360 - DNA, 479 bp, Homo sapiens
  misc_feature: GYAE6OF02JAZQO.23.10.A10.1.454.CMB.1.raw
  modified_base (455)..(456): a, c, t, g, unknown or other
  misc_feature (455)..(456): n is a, c, g, or t
  modified_base (458)..(479): a, c, t, g, unknown or other
  misc_feature (458)..(479): n is a, c, g, or t
tcagacgcgagtatcacgaccggtgctcgatttagcgtcgatctcaggggtctccaggggaaagagccacccctctcctgcagggccagtgacaatgttaggaagttgttagcctggtatcaacacaaacatggccaggctcccccggctcctcatctatgatgcatccaatagggccactggccatcccagacaggttcagtggcagtgggtctgggacagacttcactctcaccatcagcagtgtagagcctgaagtattttgctagtttattactgtcagcaccgtgactaacctcggccctactttccggccccgtgggacccagactgggacactaccaacgaactggtcggcgttcgccaactactctgttccttcacttccttccccgctatctgtaactaccgtcgtcgtctgcgcgggcgtcggcgtaacggccgacacgtagctnngnnnnnnnnnnnnnnnnnnnnnn

SEQ ID NO: 179361 - DNA, 754 bp, Homo sapiens
  misc_feature: GYAE6OF02I5B7J.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagatttattattgggcctggactccggcacgcccccagggaagacgcctggagttggtgcgagtatccattatcagtcggaccgtaacccccttctacctacttcccgtcccgtcgaacggtacgtcgacgtaccaacctattttccaacgtcggacgtcccgtaccaaacggtaaccacgttaacctccccgtaggacggtccttcggacggttccgtacgggtacccgacccccggtacgggtaaccgaccgggtaccgttaacttacgttaccgtcggtcggccggggtacttacgggtactacgttttggtacggttcggtacggtagttcggtacgtcgacgtaccgtaccgtcggacgtctaaagttcgttacggtgggtcggtttggggctacggacggacctacgggtctaccgtcgttaccctacgacctcccgaaccgtaaccgaccgggtaccctcggttacccgggttccctttacccccgggtcggtacccctaccccgttaccctacccggaaccggaccggtacccctacccggttcccgggtacgggggaacccc

SEQ ID NO: 179362 - DNA, 419 bp, Homo sapiens
  misc_feature: GYAE6OF02FS02Y.23.10.A10.1.454.CMB.1.raw
  modified_base (336)..(336): a, c, t, g, unknown or other
  misc_feature (336)..(336): n is a, c, g, or t
  modified_base (408)..(419): a, c, t, g, unknown or other
  misc_feature (408)..(419): n is a, c, g, or t
tcagacgcgagtatcacgaccggtgctcgatttagcgtcgatctcaggggtctccaggggaaagagccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagattttgcagtttattactgtcagcaccgtgacaactggcccactttcggccctgggaccagactggacatccaacgactgngctgcaccatctgtcttcatcttcccgccatctagaatctcgcgtctgagcgggctgggcaaggcgcatcgnnnnnnnnnnnn

SEQ ID NO: 179363 - DNA, 773 bp, Homo sapiens
  misc_feature: GYAE6OF02GL88R.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattagttggcctggatccggcagcccccaggaagagcctggagttggttgcgagtatcctattatcagtcgggccgaacccccttctaccagtttcccgtcccctagagacgtcgagtcacctattcacgtggacgccgtaccaagaacccagtacctccctgacggctcggcggttctcggtccgacccccgtcgggaccaccgggtcccgtatacgtttacgcggttggcgggtcgttagggtcctagttttcgtgggtttggtacggtacgttgttcgtggtcctaccgtaacccggtccgaccggtcttaaacgttttacgtttaccgggttcggggttccgggtttcgggggtacgtaaccggtacggggtaacccggtaccgggttacccggacccggttacccgttcccgttaccgtaccgtccccgtaccccgtaacccggtaaccgggcccccgttaacggttccccggtttccccgtttaccccccggttcccgggtaccccgttacccccgttacccctacccggtaacccgtaccggtaccctacccggtttaccggtccggggggtaacccg

SEQ ID NO: 179364 - DNA, 699 bp, Homo sapiens
  misc_feature: GYAE6OF02F84OX.23.10.A10.1.454.CMB.1.raw
  modified_base (177)..(177): a, c, t, g, unknown or other
  misc_feature (177)..(177): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
tcagacgcgagtatcacgaccggtgctcgatttagcgtcgatctcagggagtactggttcttggacggctcccagaagggtcctgtcccatttccagttgcgtgagtcgggcccagggactggtgaagcctgcggagaccctgtccctcatttgctctgtctctggtgactcccttnagtaacacagattattattgggcctggatccggcagccccagggaacgagcctggagttggttagcgagtagtccacttatcatggcgaaccccttctacattcctcccgtcgagacgtcgagtacactacttcacnggacncgccaacaaccgaatactccccngacggctgccggtatcggtcgacccccgngggacaccggccgttaatacgttaactcggtggccgggtaccttagggtctaagtttgttggttcggagtacgtacgtcgttagacctaccgtaccggcgacggacctaaagtttcttaagggtcgggttcggttacggggactaaccggacggggtaacccgtacggtccgaacccgtttactcccgttacgacgtccccgttaccaacccgtaaccggggacccttaacggtccccgggtttccttcccccctaggggacccccttaacccgtaccccggttacccgaaaccgtgaaccccgtaccgttcgggtaccgggacccgg

SEQ ID NO: 179365 - DNA, 608 bp, Homo sapiens
  misc_feature: GYAE6OF02F06G0.23.10.A10.1.454.CMB.1.raw
  modified_base (278)..(278): a, c, t, g, unknown or other
  misc_feature (278)..(278): n is a, c, g, or t
  modified_base (383)..(383): a, c, t, g, unknown or other
  misc_feature (383)..(383): n is a, c, g, or t
  modified_base (515)..(515): a, c, t, g, unknown or other
  misc_feature (515)..(515): n is a, c, g, or t
  modified_base (556)..(556): a, c, t, g, unknown or other
  misc_feature (556)..(556): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggagagcctggagttggttgcgtagtactccagttatcagtcgggaccgtaacccccttntaccactttcccgtccctcggagagtcgagtcacctatttcacgtggacgccgtaccaagaaccagtacctccctaggacgtctggcgtctcggtcgacccccgnggacaccggctaatacttacgtgtcggtcggtcttaggcctagttggtgttcggcgtatgtcgtgacactaccgcgcgactattacgtacggtgggtcgttgggactagacggtacacggtcaccgtctccncacgtcccaccgcgaacggcccagtcccggttcctccccgnggtccccacccgttacccgtccgaacgtacgaccctcgtccggtggggaccc

SEQ ID NO: 179366 - DNA, 607 bp, Homo sapiens
  misc_feature: GYAE6OF02IVMA8.23.10.A10.1.454.CMB.1.raw
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctgggagttggttgcgagtatccattatcagtgggccgaacccccttctacattccgtccctcganagtcgagtcaccatttcactggacgccgtcaagaaccagtactcccngagctgcggtctcgtcgaccccgnggacacggccgtatattactgtcgcgggtcttaggctagtttgtgttggcgatgtctgcactaccgcgcgacaattattaacggtgggtcgtttggggacacggacgggacccacgggtccaaccggttctcccgtcacgtccctaccgaaccgaacgggccctaaggtcccggttcccttaccccccgtggccctaccccgttcctacccgaagaccgaccctacccgtcggtcggggacccg

SEQ ID NO: 179367 - DNA, 650 bp, Homo sapiens
  misc_feature: GYAE6OF02II6FV.23.10.A10.1.454.CMB.1.raw
  modified_base (469)..(469): a, c, t, g, unknown or other
  misc_feature (469)..(469): n is a, c, g, or t
  modified_base (604)..(604): a, c, t, g, unknown or other
  misc_feature (604)..(604): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattattattgggcctggatcccggcacggccccccaggggaagagcctggagttgggttgcgagtactcctattatcagtcggggacccgtaacccccctttactacctacttccccgtccccttcggacgtacgtccgtagtcctacctacttttcaccgtgggacgtcccgtaccaagaacccagtacctcccgtgacggctcggcgtctgtccggaccccgcggacacgtaccgtatattctgtcgcggtcgttaggtcagtttgtggtggcgtagtgtcngtcacgtaccgcgacgtctaagttcgttacggtgggtccgtttagggccaacggacgggaccctacgggcctaccggttcctccgtcgtcggccctaccgaaccgaacggtcccacggttccgtcccttccccgnggtccctcccgtacgtaccgactccgacctccgtcgggtacgggcc

SEQ ID NO: 179368 - DNA, 888 bp, Homo sapiens
  misc_feature: GYAE6OF02F1IX7.23.10.A10.1.454.CMB.1.raw
  modified_base (385)..(385): a, c, t, g, unknown or other
  misc_feature (385)..(385): n is a, c, g, or t
tcagacgcgagtatcacgaccggtgctcgatttagcgtcgatctcagggagtactggttcttggacggctcccagaagggtcctgtcccatttccagttgcgtgagtcgggccccaggactggtgaagcctgcggagaccctgtccctcatttgctctgtctctggtgactccttcagtaacacagattattattgggcctggatccggcacgcccccgagggaagagcctggagttgggttgcgagtatccattatcagtcgggaccgaaccccccgttctacgtacttcccgtccctcgagacgtcgagtccacctatttcacgtggacgccgtaccaacgaaccagtacctccgtgacgtcagcgtcgtgtccgacccccgnggaccacgggtcccgttaatacttacgtggtacggtccgggtactttacgggtctacgttttggtggtttcgggacgtacgttcggttcgtcgtaccgtacccgttaacccggccggtaccgaccgttaaacgtttaacggttacccgggttttagggggttacccgggtttttacggggggacctaaaccggggtaccgggggtaaacccgttacccgggggttacccgttaaccccggtttaccccggttaccccgtttaccggtaaacccggtcccccgtttacccccggaaaccccgggtaaacccgggggtccccccgtaaaccggtttccccggggttttaccccccgtttacccccccccgggttaccggggtaacccccccgttaccccccccgtttaacccccgggtttaacccccggtaaaccgggtaaccccgggttacccccgtaacccccgggtttacccccgggggtacccgggggggtaaaccccccg

SEQ ID NO: 179369 - DNA, 802 bp, Homo sapiens
  misc_feature: GYAE6OF02F4N49.23.10.A10.1.454.CMB.1.raw
  modified_base (408)..(408): a, c, t, g, unknown or other
  misc_feature (408)..(408): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagatttaattattgggcctgggatccggcacgcccccgagggaacgagcctggagttggtgcgagtatccattatcagtcgggaccgtaacccccttctaactacttcccgtccctacgagtagtcgagtccaccgtactttcgacgtggacgccggtaccaagaacccgacgttacctcccgtaggtaacggcgtacggtcggttcgtcggtccgacccccggngggaacccgaccgggtaccgtaacgttacttaacgttcggttacggccggggttacgtttacgggttaccttatttgggttgttttacgggacgttacgtggttccgtgacccgtaccgtaccggccggtccgtaaccttaagttttaacgttacgggttacgggttacgggttttacggggaccgtaaccgggacgggtacccgtaaccgggtaccgtaccccggttccttaccgtcccgtaaccgtccccgtacccgaaccgggtaacccggtacccgtaccgtttcccggttaccccgtttcccccggtaccgtaccccgtaccccgtttaccccgtacccggtaaacggtcccgaccgtaccccggttaccgggttaccggggaacccgg

SEQ ID NO: 179370 - DNA, 799 bp, Homo sapiens
  misc_feature: GYAE6OF02JW52Z.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtacacagattattattggcctggatccggcagcccccaggacgagcctggagttggttgcgagtactcctagttaatcagtcgggtacccgtaacccccttactacctacctttcccgttacccccgtacggacggtaccgtacggagttcccaacctacttttaccgacgttacgggaaccgtcccggttaaccaaacgtaacccgtaccgtaaccgtccccgtaggacggtaccttcggtccggggttccgtaccggtccggtacccccccggacgggacccgaccgggtacccgttaagtttacgttacgttcggtacgggccgggtcgttaacggtctacggttttggtcggttacgacggttagtccgttcggtacgtaccgtaccgtacccggtcggacccggtacttaacggtttacggtttaccggggttgggttcggggtttaaccggggtcaaccgggtacggggtaccgaccgttaccgtaccgtccgttaccgtaccgcccggtccctaacccgaccgtaaccgtcccgttaacgttccggttccccgttaccccgtggtacccccacctttcccgacgttacacggtcctaccggtccggccgggtacc

SEQ ID NO: 179371 - DNA, 693 bp, Homo sapiens
  misc_feature: GYAE6OF02FWMAX.23.10.A10.1.454.CMB.1.raw
  modified_base (274)..(274): a, c, t, g, unknown or other
  misc_feature (274)..(274): n is a, c, g, or t
  modified_base (373)..(373): a, c, t, g, unknown or other
  misc_feature (373)..(373): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagattacttattgggcctggactccggcagcccccagggaagagccctggagttggttgcgagtatcctattatcatgggccaaccccttntacattccgtccctcgacgagtcgagtcaccgtatttcacgtggacgccgtaccaagaaccagtacctccctgacggtctggcgtctgtccgaccccgnggacgcggaccgtatacgttacgtgtcgcgggtcttaggtcagtttcgtgttcgggacgtagtgtctggactaccgtacgcgcgactaagtttacgttcggtgggtaccggtttggggcctaacgggtacgggtaacccgtacgggtaccgtacccggttctacccgtacgtaaccgtcccttaccgaacccgaacggggtcccctaacggttcccggttaaccccttcccccggttacggtacccccttaccccgttacccgtacccggtaaggtaccccggtaccctaccccggttacgggtacccgggggtaacccg

SEQ ID NO: 179372 - DNA, 920 bp, Homo sapiens
  misc_feature: GYAE6OF02HDY8Z.23.10.A10.1.454.CMB.1.raw
  modified_base (226)..(226): a, c, t, g, unknown or other
  misc_feature (226)..(226): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtgactccttcagtaacacagtattattagttgggcctggatccggcacgccccgaggacgngccgtggacgttggtcgcgtagtactcctaatttactacgagtcggggacccgtaacccccttttcgtaaccttaccgtttccccggttccccgtacggtaaggtacggttccgtaacggttacccaaccttaacgtttttccgaaccgttcggggtaccgtaccccggtaaccgaaaccggtaaacccgtaacggttaccccgttacccgtacggacggtccgttcggtaccgggttacgttaccggtacccggtaacccccggacgggtaacccgaccgggtaccggttaacttaccgtttaacgtcgggtacgggtaccgggttaccgtttaacggtaccgtacggttttcgggttcgggttacgggaccgttagtttccggttcgtaccggtacctaacccgggttcccggaccggtacgttaaccgtaacgttttacgggttaccggggttacgggggtttccgggtttaacggggacccgtaaccgggtaaccgggtacccggttaaccgggttaccgtaccccgggttccttacccgttacggaccccggttaccgtaaccccggtaaccggacccgggtcccctaacgggtttcccccggttaacccgtttcccccggaggtaccccttaccccggttactacccggaacggtcccgaccgttacccggtcgggtccgggaacccg

SEQ ID NO: 179373 - DNA, 733 bp, Homo sapiens
  misc_feature: GYAE6OF02HZHM7.23.10.A10.1.454.CMB.1.raw
  modified_base (647)..(647): a, c, t, g, unknown or other
  misc_feature (647)..(647): n is a, c, g, or t
  modified_base (652)..(652): a, c, t, g, unknown or other
  misc_feature (652)..(652): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (693)..(693): a, c, t, g, unknown or other
  misc_feature (693)..(693): n is a, c, g, or t
tcagacgcgagtatcacgaccggtgctcgatttagcgtcgatctcaggggtctccaggggaagagccaccctctcctgcagggccagtgacaatgttaggaagttgttagcctggtatcaacacaaacatggcaggctccccggctcctcatctatgatgcatccaagtacgggcccaacgtgggccactaccccagtaacgtacgggtttccaagggtcggacgtacgggtcggggttccgtaggggacctaacgggtaacccttttccgaaccttcccgttaccgaacctaacgttaccgaacggtccgtacgggtagttaccgggaacggtaccccggtaaggtaaaggttacgttttttacggcgttaaacggttttttacttaccgttaggttaccgtaagtccccggtaaccgggttacgaaccgtaaccgtcggtacccctacgttttcccgggccccggttagggacccaaggtcctacggactactacccgaacgtaacttggtcggtacctgaccgtacctcgtttaacctcggttcttaccctacgtttcccgtacccgtcgtaacttacgtacgtaactaccgtccggtcttacgaggacggtccggtcgtggacgtacggacgtacagttacgnacgtnaggtacncgcgancaccgatactacgacgtagacgcgtcgncgacgtctgtacgtacgtacgtagtagtcgtagacgtacg

SEQ ID NO: 179374 - DNA, 773 bp, Homo sapiens
  misc_feature: GYAE6OF02I8C4C.23.10.A10.1.454.CMB.1.raw
  modified_base (167)..(167): a, c, t, g, unknown or other
  misc_feature (167)..(167): n is a, c, g, or t
tcagacgcgagtatcacgaccggtgctcgatttagcgtcgatctcagggagtactggttcttggacggctcccagaagggtcctgtcccatttccagttgcgtgagtcgggcccaggactggtgaagcctgcggagaccctgtccctcatttgctctgtctctggtnactccttacagtaacacagtattattagttgggcctggactccggcacgccccgaagggaagcgccgtggagttggttacgcgtaagtactaccaattacgtacgacggtcgggaccctaacccccttctaccttaccgttccccgtacccgtcggagtacggtcgtacgtacctacctagtttcacgtggtacgtacccgtacgaacgaacctacgtaccgtccgtaggacgtcgtacggtcggtccgtcggtaccccggtaccccggacggaccgtaccgggtaccttacgttaactttacggtcggtacgggtacggttacgttacggtacgtagtttcgggtagttccggtacttaggttcgtactacggtacctaccggtaccgacgtccgtaagttaacgttcgggttacgggtaccggttggggtaaccggacctaacgggaccggttaccgtaccggtacctacccggttccctaccgaccgttacccgaccccggtaacgtaccggccgaccccgtttcgtaccccggttccccttaaccgggcctacccgtacccgtacgaccgaacgttcccgaccgtccggtcgggtaccgccg

SEQ ID NO: 179375 - DNA, 775 bp, Homo sapiens
  misc_feature: GYAE6OF02HDK8X.23.10.A10.1.454.CMB.1.raw
  modified_base (267)..(267): a, c, t, g, unknown or other
  misc_feature (267)..(267): n is a, c, g, or t
  modified_base (686)..(686): a, c, t, g, unknown or other
  misc_feature (686)..(686): n is a, c, g, or t
  modified_base (698)..(698): a, c, t, g, unknown or other
  misc_feature (698)..(698): n is a, c, g, or t
tcagacgcgagtatcacgaccggtgctcgatttagcgtcgatctcagggagtactggttcttggacggctcccagaagggtcctgtccatttccagttgcgtgagtcgggcccaggactggtgaagcctgcggagaccctgtccctctatttcgctctcgtctcgtggtgactccttcagtaacacagtattattagttggccgtgactccggcgacgcccccgaagggaacgcgcgtaggacggttgtgcgagtacaccgtattancaggtcgggacccgtaacccccttcgttacctacgttacccgttccccgttacggacggtaacgtcggtaacgtaccgaacctacggtttttccaacctttgggaccgtaccccggttaacccgaaaacgtaaccccgtaaaggttaccccctaccggttaccggtaacgggtccgttacggtacccgggttccggttacgggttacccgtaacccccccgggtacgggaaaccccgttacgggggaccccgtttaacgttacgtttacctagggttaccggggtacggtaccggtttacgtcgtagtttgtcggtagtcgtacgtgtctcgtacacgtacgcgactacgtaagttacgtacggtcgggttaggtcgggacacggtacggaccgacgtctaccgtctcctacgctaccnccgtaggacccnccgacgttccgcccgttacccgtcggccccaccccgttcgaccttacggaccgcccgtcgttacgggccggtacccg

SEQ ID NO: 179376 - DNA, 816 bp, Homo sapiens
  misc_feature: GYAE6OF02HFL3L.23.10.A10.1.454.CMB.1.raw
tcagacgcgagtatcacgaccggtgctcgatttagcgtcgatctcagggagtactggttcttggacggctcccagaagggtcctgtcccatttccagttgcgtgagtcgggcccagggactggtgaagcctgcgggacgacccgtgtccctcatttgctctgtctctggtgactccttcagtaacacagattattatggcctggactccggcacgccccgaggagacgcctggagttggtgacgagtatcctattatcagtcgggaccgtaacccccttctactacttcccgtccctacggacgtacggtacgacgtaccacctattttaccacgttggacgtcccgtaccgaaaacgaaccctaacgtacctcccctaggacggtccgtaggtcccggttcgtcggtacccgacccccggtagggacccgtaaccgggtccgttacgttaacgttacgtcggtggaccgggttaccgttaacgggtccgttaagttttcgggttacggtttacgggacgttacggttacggttaccgtcgtaccgtaacccgtaccgggccggtaccgttaacgttaaacgtttacggttaccggggtcggggtttaccggggttttacgggggacctaaaccgggtaccggggtaaccccgtaaccgggtcccttacccggttcccttacccggtacgaaccgtcccgtaccccgaaccggaacccgggtccctaccggtacccgggttcccccttaccccgtccggtaccccaccccgttacctaccgacggacctacccggtaccgtcgggtacggggtacc

SEQ ID NO: 179377 - DNA, 180 bp, Homo sapiens
  misc_feature: GYAE6OF01DRLP1.11.86.H09.1.454.CMB.1.raw
  modified_base (172)..(180): a, c, t, g, unknown or other
  misc_feature (172)..(180): n is a, c, g, or t
tcagcgagagataccacgaccggtgctcgatttagtgctatagacttgggtttgggggaagaggaagactgacggtccccaggagttcaggtgctgggcacagcggccctgggctgcctggtcaaggactacttccgtatctctcgctgagcgggctggcaaggcgcatagnnnnnnnnn

SEQ ID NO: 179378 - DNA, 190 bp, Homo sapiens
  misc_feature: GYAE6OF01A3HOV.11.86.H09.1.454.CMB.1.raw
  modified_base (171)..(190): a, c, t, g, unknown or other
  misc_feature (171)..(190): n is a, c, g, or t
tcagcgagagataccacgaccggtgctcgatttagtgctatagacgttgggtttgggggaagaggaagactgacggtcccccaggagttcaggtgctgggcacagcggcctggctgcctggtcaaggctacttccgtatctctcgctgagcgggctggcaaggcgcatagnnnnnnnnnnnnnnnnnnnn

SEQ ID NO: 179379 - DNA, 493 bp, Homo sapiens
  misc_feature: GYAE6OF01BSDUN.11.86.H09.1.454.CMB.1.raw
  modified_base (480)..(480): a, c, t, g, unknown or other
  misc_feature (480)..(480): n is a, c, g, or t
  modified_base (485)..(493): a, c, t, g, unknown or other
  misc_feature (485)..(493): n is a, c, g, or t
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctcctggccatcagtgggctcagtctgatgatgagctgattattactgtgcagcagtgggatgacacctgaatggtccttgtgtggttttcggcggaggaccagcgtgaccgtctaggtcagcccaaggcctcgcccctcggtccactctcgttcccaccctctcgtactctctcgctgagcggctggcaggcncatgnnnnnnnnn

SEQ ID NO: 179380 - DNA, 173 bp, Homo sapiens
  misc_feature: GYAE6OF01EL52R.11.86.H09.1.454.CMB.1.raw
  modified_base (173)..(173): a, c, t, g, unknown or other
  misc_feature (173)..(173): n is a, c, g, or t
tcagcgagagataccacgaccggtgctcgatttagtgctatagacttgggtttgggggaagaggaagactgacggtcccccaggagttcaggtgctgggcacagcggccctgggctgcctggtcaaggactacttccgtatctctcgctgagcgggctggcaaggcgcatagn

SEQ ID NO: 179381 - DNA, 173 bp, Homo sapiens
  misc_feature: GYAE6OF01CMQFL.11.86.H09.1.454.CMB.1.raw
  modified_base (172)..(173): a, c, t, g, unknown or other
  misc_feature (172)..(173): n is a, c, g, or t
tcagcgagagataccacgaccggtgctcgatttagtgctatagacttgggtttgggggaagaggaagactgacggtccccaggagttcaggtgctgggcacagcggccctgggctgcctggtcaaggactacttccgtatctctcgctgagcgggctggcaaggcgcatagnn

SEQ ID NO: 179382 - DNA, 557 bp, Homo sapiens
  misc_feature: GYAE6OF01CUYVT.11.86.H09.1.454.CMB.1.raw
  modified_base (546)..(547): a, c, t, g, unknown or other
  misc_feature (546)..(547): n is a, c, g, or t
  modified_base (550)..(557): a, c, t, g, unknown or other
  misc_feature (550)..(557): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaaccggcccccaaactcctcatctatagtaataatcagcggccctcaggggtccctgaccgattctctggctccaagtctggcacctcagcctccctggccatcagtgggctccagtctgatgatgaggctgattattactgtgcagcagtgggatggaacaccctgtaactggttccttgttggttgggttttcgggcgggacgggaccaaaggtcgtcggacccgttccgtaagggtcctaggaccccaacgggcctaccggccccccgttcggtccacctccgttcgttccccgccccttcctccgttactccgttcgcgtcggacgcgggtctgggccgtaaggccgctaagtcgcanngcnnnnnnnn

SEQ ID NO: 179383 - DNA, 483 bp, Homo sapiens
  misc_feature: GYAE6OF01DVC4L.11.86.H09.1.454.CMB.1.raw
  modified_base (472)..(483): a, c, t, g, unknown or other
  misc_feature (472)..(483): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatggatgacacctgaatggtccttgtgtggtttcggcggagggaccaagctgaccgtctaggtcagcccaggctcgcccctgtccactctcgttcccgccctctcgtatctctcgctgagcggctggctaaggcgcatagnnnnnnnnnnnn

SEQ ID NO: 179384 - DNA, 500 bp, Homo sapiens
  misc_feature: GYAE6OF01CTCV9.11.86.H09.1.454.CMB.1.raw
  modified_base (261)..(261): a, c, t, g, unknown or other
  misc_feature (261)..(261): n is a, c, g, or t
  modified_base (485)..(485): a, c, t, g, unknown or other
  misc_feature (485)..(485): n is a, c, g, or t
  modified_base (491)..(500): a, c, t, g, unknown or other
  misc_feature (491)..(500): n is a, c, g, or t
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattcnctggctccaagtctggcacctcagcctccctggccatcagtgggctccagtctgatgatgagctgattattactgtgcagcatgggatgacacctgaatgtcttgtgttggtttcggcggaggaccagctcgaccgtctaggtcagcccaagcctcgcccctcgtcactctcgttcccgccctctcgtatcctctcgcgtgacggcggtcgtcggcgaggccgnagtagnnnnnnnnnn

SEQ ID NO: 179385 - DNA, 173 bp, Homo sapiens; identical to SEQ ID NO: 179380
  misc_feature: GYAE6OF01A2BSM.11.86.H09.1.454.CMB.1.raw
  modified_base (173)..(173): a, c, t, g, unknown or other
  misc_feature (173)..(173): n is a, c, g, or t

SEQ ID NO: 179386 - DNA, 207 bp, Homo sapiens
  misc_feature: GYAE6OF01B89XL.11.86.H09.1.454.CMB.1.raw
  modified_base (177)..(207): a, c, t, g, unknown or other
  misc_feature (177)..(207): n is a, c, g, or t
tcagcgagagataccacgaccggtgctcgatttagtgctatagacttgggtttggggggaagaggaagactgaccggtcccccaggagttcaggtgctgggcacagccggccctgggctgccctggtcaaggactacttccgtatctctcgctgagcgggctggcaaggcgcatagnnnnnnnnnnnnnnnnnnnnnnnnnnnnnnn

SEQ ID NO: 179387 - DNA, 173 bp, Homo sapiens; identical to SEQ ID NO: 179380
  misc_feature: GYAE6OF01A3PUP.11.86.H09.1.454.CMB.1.raw
  modified_base (173)..(173): a, c, t, g, unknown or other
  misc_feature (173)..(173): n is a, c, g, or t

SEQ ID NO: 179388 - DNA, 493 bp, Homo sapiens
  misc_feature: GYAE6OF01A3WU4.11.86.H09.1.454.CMB.1.raw
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
  modified_base (476)..(493): a, c, t, g, unknown or other
  misc_feature (476)..(493): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagcctgaggatggaggctgattattactgtcagttcctttgacattaaactggatgtggtattcggcggagggacccacggtaaccgtccgtaggtcagcccaaggcctcgcccccgtcggtcactctcgttccccaccctcctcgtactctctcgctgngcggctggcaggcnatagnnnnnnnnnnnnnnnnnn

SEQ ID NO: 179389 - DNA, 507 bp, Homo sapiens
  misc_feature: GYAE6OF01E1EKP.11.86.H09.1.454.CMB.1.raw
  modified_base (497)..(507): a, c, t, g, unknown or other
  misc_feature (497)..(507): n is a, c, g, or t
tcagcgagagataccacgaccggtgctcgatttagtgctatagacttgggtttgggggccgttcctgggcccagtctgtgctgactcagccaccctcagcgtctgggacccccgggcagagggtcatcatctcttgtactggaagcagctccaatatcggaagtaacgatgtcaattggtatcaacatctcccggtacggcccccaaactcctcatctataggaatagccagcggccctcgacggggtccctggccgattctctggctcgaagtctggcacctcagcctccctggcctgcagtgggctccagtctgaggatgaggctgacttattattgtgcagcgtggggatggacggtctggagtgctgtggtcttcgggcggagggacaagctgccgtcgtgggtcacgccgaagctcgccccctcggtcactcttcgttcccacccttcctcgtactctcctcgctgacggcggctcggcaaggcgcgatagnnnnnnnnnnn

SEQ ID NO: 179390 - DNA, 490 bp, Homo sapiens
  misc_feature: GYAE6OF01B82VN.11.86.H09.1.454.CMB.1.raw
  modified_base (327)..(327): a, c, t, g, unknown or other
  misc_feature (327)..(327): n is a, c, g, or t
  modified_base (480)..(490): a, c, t, g, unknown or other
  misc_feature (480)..(490): n is a, c, g, or t
tcagcgagagataccacgaccggtgctcgatttagtgctatagacttgggtcctgggcccagtctgtgctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtncagcgtggatgacgtctgagtgctgtggtcttcggcggagggaccaagcgtgaccgtccgtgggtcacgcccaaggcctcgccccctcggtccacctctcgttccccaccctcctcgtactctctcgtctgacgcggctggcaggcgcatagnnnnnnnnnnn

SEQ ID NO: 179391 - DNA, 216 bp, Homo sapiens
  misc_feature: GYAE6OF01C363Y.11.86.H09.1.454.CMB.1.raw
  modified_base (178)..(180): a, c, t, g, unknown or other
  misc_feature (178)..(180): n is a, c, g, or t
  modified_base (182)..(216): a, c, t, g, unknown or other
  misc_feature (182)..(216): n is a, c, g, or t
tcagcgagagataccacgaccggtgctcgatttagtgctatagacttggggtttggggggaagaggaagactgaccggtcccccaggagttcaggtgctgggccacagcggccctgggctgcctggtcaaggactacgttccgtatctctcgctgagcgggctggcaaggcgcatagnnnannnnnnnnnnnnnnnnnnnnnnnnnnnnnnnnnnn

SEQ ID NO: 179392 - DNA, 490 bp, Homo sapiens
  misc_feature: GYAE6OF01E0KV1.11.86.H09.1.454.CMB.1.raw
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
  modified_base (483)..(490): a, c, t, g, unknown or other
  misc_feature (483)..(490): n is a, c, g, or t
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatgtccttgtgtggttttcggcggagggacaagctgaccgtcctaggtcagcccaggctcgcccctcggtcactctcgtcccgcctcctcgtntctctcgctgngcggctggcaggcgnatgnnnnnnnn

SEQ ID NO: 179393 - DNA, 616 bp, Homo sapiens
  misc_feature: GYAE6OF01CZWEK.11.86.H09.1.454.CMB.1.raw
  modified_base (601)..(601): a, c, t, g, unknown or other
  misc_feature (601)..(601): n is a, c, g, or t
  modified_base (611)..(616): a, c, t, g, unknown or other
  misc_feature (611)..(616): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagccggccctcgaggggtccctgaccgattctctggctccaagtctggcacctcagcctccctgccatcagtggctcagtctgatgatgagctgtatttattactgtcgcagactagtgggatcggacctacccgtagtaacgtggttcccgtttggtttggtttgggttttcggggaccgggtaaggggacctaaggtccgttacggtaccccggttaccgtaacgggtcctaacggaccccgtaaacggtcccgtcccgtccccccgttcggtaccctacctttaccgttcccgttcccccgtccccttcccgttcccgttacttccgtccttccgcgttcggacggtccgggcgtgggaccgacggcgacgacgttagntcgatgcagnnnnnn

SEQ ID NO: 179394 - DNA, 550 bp, Homo sapiens
  misc_feature: GYAE6OF01BOHNA.11.86.H09.1.454.CMB.1.raw
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (545)..(550): a, c, t, g, unknown or other
  misc_feature (545)..(550): n is a, c, g, or t
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcacgccctccctggccatcagtgggctccgagtctgatgatgaggatgtattattacgtgtgcagcagtgggatgaccacctgaactcggtcctttggtcgtttgggttttcgggcgggtagggaccgtagcgtcgtacccgttccgtaggtcacgcccgaggcctccgtcccctcgtccacttctccgttccccaccctcctcgtactctctcgcgtgacggcgggtctcggacgaacgggtccgagacgtaggntcgngcnnnnnn

SEQ ID NO: 179395 - DNA, 591 bp, Homo sapiens
  misc_feature: GYAE6OF01D36TC.11.86.H09.1.454.CMB.1.raw
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (578)..(591): a, c, t, g, unknown or other
  misc_feature (578)..(591): n is a, c, g, or t
tcagcgagagataccacgaccggtgctcgatttagtgctatagacttgggtttgggggcccgttcctgggcccagtctgtgctgactcagcccaccctcagcgtctcggggaccccccgggcagagggtcatcatctcttgttctggaagcagctctaatatcggaataatactagtaaattggtatacaacaactcccaggaaccgcccccaaactcctcatctatagtaaataatcagccggcccctcgacggggtcccctaggaccgattccgtctggctccaagtctggccacctcacgtccctcccgtcggccctatccaggttacggggcctccgagttccgtagatcggagtggtacgctagtatttacttactgtctagttccttgaactaattaaacgtggattggtgttacgtcgggacgggacggaccctacggtaaccgtcgtaggtacgacgtaccgaggtcctcccgccccgtacgtcaccttctccgttccccctaccgtcctaccgtacttccgtcctcgcgtggacggtcggtcgtggacgaacggcgtacagtagnancnnnnnnnnnnnnnn

SEQ ID NO: 179396 - DNA, 666 bp, Homo sapiens
  misc_feature: GYAE6OF01D9JPL.11.86.H09.1.454.CMB.1.raw
  modified_base (657)..(657): a, c, t, g, unknown or other
  misc_feature (657)..(657): n is a, c, g, or t
  modified_base (660)..(666): a, c, t, g, unknown or other
  misc_feature (660)..(666): n is a, c, g, or t
tcagcgagagataccacgaccggtgctcgatttagtgctatagacttgggtttgggggccgttcctgggcccagtctgtgctgactcagcccaccctcagcgtctgggacccccgggcagagggtcatcatctcttgttctggaagcagctctaatatcggaagtaatactgtaaattggtatcaacaactcccaggaaccgcccccaaactcctacatctatagtaataatcagccggccctcgacggggtccctgaccgtattctcgtggcctccaagtctggcctacctcacgtccctcccgtggcctaatcaggtcgggcctccgtagtcctagacgtgagtggacggtcttagtaattttacttacgtagttcgaccagtcgaaggtcgggtatcgaaccacccgttagaacgttcggtttccgtttggttcggtttcgggttttcgggacggggtaacggaaccctacggcgttaccggtacccgttacgtacgggacctacggaccccgaagggtcccttaccccggcccccgtttcggtacctaccttcccttcccggttaccccacccgttctaccgtactccttccgtccgtcgtcgggtaccggccgggcgttcgggaccgtaaacgggccgtacctaggtcgatnacnnnnnnn

SEQ ID NO: 179397 - DNA, 817 bp, Homo sapiens
  misc_feature: GYAE6OF01EXYGW.11.86.H09.1.454.CMB.1.raw
  modified_base (93)..(93): a, c, t, g, unknown or other
  misc_feature (93)..(93): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (593)..(593): a, c, t, g, unknown or other
  misc_feature (593)..(593): n is a, c, g, or t
  modified_base (729)..(729): a, c, t, g, unknown or other
  misc_feature (729)..(729): n is a, c, g, or t
tcagcgagagataccacgaccggtgctcgatttagtgctatagacttgggtttgggggccgttcctgggcccagtctgtgctgactcagcccncaccctcagcgtccgtccgggacccccgggcgaggaggtcatcatcttcttgttcgtaggaagcagctactaatagtacggaagtaatatagtaagttagtatacaacaacctaccgacggaaccgacccaacctacctactactactaataagtaataactacgacgccggtcccgtccggtaccgggtcccgtacgtaccgttaccgnttccgtcgtcgtaccgtaccgtaacgtcgtacgacctacctccgaccgtcccgtcccgtccgtaccntnactacgtacggttccggtaccgttacccgtacggtacgttaggtaacgttacggtaaggtacggtacgggtacgtttaacgtttaacgttttaacgtttaacgttacggtacggtaccgtacgtacggtaacggtacgggtacgtaccgtaccgtaccgtaggttacgttcggtttcgttggtttacggttacgggttacgggtacggtaacggaaccgtncgaacgtccgtacggctccgtaccgtaccgtacgaccgtaccggtacccgtaccggtccccgtaccccgttccgttaccgttacccgttacccgttccccgttaccccgttccccttacccgttaccgttacccgnttcccgttaccggtaccgggttcccgggtaccggtaccggggacccgggtaccgggtacccggtaaccggaccggtaccgtacgtacg

SEQ ID NO: 179398 - DNA, 702 bp, Homo sapiens
  misc_feature: GYAE6OF01ARSR0.11.86.H09.1.454.CMB.1.raw
  modified_base (203)..(203): a, c, t, g, unknown or other
  misc_feature (203)..(203): n is a, c, g, or t
  modified_base (683)..(683): a, c, t, g, unknown or other
  misc_feature (683)..(683): n is a, c, g, or t
  modified_base (687)..(687): a, c, t, g, unknown or other
  misc_feature (687)..(687): n is a, c, g, or t
  modified_base (690)..(690): a, c, t, g, unknown or other
  misc_feature (690)..(690): n is a, c, g, or t
  modified_base (693)..(693): a, c, t, g, unknown or other
  misc_feature (693)..(693): n is a, c, g, or t
  modified_base (695)..(696): a, c, t, g, unknown or other
  misc_feature (695)..(696): n is a, c, g, or t
  modified_base (698)..(698): a, c, t, g, unknown or other
  misc_feature (698)..(698): n is a, c, g, or t
  modified_base (700)..(702): a, c, t, g, unknown or other
  misc_feature (700)..(702): n is a, c, g, or t
tcagcgagagataccacgaccggtgctcgatttagtgctatagacttgggtcctgggcccagtctgtgctgactcagccaccctcagcgtctcgggacccccgggcaggagggtcatcatctcttgttctggaagcagctctaatatacggaagtaatactagtaaattggtatacaacactccacggaccgccccaactccncatctatataatactcacgcgcctcgacgggtccctagaccgtacttctcgtcggtacctccaagttccgtcggcctaccctcgaccgtccctccggtcgccactcgacggtcggctaccgtacgtctaggtactgtaagtggacggtcttaagttactttattacggtgttacgacgagtcgtaggtcggtactacgacccttaccgtaggttaccgttcgggttcgtttgggtttcggtttacggggttccgggaaacgggtacggtaaccgtacggtcgttacccgggtaaccctacgggtacgtacccggaccgtaccggtaccggtcccgtccccgtcccggtaccgtacccttaccgttacccgttccccgtaccccgtaccccgttcttaacccggttctttcccgtaccgttaccggcgttacccgggcgggtaccggtacggtcccggaacgcggggtaccacggtacggngacncgngancnngncnnn

SEQ ID NO: 179399 - DNA, 721 bp, Homo sapiens
  misc_feature: GYAE6OF01AN2BO.11.86.H09.1.454.CMB.1.raw
  modified_base (207)..(207): a, c, t, g, unknown or other
  misc_feature (207)..(207): n is a, c, g, or t
tcagcgagagataccacgaccggtgctcgatttagtgctatagacttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcatcatctcttgttctggaagcagctctaatatcggaagtatactgtaattggtatcaacactccaggaaccgccccaaatcctcatctatagtaataatcagccggtcctacgacggggttccctaggaccgtatttcctcgtcgggcctaccgaaggttcctagggcctaacccgtcgaacggtccccgttaccccgtcgggacccacgttccgaacggttccggggtacccttcccgaacggttcctacggacgttggaacttcgggacggtccttaggtaacttttaacgtttaacgtggttaccgacgaacggtaccgaaggttacggggaacttacggaaacccgtaccccgttaggtaaaccgtttcggggttaccccgttttaggggttcggttttacgggggtttttcccggggacccggggttaacgggggtaacccctaaacggggttcccgttaaccgggtaacccccgggtttccggttaaacggggtaccccg

SEQ ID NO: 179400 - DNA, 713 bp, Homo sapiens
  misc_feature: GYAE6OF01AL9ZW.11.86.H09.1.454.CMB.1.raw
  modified_base (105)..(105): a, c, t, g, unknown or other
  misc_feature (105)..(105): n is a, c, g, or t
  modified_base (681)..(681): a, c, t, g, unknown or other
  misc_feature (681)..(681): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (695)..(695): a, c, t, g, unknown or other
  misc_feature (695)..(695): n is a, c, g, or t
  modified_base (699)..(699): a, c, t, g, unknown or other
  misc_feature (699)..(699): n is a, c, g, or t
  modified_base (704)..(705): a, c, t, g, unknown or other
  misc_feature (704)..(705): n is a, c, g, or t
  modified_base (707)..(707): a, c, t, g, unknown or other
  misc_feature (707)..(707): n is a, c, g, or t
  modified_base (709)..(709): a, c, t, g, unknown or other
  misc_feature (709)..(709): n is a, c, g, or t
  modified_base (711)..(711): a, c, t, g, unknown or other
  misc_feature (711)..(711): n is a, c, g, or t
  modified_base (713)..(713): a, c, t, g, unknown or other
  misc_feature (713)..(713): n is a, c, g, or t
tcagcgagagataccacgaccggtgctcgatttagtgctatagacttgggtcctgggcccagtctgtgctgactcagccaccctcagcgtctgggacccccgggnagaggggtcatcatctcttgtactggaagcagcctccaatagtcggaagtaacgatgtctaagttggtatacaacatcccgtccccggtaccggacccccaaactcctcatctaataggaatacgccaggccggtcccgtcggtacggggtccctgggcccgtattccgtcgtcggcctacggtacgtcgtcggcccacctcacgtccctccgtcggcctgcggacggtcggtacccgctacggtcgtaggaggtagtgggacgggtctagttacgtttagtttagttcggtcggacgtacggggtcgggtaaggtacgggtacgtacgggtggtaggtcggtcggttaggttcgggtcggttcggttcggggaacgggtaccggaaccgtacggtcgttccggaccggttccgggtacggtaccgaacccggaccggacggtcccggtaccccggtccccgttacggtacccttaccgttcccggttccccgtcccccgttacccgttcccgttacgttccttccgtccggtacggtcggacggtcgggtacggtacggcggaccggtcgtacgngtacgntntacggntcgngatcnngngngngn

SEQ ID NO: 179401 - DNA, 197 bp, Homo sapiens
  misc_feature: GYAE6OF02IUE1T.11.86.H09.1.454.CMB.1.raw
  modified_base (173)..(197): a, c, t, g, unknown or other
  misc_feature (173)..(197): n is a, c, g, or t
tcagcgagagataccacgaccggtgctcgatttagtgctatagacttggggtttgggggaagaggaagacgtgacggtcccccaggagttcaggtgctgggcacagcggccctggctgcctggtccaaggctacttccgtatctctcgctgagcggctggcaaggcgcatagnnnnnnnnnnnnnnnnnnnnnnnnn

SEQ ID NO: 179402 - DNA, 173 bp, Homo sapiens; identical to SEQ ID NO: 179380
  misc_feature: GYAE6OF02IM9ME.11.86.H09.1.454.CMB.1.raw
  modified_base (173)..(173): a, c, t, g, unknown or other
  misc_feature (173)..(173): n is a, c, g, or t

SEQ ID NO: 179403 - DNA, 173 bp, Homo sapiens; identical to SEQ ID NO: 179380
  misc_feature: GYAE6OF02G5HPI.11.86.H09.1.454.CMB.1.raw
  modified_base (173)..(173): a, c, t, g, unknown or other
  misc_feature (173)..(173): n is a, c, g, or t

SEQ ID NO: 179404 - DNA, 173 bp, Homo sapiens; identical to SEQ ID NO: 179380
  misc_feature: GYAE6OF02FSEPC.11.86.H09.1.454.CMB.1.raw
  modified_base (173)..(173): a, c, t, g, unknown or other
  misc_feature (173)..(173): n is a, c, g, or t

SEQ ID NO: 179405 - DNA, 177 bp, Homo sapiens
  misc_feature: GYAE6OF02IRQXN.11.86.H09.1.454.CMB.1.raw
  modified_base (173)..(177): a, c, t, g, unknown or other
  misc_feature (173)..(177): n is a, c, g, or t
tcagcgagagataccacgaccggtgctcgatttagtgctatagacttgggtttgggggaagaggaagactgacggtcccccaggagttcaggtgctgggcacagcggccctgggctgcctggtcaaggactacttccgtatctctcgctgagcgggctggcaaggcgcatagnnnnn

SEQ ID NO: 179406 - DNA, 173 bp, Homo sapiens; identical to SEQ ID NO: 179380
  misc_feature: GYAE6OF02FHCG2.11.86.H09.1.454.CMB.1.raw
  modified_base (173)..(173): a, c, t, g, unknown or other
  misc_feature (173)..(173): n is a, c, g, or t

SEQ ID NO: 179407 - DNA, 497 bp, Homo sapiens
  misc_feature: GYAE6OF02JM174.11.86.H09.1.454.CMB.1.raw
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (488)..(497): a, c, t, g, unknown or other
  misc_feature (488)..(497): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggccccaaactcctcatctatagtaataatcagcggccctcagggtccctgaccgattctctggctccaagtctggcacctcagcctcctgccatcagtggctccagtctgatgatgaggctgattattactgtgctagcatgggatgacaccctgaatggtcttgtgtggttttcggcggaggaccagcgtcgacgttccgtaggtccagcccgaaggctcgcccccgtggtccacttccgtcgttcccgccctcctccgtactcctctcgctgcgcggcnggccaggcgacngacngcnnnnnnnnnn

SEQ ID NO: 179408 - DNA, 586 bp, Homo sapiens
  misc_feature: GYAE6OF02IIHKH.11.86.H09.1.454.CMB.1.raw
  modified_base (209)..(209): a, c, t, g, unknown or other
  misc_feature (209)..(209): n is a, c, g, or t
tcagcgagagataccacgaccggtgctcgatttagtgctatagacttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggaccccccgggnagagggtcatcatctcttgttctggaagcagctctaatatcggaagtatactgtaaattggtatcaacactcccaggaaccggcccccaaactcctcatctatagtaataatcagcggccctcgacggggtccctagaccgatttcctctcggtctcctaagtcctggcacctcacgtccctccctcggcctactcgacggtcgggcccttaccacgtccgtgatggatggacggtctagtatttacttacttgtcgacgagactagtagggtactggaacctacccgtgtagtcgggttcgtttggttcggttcgggttttccggacgggtacggaccgtaacggtcgtacggtacccggttccggtacggtaccg

SEQ ID NO: 179409 - DNA, 174 bp, Homo sapiens
  misc_feature: GYAE6OF02HJU63.11.86.H09.1.454.CMB.1.raw
  modified_base (173)..(174): a, c, t, g, unknown or other
  misc_feature (173)..(174): n is a, c, g, or t
tcagcgagagataccacgaccggtgctcgatttagtgctatagacttgggtttgggggaagaggaagactgacggtcccccaggagttcaggtgctgggcacagcggccctgggctgcctggtcaaggactacttccgtatctctcgctgagcgggctggcaaggcgcatagnn

SEQ ID NO: 179410 - DNA, 486 bp, Homo sapiens
  misc_feature: GYAE6OF02ICHWM.11.86.H09.1.454.CMB.1.raw
  modified_base (342)..(342): a, c, t, g, unknown or other
  misc_feature (342)..(342): n is a, c, g, or t
  modified_base (437)..(437): a, c, t, g, unknown or other
  misc_feature (437)..(437): n is a, c, g, or t
  modified_base (474)..(474): a, c, t, g, unknown or other
  misc_feature (474)..(474): n is a, c, g, or t
  modified_base (478)..(486): a, c, t, g, unknown or other
  misc_feature (478)..(486): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacncctgaatggtccttgtgttgggtttcggcgggacgggaccaagctcggaccgtccgtaggtcagcccaaggctcgcccctcgtcactctcgtccnccctctcgtactctctcgctgcgcggctggcagcgcntagnnnnnnnnn

SEQ ID NO: 179411 - DNA, 493 bp, Homo sapiens
  misc_feature: GYAE6OF02F860R.11.86.H09.1.454.CMB.1.raw
  modified_base (483)..(493): a, c, t, g, unknown or other
  misc_feature (483)..(493): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacacctgaatggtccttgtgtggttttcggcggagggaccaagctgaccgtcctaggtcagtcccaagtccgtcgccccctggtccacttctcgttcccaccctcctcgtatcctctcgctgagcgggctggcaggcgcatagnnnnnnnnnnn

SEQ ID NO: 179412 - DNA, 514 bp, Homo sapiens
  misc_feature: GYAE6OF02IXFB1.11.86.H09.1.454.CMB.1.raw
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
  modified_base (508)..(514): a, c, t, g, unknown or other
  misc_feature (508)..(514): n is a, c, g, or t
tcagcgagagataccacgaccggtgctcgatttagtgctatagacttgggtcctgggcccagtctgtgctgactcagccaccctcagcgtctgggaccccgggcagagggtcatcatctcttgttctggaagcagctctaatatcggaagtaatactgtaaattggtatcaacaactcccaggaacgcccccaaatcctcatctatagtaataatcagcggccctcgaggggtccctgaccgattctctggctccaagtctggcacctcagcctcctggccatcagtggctccagtctgatgatcgaggctgattattactgtgcagtcaatgggatgacaccctagaactggtccttgtgtcggttttcggcgggtaggaccaagctgaccgtcgtgctacgccgaagctccgccctcgtcactctcgttcccacctcctcgtactcctctccgtcgtacgtcggccggtacgcggtacgacggtcgacaacgtcgntcgcgtncgnnnnnnn

SEQ ID NO: 179413 - DNA, 190 bp, Homo sapiens
  misc_feature: GYAE6OF02FTZL9.11.86.H09.1.454.CMB.1.raw
  modified_base (172)..(190): a, c, t, g, unknown or other
  misc_feature (172)..(190): n is a, c, g, or t
tcagcgagagataccacgaccggtgctcgatttagtgctatagacttgggtttgggggaagaggaagactgacggtcccccaggagttcaggtgctgggcacagcggccctgggctgcctggtcaaggctacttccgtatctctcgctgagcgggctggcaaggcgcatagnnnnnnnnnnnnnnnnnnn

SEQ ID NO: 179414 - DNA, 175 bp, Homo sapiens
  misc_feature: GYAE6OF02G2C5M.11.86.H09.1.454.CMB.1.raw
  modified_base (174)..(175): a, c, t, g, unknown or other
  misc_feature (174)..(175): n is a, c, g, or t
tcagcgagagataccacgaccggtgctcgatttagtgctatagacttgggtttggggggaagaggaagactgacggtcccccaggagttcaggtgctgggcacagcggccctgggctgcctggtcaaggactacttccgtatctctcgctgagcgggctggcaaggcgcatagnn

SEQ ID NO: 179415 - DNA, 497 bp, Homo sapiens
  misc_feature: GYAE6OF02G46Z6.11.86.H09.1.454.CMB.1.raw
  modified_base (360)..(360): a, c, t, g, unknown or other
  misc_feature (360)..(360): n is a, c, g, or t
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
  modified_base (481)..(497): a, c, t, g, unknown or other
  misc_feature (481)..(497): n is a, c, g, or t
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtcccctgaccgattctctggttccttgtctgacacctcagcctccctggccatcactgggctccagcctgaggatgaggctgattattactgtcagtcctttgactattaaacnggtatgtggtattcggcgagggacccagtaaccgtcgtaggtcagcccaggctcggcccctggcactctcgttcccacctcctcgttactcctctcgctgcgcggntggcaggcngatagnnnnnnnnnnnnnnnnn

SEQ ID NO: 179416 - DNA, 756 bp, Homo sapiens
  misc_feature: GYAE6OF02J2WIV.11.86.H09.1.454.CMB.1.raw
  modified_base (419)..(419): a, c, t, g, unknown or other
  misc_feature (419)..(419): n is a, c, g, or t
  modified_base (733)..(733): a, c, t, g, unknown or other
  misc_feature (733)..(733): n is a, c, g, or t
  modified_base (743)..(743): a, c, t, g, unknown or other
  misc_feature (743)..(743): n is a, c, g, or t
  modified_base (746)..(746): a, c, t, g, unknown or other
  misc_feature (746)..(746): n is a, c, g, or t
  modified_base (748)..(748): a, c, t, g, unknown or other
  misc_feature (748)..(748): n is a, c, g, or t
  modified_base (750)..(751): a, c, t, g, unknown or other
  misc_feature (750)..(751): n is a, c, g, or t
  modified_base (753)..(753): a, c, t, g, unknown or other
  misc_feature (753)..(753): n is a, c, g, or t
  modified_base (755)..(756): a, c, t, g, unknown or other
  misc_feature (755)..(756): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactagtaaattggtatacaacaacctcccgaacggaacccggacccccaaactcctcactctatagtaataatcacgcggccctcgacgggtccctagaccgtattctcgtacggcctaccgaacgttcgtcggcctaccctcgaccgtccctccccgtggaccctatcgagggtccgggtcctacccgtggtcctaggaacttcggagttacggacgtcttaacggtttattaacgtacgttgtacgtaccgaagtcctaggngggtactaccgtaaccgtaccgtagtacggttcgggtttaccgtttggggttacgggttttcgggggttacccgggaacgggtaccggtaacggtacgttcccgggaacccgtttaccgggtaccgtttaaccgggacccgtaaccgggaccgggtaccgtttccccggtaccccggttacccgttccgggttaacccttcccgttaacccgtttcccccgtaccccgttacccgttcctttacccggtcttccccggtgttacccggcggttacgggcccggaccggttcggcgtacggtaccggcttacggntccgatcgcngcncncnncngnn

SEQ ID NO: 179417 - DNA, 582 bp, Homo sapiens
  misc_feature: GYAE6OF02GLA4K.11.86.H09.1.454.CMB.1.raw
  modified_base (562)..(562): a, c, t, g, unknown or other
  misc_feature (562)..(562): n is a, c, g, or t
  modified_base (576)..(582): a, c, t, g, unknown or other
  misc_feature (576)..(582): n is a, c, g, or t
tcagcgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatacgtaataatcagcggccctcaggggtcctgaccgattctctgctcaagtctggcacctcacgcctccctggccatccagtgggctccagtctcgatgactgaggctagtattattactgtgctagcagtggatgacaccctgaatcggtacctttggtgttcggttttcggcggaggtaccaagtcgtggtacccttaccgtggttaccacggcccgaacggtcgtaccggtccccctcgggttccaccgtcgtccggttcccccgtcccttcccttccggtaccttccgttcctaccgtccgtgccgggacggggtccctggggaccaagggccgttanacgtagctagcgtnnnnnnn

SEQ ID NO: 179418 - DNA, 552 bp, Homo sapiens
  misc_feature: GYAE6OF02GCT40.11.86.H09.1.454.CMB.1.raw
  modified_base (531)..(531): a, c, t, g, unknown or other
  misc_feature (531)..(531): n is a, c, g, or t
  modified_base (535)..(535): a, c, t, g, unknown or other
  misc_feature (535)..(535): n is a, c, g, or t
  modified_base (539)..(543): a, c, t, g, unknown or other
  misc_feature (539)..(543): n is a, c, g, or t
  modified_base (545)..(545): a, c, t, g, unknown or other
  misc_feature (545)..(545): n is a, c, g, or t
  modified_base (547)..(552): a, c, t, g, unknown or other
  misc_feature (547)..(552): n is a, c, g, or t
tcagcgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtggctccagtctgatgatgaggctgattattactgtctgtcctatgacgacgacctacacgtacttccggttttcggcgggtagggactaagcgtcgaccgtccgtaagtccacgcccgaaggtcctacgtccccgtcggtccacctccgttccgttccccaccccgttcctccgttactccttccgtaccgccgtggacggtccgggtcgtcgggaccgtaacgggccgacctagtacggnacgngtcnnnnngncnnnnnn

SEQ ID NO: 179419 - DNA, 761 bp, Homo sapiens
  misc_feature: GYAE6OF02JEV7D.11.86.H09.1.454.CMB.1.raw
  modified_base (120)..(120): a, c, t, g, unknown or other
  misc_feature (120)..(120): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagcgagagataccacgaccggtgctcgatttagtgctatagacttgggtccgtgggcccagtctgtgcgtgactcagccacctcagcgtctgggaccccgggcagagggtcatcatcnctgttctggaagcaggctctaagtagtcggaagtaatactgtaaattggtatcaacaactccaggaaccggccccaaatcctcatctatagtaagaatcagcggccctcacggggtcctgaccgtagttctctgggcctaccgaagttccgttcggcaaccccgttcaaggtccctcccgtggacccctataccgaaggtcgggacttccgacggtnttcggaattcgagaggccggntagtagttattaccgngttggaccagcctaagnggggactagacctacccggtagtaacgtcggttccgttgtcggggggtttaactttccggacggggaacggtaaccgtaaacggcgttaaacggcccgttcccgtaaaggttccgaaccggtaccgaaaccggtcccgttaccgcccccggttacggtaccctaacgtttcccgaccgtttacccggtccccttaccgttaccgttacgtccgttacctaccggtcgttacgggaacccggtccgggtccgttaccggaaggtacccggggttccgttaaaaccgggccgtttaaaccggggacttaccccgggtacgtaacccggtaccgttacggaccggttaccggtacggtacccgtaaggtacgg

SEQ ID NO: 179420 - DNA, 178 bp, Homo sapiens
  misc_feature: GYAE6OF02F1UTQ.11.86.H09.1.454.CMB.1.raw
  modified_base (174)..(178): a, c, t, g, unknown or other
  misc_feature (174)..(178): n is a, c, g, or t
tcagcgagagataccacgaccggtgctcgatttagtgctatagacttgggtttggggggaagaggaagactgacggtcccccaggagttcaggtgctgggcacagcggccctgggctgcctggtcaaggactacttccgtatctctcgctgagcgggctggcaaggcgcatagnnnnn

SEQ ID NO: 179421 - DNA, 175 bp, Homo sapiens
  misc_feature: GYAE6OF02HZGRN.11.86.H09.1.454.CMB.1.raw
  modified_base (173)..(175): a, c, t, g, unknown or other
  misc_feature (173)..(175): n is a, c, g, or t
tcagcgagagataccacgaccggtgctcgatttagtgctatagacttgggtttgggggaagaggaagactgacggtcccccaggagttcaggtgctgggcacagcggccctgggctgcctggtcaaggactacttccgtatctctcgctgagcgggctggcaaggcgcatagnnn

SEQ ID NO: 179422 - DNA, 213 bp, Homo sapiens
  misc_feature: GYAE6OF01A8OL5.13.87.H10.1.454.CMB.1.raw
  modified_base (172)..(213): a, c, t, g, unknown or other
  misc_feature (172)..(213): n is a, c, g, or t
tcagtcacgtactacacgaccggtgctcgatttagcagtactgcgttgggtttgggaagaggaagactgacggttccccaggagttcaggtgctgggcacagcggccctgggctagcctggtcaaggactacttcctagtacgtgactgagcgggctggcaaggcgcatagnnnnnnnnnnnnnnnnnnnnnnnnnnnnnnnnnnnnnnnnnn

SEQ ID NO: 179423 - DNA, 500 bp, Homo sapiens
  misc_feature: GYAE6OF01CLWV2.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaaagtccctaaagctcctgatctatgttgcatccacttttgcaaagtgggtcccatcaaggttcagcggcagtggatctgggacagaattcactctcacaatcagcagcctgcagcctgaagattttgctaactttattactgtcaacagacttaatagttacccgcttcagtttcggcggagggaccaaggtggagatacaaacggactgtgctgacaccatctgttc

SEQ ID NO: 179424 - DNA, 174 bp, Homo sapiens
  misc_feature: GYAE6OF01ED3L3.13.87.H10.1.454.CMB.1.raw
  modified_base (173)..(174): a, c, t, g, unknown or other
  misc_feature (173)..(174): n is a, c, g, or t
tcagtcacgtactacacgaccggtgctcgatttagcagtactgcgttgggtttgggggaagaggaagactgacggtcccccaggagttcaggtgctgggcacagcggccctgggctgcctggtcaaggactacttcctagtacgtgactgagcgggctggcaaggcgcatagnn

SEQ ID NO: 179425 - DNA, 566 bp, Homo sapiens
  misc_feature: GYAE6OF01CYYFP.13.87.H10.1.454.CMB.1.raw
  modified_base (470)..(470): a, c, t, g, unknown or other
  misc_feature (470)..(470): n is a, c, g, or t
tcagtcacgtactacacgaccggtgctcgatttagcagtactgcgttgggtttggggagtcagtcccagtcaggacacagcatggacatgagggtccccgctcagctccgtggggctcctgctgctctggctcccaggtgccagatgtgacatccagttgacccagtctccattcccttcctgtctgcatctgtaggagacagagtcaccatcacttgccgggccagtcaggactattaacagtttatttagtctggtatcaagacaaaaaccgagggaaactccctaagctacctgatctatgttgctatcctatttgactaaaggttcgggtaccatacgaaggttcaggcggcaggtggatcgtgggaacagtaacttcactctacaacaatcagcagcctgacagctagaattatttcgactaatttattactgtaccaacgtataacttaacttaccgttacccnttacgttaggttccgggacggtaacgggaccgtaagggtgaagtactaacgaaacgtcgttggtaggcttacggactaacctacgttcgtcgttcc

SEQ ID NO: 179426 - DNA, 558 bp, Homo sapiens
  misc_feature: GYAE6OF01B50DI.13.87.H10.1.454.CMB.1.raw
  modified_base (270)..(270): a, c, t, g, unknown or other
  misc_feature (270)..(270): n is a, c, g, or t
  modified_base (403)..(403): a, c, t, g, unknown or other
  misc_feature (403)..(403): n is a, c, g, or t
  modified_base (456)..(456): a, c, t, g, unknown or other
  misc_feature (456)..(456): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcaagacaaaaaccgngggaaatccctaagctcctagatctatgttgcatccactttgacaaaggtcgggtacccatcaaggttcagcgcagtggatcgtaggacagtaatcactctacacaatcagcagcctgcacgcctagaagttnttttagactaactttattactgtacaacgtagtactttaatacgttaaccccnttacgtaggtttcgggaccggtagggaaaccgtagggtacggaagtactaacgaaaacggtacttggtaggccgttacgacctacctattccgttgttaccc

SEQ ID NO: 179427 - DNA, 557 bp, Homo sapiens
  misc_feature: GYAE6OF01D5KV7.13.87.H10.1.454.CMB.1.raw
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaatccctaagctcctgatctatgttgcatccactttgcaaagtgggtcccatcaaggttcagcggcagtggatctggcacagacttcattcncaccatcagcagccctgcagcctgaagtnttttgactaactttattactgtactaacaagattacaactaaatttactcccgtaggggtaccgtttccggaccgtaaaggggaaccctaaaggggtacggaaaattacgaaaaaccgaacgttggtacgggtaccttacggaccctaacccgtatccgttacg

SEQ ID NO: 179428 - DNA, 521 bp, Homo sapiens
  misc_feature: GYAE6OF01BAW4C.13.87.H10.1.454.CMB.1.raw
  modified_base (379)..(379): a, c, t, g, unknown or other
  misc_feature (379)..(379): n is a, c, g, or t
  modified_base (514)..(514): a, c, t, g, unknown or other
  misc_feature (514)..(514): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaatccctaagctcctgatctatgttgcatcctactttgactaaaggtcgggtacccatcaaggttcagcggcagtggatcgtgggacagaattcactctcacatcancagcctgcagcctagaagtattttgactaacttattactgtacaatacgtacttaatacgttacccattctacggttcggacggaggaccagggtcgacgagatacgaaacgtactggtacggctacgacaaccnttcgtcg

SEQ ID NO: 179429 - DNA, 516 bp, Homo sapiens
  misc_feature: GYAE6OF01DBFHI.13.87.H10.1.454.CMB.1.raw
  modified_base (339)..(339): a, c, t, g, unknown or other
  misc_feature (339)..(339): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccacgttgacccagtctccagtccttcctgtctgcatctgtaggagacagagtcaccatcacttgccggcagtcaggacattacagttattagcctggtatcagcagaagccaggagagtccctaaattattgatctctgctgcgtccgccttgcaatcggggtccatctcgttcagtggcggtggntctaggacagaattcaactctacaccactcaccaacctgcaccctgaacgatgttgaagttattaactgtctagacctataagtggtcggcccgtctcgacttttcgggacggagggtacccaggtcgacgagatacgaaacgtacgtagtcggcgtgacacctacgtctggttacc

SEQ ID NO: 179430 - DNA, 554 bp, Homo sapiens
  misc_feature: GYAE6OF01DVTGU.13.87.H10.1.454.CMB.1.raw
  modified_base (545)..(545): a, c, t, g, unknown or other
  misc_feature (545)..(545): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgcctagatcggtcacgataccgagttcgaacacagtctccatccttcctgtctgcatctgtaggagacagagtcaccatcacttgccgggccagtcaggacattaacagttatttagtctggtatcagacaaaaaccaggaaacgtccctaagctcctgatctatgttgctatccactttgacaaagtgggtcccatcaagttcagcgcagtggatcgtgggacagtaattcactctcacaatcagcagctcgcacgacctagaagtatttagtactaacttaacttaacttactactaactaatacttaacgtacgttaccgtacctacgtacgttacggtacggtacggacgtaacggtaggagtagtaacgtaacgaacgtagtacggtcgtacgacaccgtntcgttaccg

SEQ ID NO: 179431 - DNA, 512 bp, Homo sapiens
  misc_feature: GYAE6OF01DETRD.13.87.H10.1.454.CMB.1.raw
  modified_base (350)..(350): a, c, t, g, unknown or other
  misc_feature (350)..(350): n is a, c, g, or t
  modified_base (481)..(481): a, c, t, g, unknown or other
  misc_feature (481)..(481): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggagcttggtacagcctggcagggtcccctgagactctcctgtgcagcctctggattcacctttagcaactatgccatgagctgggtccgccaggctccgagggaagggctggagtgggtctcaactattagngctagtggtgccaccacatactacgcagacctccgtgagggccgattcaccatctccagagacaattccaagaaccacgctgtttctacaatgaacagcctgagagccgatgacacggcgtgtattactgngcgagagagtggggcccacggtacgttaccg

SEQ ID NO: 179432 - DNA, 539 bp, Homo sapiens
  misc_feature: GYAE6OF01BVACD.13.87.H10.1.454.CMB.1.raw
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagacaaaaaccgagggaaatccctaagctcctgatctatgttgcatcctactttgacaaaggttcggggtacccatacgaaggttcaaggcggcagtggatcgtagggacagtaattcactctacaacaatcagcagcctgcagcctagaatntttgactaacttatactntacaatagtacttaatacgttacccnttactaggttcggacggaggtaccgaagggtggaacgtactacgaaaacggtactggtacgacgtacgacctactattcgtgttacc

SEQ ID NO: 179433 - DNA, 500 bp, Homo sapiens
  misc_feature: GYAE6OF01EV5ZG.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatcctccctgtctgcatctcttggagacagagtcaccgtcacttgccggcgagtcacgacattaacacttatttagcctggtatcagcagaagccagggagagtccctaaattatgatctctgctgcgtccgcttgcagtcggggtcccatctcggttcagtggcggtggatctaggacagaattcactctcaccatccaccaacctgccaccctgaacgtatgttagtaagttattactgtcagtacctatagtggtcgcccgctctagtttcggacggagggaccaaggtcgcgagagtcaaagactgtgctagcacatctgtcttac

SEQ ID NO: 179434 - DNA, 598 bp, Homo sapiens
  misc_feature: GYAE6OF01DFEZH.13.87.H10.1.454.CMB.1.raw
  modified_base (265)..(265): a, c, t, g, unknown or other
  misc_feature (265)..(265): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttatttagtctggtatcagacaaaacnggaaacgtcctaagcctcctgatctatgtgacatccatttgcaaagtcgggtacccatcaaaggttcagcggcagtggatcgtggacagattcactctacacaatcagtacacgccgtagcacgtaccgtagtaagttagtttttacgcttaaactttactttaacgtacgtactaaaccgtagttacctttaaaacgttaccgggtttaacccgtcgttactaacggggttttccggacggggtaacgggtacgaaacgggtttgggaacgtaacgtaccgtaaacggtaacgtggttacggccttaggacccactaactcgttaggttccc

SEQ ID NO: 179435 - DNA, 486 bp, Homo sapiens
  misc_feature: GYAE6OF01BNBER.13.87.H10.1.454.CMB.1.raw
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
  modified_base (478)..(478): a, c, t, g, unknown or other
  misc_feature (478)..(478): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacacttatttagcctggtatcagcagaagccagggagagtccctaaattattgatctctgctgcgtccgccttgcaatcggggtcccatctcggttcagtggcgtggatctagacagaattcactctcacatcacacctgcacctnaagatgttgaagttattactgtcanacctatagtggtggcccgtctcattttcggcggtagggaccaggtgcagatcaaacgactgtggctgcaccntctgttcc

SEQ ID NO: 179436 - DNA, 536 bp, Homo sapiens
  misc_feature: GYAE6OF01BM1VT.13.87.H10.1.454.CMB.1.raw
  modified_base (443)..(443): a, c, t, g, unknown or other
  misc_feature (443)..(443): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagacaaaaaccagggaaactccctaagctcctgatctatgttgcactcctactttgactaaaggtcgggtacccagtcaaggttcagcggcagtgatcgtggacagaattcactctacacatcagcagctgcagctagaatatttgactaactttatactgtacaactagtacttaatacgttacccnttacgtagttcggacggtaggaccgtaagggtagaagtactacgaaaacggtacgtaggtacggacttacgacctaacctacttcgtgttacc

SEQ ID NO: 179437 - DNA, 538 bp, Homo sapiens
  misc_feature: GYAE6OF01EDO7T.13.87.H10.1.454.CMB.1.raw
  modified_base (393)..(393): a, c, t, g, unknown or other
  misc_feature (393)..(393): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagttattagtctggtatcagacaaaaccgaggaaactcctaagctcctgatctatgtgcatccatttgactaaaggtcgggtcccatacgaaggttcagcggcagtgatcgtaggacagattcactctacacatcagcagcctgcagtctagtaagtntttacgactaacttattactgtacaactagtactttaagtacgttaacccgtcttactacggttcggacggaaggtaccaagggtgagtacgtacgaaacggtacgttggagtaccttcggacctaaccgtattccgtgttaccg

SEQ ID NO: 179438 - DNA, 663 bp, Homo sapiens
  misc_feature: GYAE6OF01ETIQT.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtgggggagcttggtacagcctggcaggtcctgagactctcctgtgcagcctctggattcacctttgattgattatcgcctatgcacgtgggtccgacaagctaccgaggggacggcctgggagtgggtctacgaggttattaggttaggaatggtggtagctaagtaggtctagtcggacggtacttcgtagggtaggaacggggtcctaatttcccgaacctacgtacctacccgaaggtaacgaacccaaaccggacccaaacggtaaccccttccccgtagtactccgtaggaacctaaaagtcggaaacacgacctaggacggacgtaccgtaggaaccgggaccgtaccggggttccctttaaggttaactttaacgttggtaacgtaaacctaaaaacggtacccctttaacccccgttaaaaccccgtttaggtttaaacgg

SEQ ID NO: 179439 - DNA, 534 bp, Homo sapiens
  misc_feature: GYAE6OF01DSTYP.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcaagcaaaaaccagggaaatccctaagctcctgatctatgttgcatccatttgcaaagtgggtccatcaaggttcagcggcagtggatcgtgggacagaattcactctacacaatcagcagccctgcagcctagaagtattttgactaactttattactgtactaacaagatacaactaattactccgtgggtacgttccggaccaaaggggaccctaaagggtacggaaaacttacgaaaaacggtctaggtggacctcgacaccattctggttacc

SEQ ID NO: 179440 - DNA, 549 bp, Homo sapiens
  misc_feature: GYAE6OF01CAGMU.13.87.H10.1.454.CMB.1.raw
  modified_base (396)..(396): a, c, t, g, unknown or other
  misc_feature (396)..(396): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatcctccctgtctgcatctgtaggagacagagtcaccatcacttgccgggcaagtcagggcattagaaatgatttagctggtatcagcagaaaccagggaaagccctaagctcttgatctatggtgcataccaagtttaaaaagtgggtacccagtcaaggttcagcggcagtggatctggcacagacttcattctcaccatcagcagcctgcagcctagaacgtnttttgactaactttattactgtactacaagtatactaactaaattacgtaccgtagggtaaccgttcggaaccgaaacgggtaacccgaaagggtaggaaaactacgtaaaaacgaaccttaggtacggacttagaccaacctagtcttacgg

SEQ ID NO: 179441 - DNA, 571 bp, Homo sapiens
  misc_feature: GYAE6OF01C2DK3.13.87.H10.1.454.CMB.1.raw
  modified_base (234)..(234): a, c, t, g, unknown or other
  misc_feature (234)..(234): n is a, c, g, or t
  modified_base (479)..(479): a, c, t, g, unknown or other
  misc_feature (479)..(479): n is a, c, g, or t
  modified_base (565)..(565): a, c, t, g, unknown or other
  misc_feature (565)..(565): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttgccggcagtcagacattaacngttattagtctggtatcaagacaaaaacgaggaaactcccaagctcctagattctatgttgctatccatttgacgtaaagtcgggtacccaagtctaaaggttcaaggcggtacaggttcggaatcgtgggaactaagtaacttcactctacaacgaatcaagcagcctgccaagtcctaggtaattacgtttcgactaaactttacttactagtacaacgtatactttaagtaacggttacccnttcgtaacggtttcgggacggtaagggacctaagggtgagaaactacgaaaacgtcgttcggtgacctcgactaccgtattccgtnttaccg

SEQ ID NO: 179442 - DNA, 518 bp, Homo sapiens
  misc_feature: GYAE6OF01DU33E.13.87.H10.1.454.CMB.1.raw
  modified_base (231)..(231): a, c, t, g, unknown or other
  misc_feature (231)..(231): n is a, c, g, or t
  modified_base (412)..(412): a, c, t, g, unknown or other
  misc_feature (412)..(412): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagatgagccagtctccatccaccctgtctgcgtctctcggagacagggtcaccatcacttgtcgggcaagtcagacnttggcaactcttaaattggtatcagcagaagtcagggcaagccccgaacctcctgatctacggtacatccactttgcacagtgggatccatcaaggttcagtgcagtagatctggaacagtacttttaccctcaccatcaggggtctacgacgcctagaagtatttgcgtacttactattntacaactagtattacctctccccggtacgttcgccgaaggaccaaggtcgaaagtcaagcgaatgtcggntacgcaccatcttntacttctactcttcccgtaccc

SEQ ID NO: 179443 - DNA, 543 bp, Homo sapiens
  misc_feature: GYAE6OF01ECB6O.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtcgccttgcaatcggggtcccatctcgttcagtggcggtggatctaggacagaattcactctcaccatcaccaacctgacaccctagaagtatgttggtaattattactgtacagacctagtagtggtaggcccgtctacctagttttccgggacgggtaacgggtaccaaagggttcgacgaagtaactacgaaaacgtaacgttaggtaggtacctggaccaacccacttcgtgttacccg

SEQ ID NO: 179444 - DNA, 575 bp, Homo sapiens
  misc_feature: GYAE6OF01CKCNR.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaactccctaagctcctgatctatgttgctatcctactttgacgtaaagtcgggtacccagtcgaaggttcagcggcagtgatcgtggacagattcactctcacaatcagcagcctgcagactagaagtattttgactaattattactagtacaactagtacttaatacgttacccgcttacgtaacggtttccgggacgggtaacgggtaacccgtaaagggtagggtaacgtaacgttaaccgaaaacggtacgttgggtacggctacggaccctaaccgtacttccgttacggtttaccc

SEQ ID NO: 179445 - DNA, 174 bp, Homo sapiens; identical to SEQ ID NO: 179424
  misc_feature: GYAE6OF01E2PRO.13.87.H10.1.454.CMB.1.raw
  modified_base (173)..(174): a, c, t, g, unknown or other
  misc_feature (173)..(174): n is a, c, g, or t

SEQ ID NO: 179446 - DNA, 605 bp, Homo sapiens
  misc_feature: GYAE6OF01EJPG5.13.87.H10.1.454.CMB.1.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
  modified_base (473)..(473): a, c, t, g, unknown or other
  misc_feature (473)..(473): n is a, c, g, or t
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggggaggcttggtacagcctggcaggtccctgagactctcctgtgcagcctntggattcacctttgatgattatgccatgcacgtgggtccgnaagctccgagggacggcctggagtgggtctcgaggtattaggttggaatggtggtagctagtaggctagtggaccggtactcgtggtaggaacggggcctattccacctatcctacgagacgacaacgccaaacgtacctccctagtactctagactaaactcgaacncgaccgtagacgacgacgtaggaacggacgaccggttccttagttaacgtttgttagtacgaacgtaaaacgtacttaacccccgttaaacccgtttacggttaagtttttacgggagtttgggttaaccgg

SEQ ID NO: 179447 - DNA, 551 bp, Homo sapiens
  misc_feature: GYAE6OF01DF8BO.13.87.H10.1.454.CMB.1.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
  modified_base (425)..(425): a, c, t, g, unknown or other
  misc_feature (425)..(425): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagtttattagtctggtatcagacaaaaaccgagggaaactccctaagccttacctgatctatgttncatccatttgacaaaggtcgggtacccatcaaggttcagcganagtgatcgtaggacagtaacttcaactctacacaatcagacagactgcagctagaagttatttcgactaatttatactntacaacgagtaccttaattccgttaccgcttacgtacggtttccgggacgggtaacgggaaccgaagggtcgaagtaactaacgaaacgtagtggtagactcgaccttaccgattcgttacgttcc

SEQ ID NO: 179448 - DNA, 668 bp, Homo sapiens
  misc_feature: GYAE6OF01DRKSO.13.87.H10.1.454.CMB.1.raw
  modified_base (284)..(284): a, c, t, g, unknown or other
  misc_feature (284)..(284): n is a, c, g, or t
  modified_base (619)..(619): a, c, t, g, unknown or other
  misc_feature (619)..(619): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatcgtgtaggagacagagtcaccatcacgttgccgggccagtcaggactattaactagtttattagtctggtatcgaagaccaaaaacgaggtaaacnccctaagctacctagatctagatcgactactacctaagtttacggaaacgtacgggtaccagtacgtaaggttcaaggtggaagtggatcgtaggaactagttacttttacgttacaacctagtacacgtactacgtcccgtagaccgtacgtaccgttaaggtaaacgtattaacgttacgaacctaacgtaatttaacttacgtgtacgaaggtactaagttactaagtaacttaaccttcccgtacccggtacttaccgtacccgttaccgggaaaccgtaacgggtaccctaacggtacggtaacgggtaattaaaccggttaaaaccggngtttacgggtaccgtacgtacgtaacccgtaacttcgttcgtttacccg

SEQ ID NO: 179449 - DNA, 705 bp, Homo sapiens
  misc_feature: GYAE6OF01A143K.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatcccttcctgtctgcatctgtaggagacagagtcaaccatccacttgccgggccagtcaggactattaacagtttatttagtctaggtatcaagacaaaaaccgagggaaactccctaagctacctgaatctatgttcgctacttcctactttgaccgtaaaggttcgggtacccaagttacgaacgggtttcaacgggccggtacgtaaggtgggactccggtagggaactaacggtaaactttcctaaccttctactaacaacttccgaagaccacgtaccttaggacctaacggtccttaggtaaacgtttacgtttttacgaacctttaaactttacgtttaacgttacgtaacctaacgtaccgttaactttaaacgttaacccggtttaccccgactttacgttacgggtttaccgggaccgggtaaacgggtaaccgtaaggggtacggtaaacgtacggttaaaccgaaaacgggttcgtacgggtccggtaactacgtacctaaccctattcccgttgttacccg

SEQ ID NO: 179450 - DNA, 572 bp, Homo sapiens
  misc_feature: GYAE6OF01B01DP.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagatgacccagtctccatcctccctgtctgcatctcttggagacagagtcaccgtcacgttgccgggcgagtcacgacattaacacttatttagcctggtatcagcagaagccgagggagagtccctaaattattgatctctgctgcgtccgcttgcagtcggggtcccagtctcggttcaggtggcggtggatcgtaggacagtaattcactctcaccactaccaccaacctgccaccctagaatagttgttaggtaagtttattacgtgtactagtaccttagtacggtggtcggcccgtcgttaccttacgttttcgggacgggtaaggggaacccgtaagggtcgaccgtaagacgtaacgaaaacggtaccgtggtggaccgtacggacctaaccgtattccgtgtttacccg

SEQ ID NO: 179451 - DNA, 559 bp, Homo sapiens
  misc_feature: GYAE6OF01A87SA.13.87.H10.1.454.CMB.1.raw
  modified_base (399)..(399): a, c, t, g, unknown or other
  misc_feature (399)..(399): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaatccctaagctcctgatctatgttgcatccactttgacaaaggtcggggtacccagtcaaggttcagcggcagtgatcgtggacagaattcactctacacaatcagcagcctgcagcctagaagtntttagactaacttattactagttaccaactagtacttaagtacgttacccgcttacgtacggtttaccgggacggtacgggaaccgtaagggtagggaacgtactaaccgaaaacggtacgttaggtacggaccttggaccctaccacttcgtcgttacc

SEQ ID NO: 179452 - DNA, 621 bp, Homo sapiens
  misc_feature: GYAE6OF01A4RI4.13.87.H10.1.454.CMB.1.raw
tcagtcacgtactacacgaccggtgctcgatttagcagtactgcgttgggtttggggagtcagtcccagtcaggacacagcatggacatgagggtcccgctcagctcctgggctcctgctgctctggctcccaggtgccagatgtgacatccagttgacccagtctccatccttcctgtctgcatctgtaggagacagagtcaccatcacttgccgggccagtcaggacattaacagttatttagtctggtatcaagacaaaaaccgagggaaactccctaagctcctgatctatgttgcatccatttgcaaaggtcgggtaccatcgtaaggttcaggcgctaggtggactcgagggacagtattcgactctacaacatcacgcacgcctgaccacgccgtagaagttacttttgaccttaactttaactttacgtctaccgaaactacgtaactttaaacgtaccgtttaaccccgtcttaccgtacgggtttaccgggaccgggtaaacgggtaacccggtaaagggtggggtaacgtaacgttaacccggaaaaacggtcgtttacgggtacggccgttacggacccttaaacccgtcgtttaccgttcggttaccc

SEQ ID NO: 179453 - DNA, 787 bp, Homo sapiens
  misc_feature: GYAE6OF01CRCCH.13.87.H10.1.454.CMB.1.raw
  modified_base (186)..(186): a, c, t, g, unknown or other
  misc_feature (186)..(186): n is a, c, g, or t
tcagtcacgtactacacgaccggtgctcgatttagcagtactgcgtttgggtttggggagctctgggagaggagaccccagccctgagattcccaggtgtttccattcagtgatcagcactgaacacagaggactcaccatggagttgggactgagctggtattttcctttgtctattttaaaggngtccagtgtgaagtgcagctggtggagtcgtgggggagcgttggtacagcctggcaggtccctgacgactctccgtgtgcagcctgtgattcacctttgatgattagtcgcctagtcgcctacggtcggtaccggctaacgccgtacgagggaacgtccgtggacgtcggtaccttcgtaggttatttaggtaggtaaagttggtacgggttaacgcgtaaggttacggtacgttaacgttcgggaacggtttaccgtaccggttcgggttagggaaccggggtaccggtaacgttttaccccgaacccttaacgttacccgttaccgaacgggtaacgtaaacccgaaaccggacccccgttaaaacggtaaccccttacccggttaacgttaacgtacccttacgaaacccgttaaaagtaccgggaaaccaaccggtcccgttaggaagggacgttaccggaacggagggtaaaccccgtaccggggtttacccttttacggttaaaacgttttagtttacggttaaagtaaaccccgtaaaaacgttaacccgtaacccccgtttaaaacccccgtttaagggttttttaaacccgg

SEQ ID NO: 179454 - DNA, 592 bp, Homo sapiens
  misc_feature: GYAE6OF01D5EJE.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagacaaaaaaccaggaaagtccctaagctcctagatctatgttgcatccgactttgacaaaggtcggggtaccccatcaaaggttcagcggcagtggatcgtagggacagaaattcaactctacaacaatcaagcagcctagcaaggcctagaagtattttgactaaatttagttactgtacaaacagtacctttaaataacgtttacccgattcgtaagtttccgggacggtaaggggaacctaaaggggtggaacgtaaattaacccggaaaaacgtaacgttacggttacggaaccgttcggaacctaaccccgtaattcccgttggttaaccc

SEQ ID NO: 179455 - DNA, 600 bp, Homo sapiens
  misc_feature: GYAE6OF01C0Y6O.13.87.H10.1.454.CMB.1.raw
  modified_base (402)..(402): a, c, t, g, unknown or other
  misc_feature (402)..(402): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctccaggtgccagatgtgacatccagttcgacccagtctccatccttcctgtctgcatctgtaggagacagatcacatcacttgccggcagtcaggactattaacagttatttagtctggtatacaagaacaaaaaccgagggaaactccctaagcctacctagatctatgttgctactcctactttgacgtaaaggtcgggtaccagtacgtaaggttacaggcggacaggtggatcgtaggactagtaacttcactctacaacaatcganccagcctgacagtccgtagaacgttattttcgaacttaactttagttactagtaactaacgtagtaactttaacgtaaccgttacccgtacttacggttacggtttacgggaacgggtaaggggtaaccctaagggtagaacgtaagttaaccgaaaggtacgtggtacgtacgtacgacctacgtctcgtcgttacc

SEQ ID NO: 179456 - DNA, 598 bp, Homo sapiens
  misc_feature: GYAE6OF01A12QU.13.87.H10.1.454.CMB.1.raw
  modified_base (338)..(338): a, c, t, g, unknown or other
  misc_feature (338)..(338): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttattagtctggtatcagacaaaacgaggaactcctaagctctgatctatgttgcatccatttgactaaaggtcgggtacccagtcgaaggttcagcggnaggtgatcgtaggacagtaattcactctacaacatcagcagtcctgcagcctagaagttattttacgacttaacttattacgtagtactaactacgttactttaaacgtaccgttaccccgtattaccggttaggtttacccggggaacgggtaaccgggtaaccgtaaagggtcgggtaaagtaaccgttaacgaaaaccggtacgttgggttacggtccgtaccgaccgtaaaccctcgtttcccgttggtttacccc

SEQ ID NO: 179457 - DNA, 628 bp, Homo sapiens
  misc_feature: GYAE6OF01AWC38.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttcggccggccagtcaggactattaacagttatttagtctaggtatcagaacaaaaaccgagggaaacgtcccctaagcctacctagactactatgttcgctatcctactttgactaaaggtcgggtacccatacgaaggttcagcggacaggtggactcgaggacagtaacttcactctacactaactcacgcacgcctagacgacgtcctagtaagttatttcgacttaaactttattactagtaaccaacgtagttaaccttaagttaccgttacccgtacttacgttacggtttaccgggacgggtaacgggtaccgtaaggggtacggtaaacgtaacgtaaccgaaacggttaacttacggggtacggtaccgtacggtaacccaacccgttacgttccgtcgtttaccc

SEQ ID NO: 179458 - DNA, 537 bp, Homo sapiens
  misc_feature: GYAE6OF01BJ3K2.13.87.H10.1.454.CMB.1.raw
  modified_base (529)..(529): a, c, t, g, unknown or other
  misc_feature (529)..(529): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagacaaaaaccagggaaatccctaagctcctgatctatgttgcatccctacttttgactaaaggttcggggtaccctagtcgaaggttcaggcggcaggtggatcgtggacagaattcactctcacatcagcagctgcagcctagatattttgacctaatttacttactcgtacaactagtacttaacgtaccgttacccgcttacgtaggttcggacgggtagggtaccagggtaggagtacgtacgaaacgtacgtggtaggctcgacaccntctgttcc

SEQ ID NO: 179459 - DNA, 667 bp, Homo sapiens
  misc_feature: GYAE6OF01COVNV.13.87.H10.1.454.CMB.1.raw
  modified_base (140)..(140): a, c, t, g, unknown or other
  misc_feature (140)..(140): n is a, c, g, or t
tcagtcacgtactacacgaccggtgctcgatttagcagtactgcgttgggtttgggggagtcagtcccagtcaggacacagcatggacatgagggtcccccgctcagctcctggggctcctgctgctctggctccaggtnccagatgtgacatccagttgacccagtcctccatccttcctgtctgcatctgtaggagacagagtcaccatcacttgccggcagtcaggacattagaaatgattagctggtatcagcagaaacgacgggaacgacccctaagctacgttgactctatggtatactagtaccgtaagtttaaaacggtgggtaccagtacgtaaggttcaggcggactagtcggtagtcgtaggctacaggtacttactacttcctacaacctatacagtaccgacgtccgtagacgtacggtccttagggtaaacgttttacgttttacggtaccttaaacttttactttaacgtagttaaccttaacgtaacgtaacttaactaaccgttaacgtttacgttaccggttacggggtaaccggtttaccgggaacccgtaaacggggtaccgtaaaggggttaacggtaaataaccggtaaaaccggtaacgttagggtacggtaccttacggacctaacccgtagttcgttaccgg

SEQ ID NO: 179460 - DNA, 646 bp, Homo sapiens
  misc_feature: GYAE6OF01DRHPQ.13.87.H10.1.454.CMB.1.raw
  modified_base (447)..(447): a, c, t, g, unknown or other
  misc_feature (447)..(447): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcgttggtacagcctggcaggtccctgagactctcctgtgcagcctcgtggtattccacctttgattgacttatcgccatcgcacgtcggggtccgacaacgcctaccgaaggggacggtccgtgggagtgggtctcgaggttagtttaggtaggtaatggtaggtagcgtaagtaggacttagtggcggtactcgtgtaggacgggtcctattacccacctntcctacagacgaacaaccgccaaagtaccctctgtactctagaactaaagtcgaaacctgtaccgtaggaacggtacgtccgtagggaacggtaaccggtcccgggttactttaggtttaaactttggttacggtaacgaaaaccgttaaaaccgtaccccttaacccccgttaaaaccccgttttagttttaaccggg

SEQ ID NO: 179461 - DNA, 575 bp, Homo sapiens
  misc_feature: GYAE6OF01BQD1U.13.87.H10.1.454.CMB.1.raw
  modified_base (428)..(428): a, c, t, g, unknown or other
  misc_feature (428)..(428): n is a, c, g, or t
  modified_base (561)..(561): a, c, t, g, unknown or other
  misc_feature (561)..(561): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccaggaaatccctaagcctcctgatctatgttgcatcctatttgactaaaggtcgggtacccagtcgtaaggttcaggcggacaggtggatcgtaggacagtacttcactctacaacaatcagcacgcctgcagcctagaatatttgactaacgtttatactntacaactacgtaactttaacgtaccgttacccgtcttacgtacggtttcgggacggtaacgggtaaccgtaagggttggaacgtaacgtaaccgaaaacggtacgttggtacggccttacggacctaaccgtnttccgttgttaccc

SEQ ID NO: 179462 - DNA, 648 bp, Homo sapiens
  misc_feature: GYAE6OF01ASFK9.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacacttattagcctggtatcagcagaagccagggagagtccctaaaattattgatctctgctgcgtccgccttgcaagtccgggggtcccagttctcggttcaggtggcgggtggatcgtaggacgagtaaacttcactctacaccgtactaccaccaaccttcgaccacccctgaaacgtatagttaggtaaagtttaatttacgtagtactaacggtaacccttaagttacggttacgggtcgggtaccccgtccgttacgttaacgtttttcccggggacgggtaacgggtaacccgtaaagggttccggaaccgtaaggtaacgttaacccgaaaaacggtaaccgttcgggttacccgggtacgttaccgggacctaaccccgttaacttccgtttcgtttaccccg

SEQ ID NO: 179463 - DNA, 626 bp, Homo sapiens
  misc_feature: GYAE6OF01BP9JM.13.87.H10.1.454.CMB.1.raw
  modified_base (307)..(307): a, c, t, g, unknown or other
  misc_feature (307)..(307): n is a, c, g, or t
tcagtcacgtactacacgaccggtgctcgatttagcagtactgcgttgggtttggggagtcagtcccagtcaggacacagcatggacatgagggtccccgctcagctccgtggggctcctgctgctctggctcccaggtgccagatgtgacatccagttcgacccagtcctccattccttcctgtctgcatcgtgtaggagacagacgtcacctatctacgttcggccgggcaggtcaggactattaacagtttattagtctggtatcaagaacaaaacgaggaactacctagctctgatctatgtnctatcctagtttagacgtaaggtcggtacctagtacgtaacggtcaggacgactaggtcgtatcggtaggactagacttaccactctacaactatcacgtccagtcgtagacctagtacctaggtaagtcgttttacgaacctttaatttacgttacgtacgtacctaaagtcgttaacttacgttaaccggttacccctaagttacggttaccgggttaccgggacgggtaacgggtaacgtaaacggggtaggtaacgtacgtaacgaaaccggtaggttcggtagacccgtcgacctacgtcttccgtcgttaccc

SEQ ID NO: 179464 - DNA, 773 bp, Homo sapiens
  misc_feature: GYAE6OF01DPE5U.13.87.H10.1.454.CMB.1.raw
  modified_base (286)..(286): a, c, t, g, unknown or other
  misc_feature (286)..(286): n is a, c, g, or t
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctgtgtattcctactttgatgtattancgacctagtcgacctacggttcggggtacccggacaacggtcccgtaccgggaagggggtaaccgggtccgtagggtacgggttcgggtacctacggtaagggtttagtttaggggttaggtaaagttagggttagggtacgtacgtaaaggttacggtacttaaggtcgggtaccggtaacttcggttagggtaacggggtaacggggtaccgttaacgttacccgtaacccgtacttacccgtacccgaaggaacggaaaccgaaacccgaacccgtaaacgtaaccccttacccgttacgttaaccgttccgtaacgaactaaacgtacgaaacgacgtaccgtagacggacgtcgtacggaacggaaccgtaccggttccgtttagttaacgtttagttaggtacgtaaacgtaaaacgtacctaaaccccgttaacccgtttaacgtttagtttttacgggtaggttacggtttaaaccggg

SEQ ID NO: 179465 - DNA, 640 bp, Homo sapiens
  misc_feature: GYAE6OF01EOSA1.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatcccttcctgtctgcatctgtaggagacagagtcaccatcacttcggccgggccagtcaggactaattaacagtttatttagtctggtatcaagaacaaaaaccgagggaaactccctaagcctacctgactctatgtgctactcctatttgactaaaggtcgggtacccagtacgaaggttcaggcggactaggtgatcggtaggactaagtaacttcactctacaacaactcagcacgtcctagacacgtcctaaggtaagttgttttacgacttaaactttattacgtacgtaaccaacgtaagttaactttaaacgttaccggttacccctacgttacgttacgggtttaccgggaccgggtaaacgggtaccgtaaaggggtaggtaacgtaacgtaaccggaaaacggtcgttcgggtacggtaccctacggaccctaaccgtacgtttccgtcggtttaccc

SEQ ID NO: 179466 - DNA, 576 bp, Homo sapiens
  misc_feature: GYAE6OF01AN5BL.13.87.H10.1.454.CMB.1.raw
tcagtcacgtactacacgaccggtgctcgatttagcagtactgcgttgggtttggggctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagcctctggattccaccttttgatgtattatgccatcgcacgtgggtccgcaagctccgagggacggcctggagtgggtctcgaggtattagtaggaataggtggtagcagtaggctagtcggcgtactcgtgtggacggccgtatcacctatcctcagacgaccaacgaccaacgtaacctcctagtactctagactaaatcgaacgacgctaggacgagcgtaggacggaccgtaccggtacgttgtatttagttggtacgtacgaaaacgtaccttaccccgtaaaccccgtttacggttagtttttgggtaacgg

SEQ ID NO: 179467 - DNA, 586 bp, Homo sapiens
  misc_feature: GYAE6OF01CLJPR.13.87.H10.1.454.CMB.1.raw
  modified_base (269)..(269): a, c, t, g, unknown or other
  misc_feature (269)..(269): n is a, c, g, or t
  modified_base (380)..(380): a, c, t, g, unknown or other
  misc_feature (380)..(380): n is a, c, g, or t
  modified_base (516)..(516): a, c, t, g, unknown or other
  misc_feature (516)..(516): n is a, c, g, or t
tcagtcacgtactacacgaccggtgctcgatttagcagtactgcgttgggtttgggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagactctcctgtgcagcctntgggttccaccgtcagtcacacctacatgagcgtcgggtcccgccaggcctccgaggggagggctgggagtgcgttcttcttttattatagtagtggtatacatactccgnagactccggtgacgggcctattccacctatcctaccagacgacaattccaagaacacgtcttacgtttactacaaattcgaactacgacctaggaagtcgacccgtatacggacgaccggtcgttagtacttacgnggtcgacggaggacggacgtccgggggacccctaaacgggtaaccgtttacaccggtcttaggtacgggg

SEQ ID NO: 179468 - DNA, 175 bp, Homo sapiens
  misc_feature: GYAE6OF01DPN04.13.87.H10.1.454.CMB.1.raw
  modified_base (173)..(175): a, c, t, g, unknown or other
  misc_feature (173)..(175): n is a, c, g, or t
tcagtcacgtactacacgaccggtgctcgatttagcagtactgcgttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 179469 - DNA, 840 bp, Homo sapiens
  misc_feature: GYAE6OF01AGJ8L.13.87.H10.1.454.CMB.1.raw
  modified_base (267)..(267): a, c, t, g, unknown or other
  misc_feature (267)..(267): n is a, c, g, or t
tcagtcacgtactacacgaccggtgctcgatttagcagtactgcgttgggtttggggctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgacgtctctcctgtgcagcctntggattcacctttgatgtattagtcgcctatcgctacgtcggggtcccgacaacggtcctaccggaaggggaacgggtcccgttaggggacggttcggggttccttacggtaacggggtttaagttttagggttaaggggtaaatttagggttggggtaacgtctaaggttacgggacttaagtcgggacggtaacgttcgttagggtacgggtaacggggtcccctaagtttaccgaacccttagttccctaccggaaggtaacgtaaccaaacgttccggaaaccccgtaaaggtaaccccctttcccgttaaggttaccttacccggtgaaacccgtaaaagtaccggaaaaccgtcggttaacccgtagggaacggaccggtacggtagggaaacccgggtaaacccggttaccccggggtttaccgtttttaggttaaacggttttaacccgttgggggttaaacccaaaaccggttaaaaaacccggtttccccttaaaaccccccccggtttaaaacccccggtttttttaacgggtttaaagggtttttttttaaacccgggggg

SEQ ID NO: 179470 - DNA, 636 bp, Homo sapiens
  misc_feature: GYAE6OF01CIFA5.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcaagacaaaaacgaggaaactcctaagctcctgtatctatgttgctatcctactttgactaaaggtcgggtaccaagtcgaaaggttcaggtcggacgaggtggagtcggaggacagtaactctactctacacaatcagcagcctgacgacgtactaagtacgttatttacaaccgtttaacttactttactcgtaaacctaacgtacgttaactttaaacgttaccggttaacccgttaccgttacggtttaacgggttccgggaacggggttaccgggtaacgtaaacggggttagggaacgtaaacgtaaccggtaaaaccggtacgttacgggtcggtaacctacggtaccaaccgttacgtccgttcgtttacccg

SEQ ID NO: 179471 - DNA, 532 bp, Homo sapiens
  misc_feature: GYAE6OF01B7GPR.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattacttgatctctgctcgcgtccgccttgcaagtcggggtccagtctcggttcgagtcggcggtggtatcgtaggacagtactcactcgtcacctatccaccaactcgccacctagaagacgtgtaggtaattattaactgtacacgtacctatacggtgacggtcctcgttcgtagtttcggacggtaggtaccgtaaggtgacgtagacttacgaaacggtactgtgactacgacacacgtctgttacc

SEQ ID NO: 179472 - DNA, 573 bp, Homo sapiens
  misc_feature: GYAE6OF01CJ3TC.13.87.H10.1.454.CMB.1.raw
  modified_base (194)..(195): a, c, t, g, unknown or other
  misc_feature (194)..(195): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (203)..(204): a, c, t, g, unknown or other
  misc_feature (203)..(204): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
tcagtcacgtactacacgaccggtgctcgattttagcagtactgcgttgggttttgggggggaagaggtaagactgaccggggtcccccaggagttcaggtgctgggcacagcggccctgggcctgtcctggtccaaggactacttcctagtacgtgacgtgacgcgggctcggacgaagggcgtacaataggnnatncanannagtagngcnatgacnagctcngaggcttnactgcncgngatcatacagacacgtntntntnananananatagagagngacgacgacgacgacatatactcgtgtgagagaggtagtggtggtcgtgtacgtgtactatacgtacgtacggacggacggtacggtacgtacgtcgtcgtcgtcgcgaccgtaccgaccgaccgaccgaccgtcgtccgtccgtcccgtccgtaccgtaccctacctaccgacgtaccgaccgtccgtcggtaccggacgcgacggccgccgtcgtcgtcgtacgtacgtacgtacgtacgtacgtacgtacgtacgtacgacgtcgcgcgtacgacgacgagcgngngn

SEQ ID NO: 179473 - DNA, 699 bp, Homo sapiens
  misc_feature: GYAE6OF01DK5AZ.13.87.H10.1.454.CMB.1.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttgccggcagtcaggacattaagattattagtntggtatcagacaaaacgaggaactcctaagctactgatctagtgtnctatcctactttagactaaaggtcgggtacccagtacgaacggttcaggcgcgaggtcggagtcgtggacagtaacttcactctacactaatcagcagtccctgtacacgtaccttagtaacgtacgtttttacgacttaacgtttactttacgtacggttaactaaacgtaacgttaaccgtttaaaccgttaacgttaccccgtaccgtttacggtttaaccggggttttaccgggggaccgggtaaacccgggggttaaaccgtaacggggggttaaccggtaaacggtaaacccggttaaaaccgggttaaaaaccggttaaaccccgggtttgggttaacccgggggtaccttaccggggaccccttaaacccgttggtttaaccccggtttcgtttaaccccg

SEQ ID NO: 179474 - DNA, 698 bp, Homo sapiens
  misc_feature: GYAE6OF01C4B1Y.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttcgacccagtcctccatccttcctgtctgcatctgtaggagacagacgtcaaccatccacgttcggccggcagtcaaggacattaacagtttatttagtctggtatcaagaacaaaaaccgagggaaactaccctaagcctacgtagacttctatgtcgactactcctactttacgacgtaaacggttcgggaccctaagtacgtaaacggttcgaacggcggtacgaggttacggtaacgtcggtacgggaactaggttaaaccttccgtaacttacctacaaactactaccgaagacctacgaccctaggacccgtaacggtaccgttaagtaagttacgtttttaaccgaacttaaacgttttaactttacgtacgttaaccttaaacgaattacttaacctaacttaacgttacgtaccggttagggtaccgttacggaaccgtaaaggggaccctaaagggtacgtaaaacgtaccgtaaaaggtaccgttggtaccgtacgtacggtaaccctaacgtacttccgtgtttacccg

SEQ ID NO: 179475 - DNA, 587 bp, Homo sapiens
  misc_feature: GYAE6OF01CIAG9.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtcctccatccttcctgtctgcatctgtaggagacagatcacatcacttgccggccagtcaggacattaacgagtttattagtctaggtatcaagacaaaaaccgaggaaactaccctaagctacctgatctatgttgcatctacttgactaaggtcgggtaccagtcaaggttcagcgcgagtgagtcgtaggacagtaatcactcacactatcagccaagcctagcacgtccagtacgtatttcgactaactttattactgtaactaacgtagtaactttaaacgtacgttacccgcttacgttagggttaccggacgggtaacgggtaaacgtacgggtaaggtaacggtaaactaacgaaacggtaacgttcggtacgaccgttcgaaccgtaccttacgttccgttcgtttaacccg

SEQ ID NO: 179476 - DNA, 604 bp, Homo sapiens
  misc_feature: GYAE6OF01ASO9K.13.87.H10.1.454.CMB.1.raw
  modified_base (280)..(280): a, c, t, g, unknown or other
  misc_feature (280)..(280): n is a, c, g, or t
  modified_base (440)..(440): a, c, t, g, unknown or other
  misc_feature (440)..(440): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttgccgggccagtcgagggacattagaaatgatttaggctggtatcagacaagaaaccgagggaaacncccctaagctctgatctagtggtgctagttaccgtaaggtttaaaacggtcgggtacctagtacgtaaggttcgaggcggacgaggtggattccgtggactacgagtacttcattcaccacctatacagacacgtccctaggctacgccgtagtaagttntttagacttaacctttatttacctgtactaacaacgtactactacttaattacgtcggtacgggtaccggttccggaccgtaaacgggaaccgtaagggttaacgaaacgtaaccgtaaacgtaaccggtggtacggtccgtagaccctacgtgttccgttacg

SEQ ID NO: 179477 - DNA, 621 bp, Homo sapiens
  misc_feature: GYAE6OF01EAOCQ.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttatttagtctggtatcaagacaaaaaccgagggaaactccctaagcctcctgattctattgttgactatccctatttgactaaaggtcggggtaccagtcaaggttcacgcggacaggtaggatcgtagggacagtaacttcactctacaacaatcagcagtcctgcagcctagaattattttcgactaactttacttactgtaacctaacagttaacctttaacgttaaccgttaccccgtatttacgtacgggtttaccgggaccgggtaacgggaaccggtaggggtacggtaaacgtaaccgttaacgaaaaccggttcgttacgggtacggtacccgtacgtacccgaaacccttacgttcccgttcgtttacccc

SEQ ID NO: 179478 - DNA, 710 bp, Homo sapiens
  misc_feature: GYAE6OF01CE3DK.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggactattaacagttatttagtctggtatcaagacaaaaaccgagggaaactccctaagctcctagattctattgttgactatcctacgtttgacgtaaagggtcggggtacccagttacgtaacggttacgaggtacggacgtacggtaggactcggtacgggaactaggtaactttccgtaacttacctaccaacgaacttaccgaagaccacgtcccgtagaccgacgtaccgttacggtaaacgtttacgttttacgaacctttaaacgtttacttacgttacgttaaccgtaactaaacgtacttacctaaactaagtttaaccgttcccggttacggggtaaccggtttacccgggaacccggtaaaccgggggtaacccgtaaaaggggttacggtaaaaacgttacccggaaaaacggttaccgtaggtacgggtcctaacggtaccctaaaccgttactttcgtacgtttaccc

SEQ ID NO: 179479 - DNA, 673 bp, Homo sapiens
  misc_feature: GYAE6OF01CHV71.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttcgacccagtctccatccttcctgtcctgcatctgtaggagacagagtcaccatcacttgccggcagtcaggacattaacagttatttagtctggtatcagacaaaaaccagggaaacgtcctaagcctcctgatctatgttgcatccactttgacaaagggtcgggtacccagtacaacggttcaggcggcaaggtcggatcgtaggaacagtaattcacgttctaccaactaatccaagtccaacggtcctaggacctacggtaccctagggtaacgttactttttcggaacctttaacgttttaactttacctacggttaaccaaacgtacgttaccgttttaaacgttaacccggtttacccgaccgtttaccgttagggttttacccggggaacggggtaacgggtaacccggtaaagggtacggtaacggtaacgaaccgggtaaaaaccggtacgttacggtacgggacttaccgggacctaaaccgtcgttaccgtcggtttaaccc

SEQ ID NO: 179480 - DNA, 678 bp, Homo sapiens
  misc_feature: GYAE6OF01DAYIZ.13.87.H10.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgacagatgtgccatccagatgacccagtctccatcctccctgtctgcatctgtaggagacagagtcaccatcacttgccgggcaagtcgaggcagttagaaatgtatttaggctggtatcgagacaagaaaccgaggaacnccctaagctnttgatctagtggtgctaagtacctaaaggtttaaaaggtcgggtacccagtacgtaaggttcaggcggacgtaggtgatcgtacggcaacgtagtacttctattcctacaaccgtatcgaacgcctaacgcctaggaccacggtccgttaaggtaaacgtttacgttttacaaccgtttaaactttacgtttaacctcggttaaacctaagaaacgtacttaacctaacgtttaaaacgtttaccgttaccgggtacggggttaacccgtttaccggggaaacccggtaaaccggggtaaaccgtaaagggttaaacggaaaacttaaaccggaaaaacccggtagttggtaccggtacctaccggaccctaaacgtcgtttaacccg

SEQ ID NO: 179481 - DNA, 586 bp, Homo sapiens
  misc_feature: GYAE6OF01B5RRC.13.87.H10.1.454.CMB.1.raw
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
  modified_base (487)..(487): a, c, t, g, unknown or other
  misc_feature (487)..(487): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcctacttcggccggccagtcaggactaagttaacagtttatttagtctggtatcaagacaaaaacgaggtaaacgtcctaagctcctagactctatgtgctactcctatttgaactaagggttcgggtacctaagtacgtaacggttcaggcgagagtggatcgtagganaacgtattcactctacaatactcacgcngtcctgaccacgtcagtaacgttntttacgaacttaacgtttattactgtaactaagtacgttacttaacgtacgttcccngttacgtcggtacgggaacggaggtaccggtaggaggtacgtaagtaaccgaacggttacgtggtaccgtctaccgactacctacgttctcgtttaccg

SEQ ID NO: 179482 - DNA, 821 bp, Homo sapiens
  misc_feature: GYAE6OF01CK4U8.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacagttatttagtctggtatcagacaaaaaccgagggaaacgtcctaagctcctgatctatgttgctatcctactttgactaaaggttcggggtacccctaagtaccgtaaagggtttcgaacggtcgggtaccgtaagggttacgggtaacgttccggtaggggtaaacctaacggttaaactttacctaaccttaccgttaccaaacctaacttaccgaacggtaccgaacggtacccttaggacccgtaacggtaacccgtttaaggtaaaacgttacgtttttttaacgggaacccgtttaaaacgtttttaacttttaaacccgttacggttaaacctaaaaccgttaacgtttaaccgttttaaaacgtttaacccggttttaacccccgtaccgtttacccggttaaccgggtttttaccggggaaccggggttaaccgggggtaaacccggttaaagggggttaccggggtaaaggtaaaccgttaaccggtaaaaaacccgggttaaccggttacgggttaccgggtaacgttaccggtacccgaaacccgttaacgtttcccgttaggttttaacccc

SEQ ID NO: 179483 - DNA, 741 bp, Homo sapiens
  misc_feature: GYAE6OF01CXB89.13.87.H10.1.454.CMB.1.raw
tcagtcacgtactacacgaccggtgctcgatttagcagtactgcgttgggtttgggggagtcagtcccagtcaggacacagcatggacatgagggtcccccgctcagctcctggggctcctgctgctctggctcccaggtgccagatgtgacatccagttcgacccagtcctccatccttcctgtctgcatctgtaggagacagagtcaccatcacttcgccggccagtcaggacattaacagttatttagtctggtatcaagacaaaaacgaggaaactccaagctcctagatctatgttcgactacgttcctacgtttagacgtaaacgggtcgggtaccccaagtacgtaaacggttcgaacggccggtagtaggttacggtacgttccgggtacggggaaacctacggtttaaactttaccgtaaccgtttcctaaccgtaaacctaaacgttaccaaccggtaccgtaacggtccccgtaggtacccgaacggttacccgttaagggtaaacgtttacgtttttaaccggaaccctttaaacgtttttaactttaacgtaccgtaaacctaaacgttaacgttaacctttaaacgtttacccgttacccgtcgttaacgttacgggttccggaacgggaacggtaaccgtaagggttacgacgtaaacgtaaccgtaaaacggtcgttcgggtaggtaccttacggaaccctaccgttgttacccgttggttaccc

SEQ ID NO: 179484 - DNA, 547 bp, Homo sapiens
  misc_feature: GYAE6OF01DQ9LZ.13.87.H10.1.454.CMB.1.raw
  modified_base (292)..(292): a, c, t, g, unknown or other
  misc_feature (292)..(292): n is a, c, g, or t
  modified_base (368)..(368): a, c, t, g, unknown or other
  misc_feature (368)..(368): n is a, c, g, or t
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccggcagtcagacataacagttattagctggtatcagacaaaaaccagggaaactcctaagctacctgatctatgttncatccactttgactaaaggtcgggtaccattcaaggttcagcgtacaggtggatcgtggacagtaatcaactctanacaatcagcagcctgacagctagaatagttttcgaactaactttattacgtgtaanaacgagtactttaaacttacggttacccnttactacgggtttcggaccgggtaaggtaaaccgagggtggaacgtataacgaaacgtacgtggtgacctaggaccctaagcttcgtgttaccc

SEQ ID NO: 179485 - DNA, 785 bp, Homo sapiens
  misc_feature: GYAE6OF01BFSHE.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttggccggccagtcaggacattaacagtttatttagtcttggtatcagacaaaaaccgagggaaactccctaagcctcctgactcttatgttgctactcctacttttgaacgtaaacgggttcggggtaccccagtaccgtaacggtttcaaggccggtacgtaaggttcggacgttaccgtaggggaacctaaggtaaacctttccgaacccttaccgtaaccaacgtaaacgttccgaaacggtccgtaacccggtaccgttacggacccgtaacggtacccgttaaggtaaacgtttaacgttttttacggaaaccgttttaaaccttttaacgtttaaccgtttacgttaacccgtaaaacgttacgttaaccgttttaaacgttaacccgggttttaaccccgccgttttaaccggttaaccggggttttaccggggaaccggggtaaaccggggtaacccgggtaaaggggttacgggaaacgtaacgttaaccggtaaaaccggtacggttcgggtaccggacgttaccggaacctaacccgttacgttaccgttccgtttaaccg

SEQ ID NO: 179486 - DNA, 817 bp, Homo sapiens
  misc_feature: GYAE6OF01AFY7X.13.87.H10.1.454.CMB.1.raw
  modified_base (199)..(199): a, c, t, g, unknown or other
  misc_feature (199)..(199): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccgaggtgccagatgtgacatccagttgacccagtcctccattccttcctgtctgcatctgtagganacagacgtcaccatctacgttcgccgggcagtccaggactattaactagttatttagtctaggtatcaagaacaaaaccgagggaaactcctaagtctcctgtatctatgttgctatcctactttgacgaaaggttcgggtaccctagtaccgtaaaggttcacggtcggacgaggttcggtaacgtcggttacgggaactaacggttaaactttaccgtaccttacgtacctaacctaacgttaccgaacgtaccgacggtccccttacggacccgtaacgtaacccgtttaaggtaaacgttttacgtttttacggaaacctttaaaacccgtttttaattaacccgtttacggttaaacccgtttaaacgtaaacggttaacttaaaccccttaaaacgttaaaaccttttaaccggttacccgggttaccgggggttaaacccggttttacccggggtaaaacccgggtaaaccgggggtaaaccccggtaaaaaggggttaccgggtaaaaaacgttaacccgggtaaaaaccggttacggtttaccggggaacggtacccgttacggtaaccccgtaacccgttaaccggtttaccgttccggttttaaccc

SEQ ID NO: 179487 - DNA, 724 bp, Homo sapiens
  misc_feature: GYAE6OF01EIG4P.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttcctttggctattttaaaggtgtccagtgtgaagtgcagctggtggagtcgtgggggagtcttggtacagcctggcaggtccctgagactctcctgtgcagcctctgattctacctttgatgtattagtgccagtcgctacggtcggggtcccgacaacggcctaacccgaaagggaacgggtccgtaggggacgttcggggtcctacggtaagggtttaatttagggttagggtaaagttagggttagggtagtacgtaagtagggtacttagttcgggtacggtaaccttcggttagggttaacgggaacggggtccccggtaacgtttcccgaaacccgtacgttacccgttacccgaacggtaaccgaaacccgaaacccggaacccgaaacggtaaacccctttccccgtaggttaacctccgtaacgaactaaacgtacggaaaccacgtacctaggaacgacggccgtaggaaccgggaaccgccgggttacctttaggttacttagttgtaacgtaacaaaacgtacttacccctaaacccgtttggttaacg

SEQ ID NO: 179488 - DNA, 533 bp, Homo sapiens
  misc_feature: GYAE6OF01ALB25.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaatccctaagctcctgatctatgttgcatccatttgactaaagtcgggtcccatcaaggttcagcggcagtgatcgtggacagaattcactctcacaatcagcagcctgcagtcctagaagtatttcgactaactttattactgtacaactagtacttaatacgttacccgcttacgtaggtttccggacggtagggacctaagggtcggaagtactaacgaaacggtagtggtggactcgacctaacctatcgtgttacc

SEQ ID NO: 179489 - DNA, 654 bp, Homo sapiens
  misc_feature: GYAE6OF01BRYT4.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagtcttggtacagcctggcaggtccctgagtactctcctgtcgcacgcctctggactttccaccttttgattgtattatcgcctatgctacggtcgggtccgacaacggcctaccggaaggggaacgggtccgtagggtacggttcgggtacctcggtaaggttagtttaggttaggaattaggtggtagctaagtaggcttagcggacggtactcgtaggtacggaacgggcctagttcccaacctactaccgtaccgacggaacgaaccgaaccgaaccaaacgaacctccaacttacgtaactcgtacgaccgtaagtacgtccgaaccgtacgtacccgtaggaacggtacggtacggaacggtacgtaccgggtattggttagttagtttacgttggtcggaacggtaggtaagtcgggtacgggg

SEQ ID NO: 179490 - DNA, 640 bp, Homo sapiens
  misc_feature: GYAE6OF01BNKOG.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctgtaggagacagagtcaccatcacttgccggcagtcaggactattaacagttattagtctggtatcagaacaaaaacgaggaaactacctaagcctcctgactctatgttcgctactcctagttcgacgtaaggtcgggtaccacgtacgaacggttcacggcgacgtaggtacgtagtcgtacgggaactaggtactctacgtctacgaactaatcacgtacgacgtcgtcgacgtaccgtacgtaggtaaacgtttcgtttaacgacctttaaactttacgtttactaacggtacctaaacgtacgttaactttaaacgttaccgttacccgtactttaccggtacgggtttaccgggaacgggtaacggtaaccgtaagggtacggagtaaccgtaacggaaacgtacgtcgtacggtacctcgacttaccgcgtacgttgttaccg

SEQ ID NO: 179491 - DNA, 724 bp, Homo sapiens
  misc_feature: GYAE6OF01B8E36.13.87.H10.1.454.CMB.1.raw
  modified_base (605)..(605): a, c, t, g, unknown or other
  misc_feature (605)..(605): n is a, c, g, or t
tcagtcacgtactacacgaccggtgctcgatttagcagtactgcgttgggtttggggagtcagtcccagtcaggacacagcatggacatgagggtccccgctcagctccgtggggctcctgctgctctggctcccaggtgccagatgtgacatccagttcgacccagtcctccatccttcctgtctgcatctgtaggagacagagtcaaccatcacttcggccgggccagtccgaggtacctaatttaaacgtagtttatttagtcgttaggtactcgaacgtaaaccaaaaaccgaagggtaaacgtaccctaaggtcctccgtagacttacgttagttcgttacgcctaacttcctaacgtttacgaacgtaaacgggttccggggtaccctaagttacgtaaacggttcaggaccggtacgtaaggttacggtacgtaccggtagggaactaacgtaaactttccctaaccttctaccaacgtacttaccgaacggcctaacgtcgacgtacacgttacctaggtaaccttagttttcgaacttaaccttagtttacgtacgtaactaacctagttaacgtttaacgttaccgttaacccgngtttaaccgttacggtttccggggacggtaacgggaaccgttaggggacgtaacggtaactaaccggaaaacgtgggtccgttagaccgtcgtacctaacctagtaccgttcgttaccg

SEQ ID NO: 179492 - DNA, 713 bp, Homo sapiens
  misc_feature: GYAE6OF01EEPQN.13.87.H10.1.454.CMB.1.raw
  modified_base (186)..(186): a, c, t, g, unknown or other
  misc_feature (186)..(186): n is a, c, g, or t
  modified_base (334)..(334): a, c, t, g, unknown or other
  misc_feature (334)..(334): n is a, c, g, or t
tcagtcacgtactacacgaccggtgctcgatttagcagtactgcgttgggtttggggagctctgggagaggagccccagccctgagattcccaggtagtttccattcagtgatcagcactgaacacagagactcaccatggagttgggactgagctggtattttcctttggcttattttaaaggtntccagtgtagaagtgcagctgggtggagtcgtgggggagtcgttggtacagcctggcacggtccctgagtaccttctccgtgtgccagtccttcgtggtactttcaccgttttgatgtattagtcgcctatgctacggtgggtccganaacgtctacggaagggtacggcttgggacgtcggtctacgaggttattagggtaggaatggttagggtacgctaagttaggcgttaagtcgaccggtactcgtggtacggaacgggtccgtaattcccaaccgtacgttccgtacccgaaggacgtaaacccgaacgtacccgaaacggtaaccccttcccgttagtaaccttcgtaacgaaccgtaagtaaccggaaacctacgtaccgtaggaaccgtacggttaccgaacgggaaaccggtacggaaccccggtttacgtttaacggttaaagtttacgttaaggtaaccgaaaacttaaaactacccggtttaaccccttaaaccccggtttagttttaaacggg

SEQ ID NO: 179493 - DNA, 518 bp, Homo sapiens
  misc_feature: GYAE6OF01DN9ZK.13.87.H10.1.454.CMB.1.raw
  modified_base (247)..(247): a, c, t, g, unknown or other
  misc_feature (247)..(247): n is a, c, g, or t
  modified_base (249)..(250): a, c, t, g, unknown or other
  misc_feature (249)..(250): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagtcacgtactacacgaccggtgctcgatttagcagtactgcgttgggtttgggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcagacattaacaatattaatgtatnannagaacagtaaacgaccctaagctctgatctacgatgcatccaatttaggaaacaggggtacccatacaaggttcagtaggaagtggatctaggacagtatttacttcacatnancagcctagcagactagaagatattgactaaactaatacttaatntacgagactagtattacgaattaatcgtaccctataccgaccttcggaccaacgggacacgacgtaggaagtaattaaaacgactagtagacttagacaactatcgtacg

SEQ ID NO: 179494 - DNA, 703 bp, Homo sapiens
  misc_feature: GYAE6OF01DW64Y.13.87.H10.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
  modified_base (494)..(494): a, c, t, g, unknown or other
  misc_feature (494)..(494): n is a, c, g, or t
  modified_base (528)..(528): a, c, t, g, unknown or other
  misc_feature (528)..(528): n is a, c, g, or t
tcagtcacgtactacacgaccggtgctcgatttagcagtactgcgttggggtttgggggagtcagtcccagtcaggacacagcatggacatgacgggtccccgctcagctccgtggggctcctgctgctctggcctccgaggtcgccgagagtgtagacatccgagttcgaccagtcctaccncttccttctgtctgctatcgtaggagagacagtacncacgatctacgtcggccggacagtacgaggaactacgttaacgtagtttatttagtacgttaggtactacgaacgaaaccgaaaaaccgaagggtaaacgttaccgtaaacgtctacgtatacgtagttagtcgtacgtctaactaccgttacttacgtaacggtaacgggttcggtaacctacgtacgtacggtacgacggaccgtacgtacggtagtacgtacggtacggaactaaggtacctctaactctaacaagtacacgacgcgtaccncgttacgactcgtacgaagttaagttaccgttanaaccttacttacgttaataccgtaacgtaactacgttaacgttaacgtaccttaaccggtacgttacgttaccgggtacggaacgggtaaccggtacggacgggtaacgtacggaaacgtaacgtaaacggtaccgtgtaccgacgtacgaaccgtacttacggtcttcggtacc

SEQ ID NO: 179495 - DNA, 667 bp, Homo sapiens
  misc_feature: GYAE6OF01BB6S3.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttcggccgggccagtcaggactattaacagttatttagtctggtatcaagacaaaaaccgagggaaactccctaagcctcctgtatctatgttgctactcctactttgacgtaaacggtcgggtacccagtacgtaaggttcaggcgacgtaggtggatcgtagggactagtacttcactctacactaatcagcacgcctagacctacgtaccttaggtaacgttagttttacgaacctttaaacgtttactttaacgttcgtaacccaaacgttacgttaacctttaaacgttacccgtttaccccgtacgtttaccggttaacgggtttaccgggaaccggggtaacgggtaaccgtaaaggggtaggtaacgtaacggttaacccgaaaacgggtcccgttagggtaccggacttaccggacccttaaccgttacgttccgttcgttacccg

SEQ ID NO: 179496 - DNA, 559 bp, Homo sapiens
  misc_feature: GYAE6OF01BDRQ8.13.87.H10.1.454.CMB.1.raw
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (465)..(465): a, c, t, g, unknown or other
  misc_feature (465)..(465): n is a, c, g, or t
  modified_base (545)..(545): a, c, t, g, unknown or other
  misc_feature (545)..(545): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttcgccgggccagtcaggacattaacagttatttagtctggtatcacgacaaaaaaccgngggaaaacgtccctaaagctcctgactctatntgcatcctactttgactaaaaggtcggggtacccatacgaaggttcacggcggcagtgatcgtggactagtattcactctcaacancancagccctgcacgccgtnaagttntttgactaacttagtactgtacaactgttaccttaatacgttacccgnttcgtaggttccggacggtacgggaaccgtaggtagggacgtaacgtacaaacggtactggtacgcgttacgacaacctntcgttcgttacccg

SEQ ID NO: 179497 - DNA, 863 bp, Homo sapiens
  misc_feature: GYAE6OF01BBRM7.13.87.H10.1.454.CMB.1.raw
  modified_base (270)..(270): a, c, t, g, unknown or other
  misc_feature (270)..(270): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacaggcctggcaggtccctgacgactctcctgtgcagcctntggattccacctttgatgattatgcctatgccacgttcggggtcccggacaacggcctacccggaagggggaacggggtcccgttagggggaacggttcggggtcctacggtaacggggtttatttaacggggtttagggaaagtttagggttcgggtaagaccgtaggtacgggtactaagttcgggaccgggtaacttcggttagggtacgggaacggggtccccgtaagtttcccgaaacccttattcccgtaacccgtaaggaaacccggtaacccgaaacccggtaccccgaaaacggttaacccccgtttaccccgttagttaaaccttccggtaaccggtaaacctaaaacggtcggtaaaacccttacgggttaacccgtagggaaacggtaccgggtaccgttaacggggaaccggggtaaccccgttaacccggggttccctttttaaaggggttaacctttttaaacgggtttaccgggttaaaccgggaaaaacccgttaaaaaaccggttaacccccggtttaaacccccccccgtttaaaaaccccccgggtttttaagggtttttttaaaacccgggg

SEQ ID NO: 179498 - DNA, 701 bp, Homo sapiens
  misc_feature: GYAE6OF01AGU0D.13.87.H10.1.454.CMB.1.raw
  modified_base (593)..(593): a, c, t, g, unknown or other
  misc_feature (593)..(593): n is a, c, g, or t
  modified_base (627)..(627): a, c, t, g, unknown or other
  misc_feature (627)..(627): n is a, c, g, or t
  modified_base (693)..(693): a, c, t, g, unknown or other
  misc_feature (693)..(693): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttccttttggacttattttaaaaggtgtccagtgtgaagtgcagcgtgggtggagtcggtgggggagcgttggtacaggccgtggctacggtccctggagtacctctccgtgtcgccagccctcgttggtacttctagttccttttgattgtaattagtcgtacctatcgaccgtacggttcggggtacccggtacaacggtcccgtaccgggaagggggtaaccgggtccggttaggggtaccggttcggggttaccttacgggtaagggtttagtttacgggttaggtaaacgttagggttaaggttaaacgtaggttacggtactaggtcggtaccgtacgttcgtaggtagggaaccggtccgtatacccgaactactcccgtacacgaacgacctaaccgaccgaaccgtaccttccgtagtacncgtacgaactaagtacgaactgtactggacgagngtacgacggtaaccgtcggttacttgtacttagtcgttaacgtacgaacgtttacgaagtttcggngtaccggg

SEQ ID NO: 179499 - DNA, 709 bp, Homo sapiens
  misc_feature: GYAE6OF01B8MB7.13.87.H10.1.454.CMB.1.raw
  modified_base (638)..(638): a, c, t, g, unknown or other
  misc_feature (638)..(638): n is a, c, g, or t
tcagtcacgtactacacgaccggtgctcgatttagcagtactgcgttgggtttgggggagtcagtcccagtcaggacacagcatggacatgagggtccccgctcagctccgtggggctcctgctgctctggctcccgaggtcgccagatgtgacatccagttcgaccctagtctccacttcccttcctgtctgcattctaggtagagacagacgtcacctatcctacgttcggaccggacctaggtcaaggtactaagttaactagtttatttagtcttggtatacgaagtaaccaaaaccgagggaaactaccctaagtcctaccgtagtactacttatgttacgactactacctactttagacgtaacgggtcggtaccctaagtacgtaaggtcgtagggccgtagaggtgtacgtacggtaggaactacgtacttacacgttacaactaacgtaactcgaacgtactacggtcctacggaccgtacgtaacgttaacggtaagtttctttaaccggaactttaaacgtttaacttacgtaactaaaccgtaccttaagtttaacctttaaaccggtacccgtttcccgtacgttacgtacgggttcgggaacggtaacgggaccgttaaagggngtaaaccgtacgtaaccggaaacgtcggtacggtacggtctaccgaacacctttagtccgttggttaaccc

SEQ ID NO: 179500 - DNA, 641 bp, Homo sapiens
  misc_feature: GYAE6OF01CD4Z0.13.87.H10.1.454.CMB.1.raw
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttcgacccagtcctccatcccttcctgtctgcatctgaggagacagagtcacatcactggccgggcagtcaggacattaacagtttatttagtntggtatcaagaacaaaaaccgagggaaactcctaagctcctagatctatgtntcatccactttgacgtaaaggtcggcctaagtacgtaaggttcgaggcggacgaggtcggacgtcgtaagggacaagtaacttcgactctacaactacacagacagtactcggacacggtacctagtaacgttatttacggaaccttaactttaactacgttacgtaactaaacgtacgttaactttaacggttaaccgttaccccgtaccgttacggttaacgggttacgggtaaccgggaacgggtaaccgtaacggggtacggaagtaacgtaaccgaaacggtaaccgttgggacgtaccgttacggacccaaccttactccgtttgtaacccg

SEQ ID NO: 179501 - DNA, 653 bp, Homo sapiens
  misc_feature: GYAE6OF01AGT5N.13.87.H10.1.454.CMB.1.raw
  modified_base (515)..(515): a, c, t, g, unknown or other
  misc_feature (515)..(515): n is a, c, g, or t
tcagtcacgtactacacgaccggtgctcgatttagcagtactgcgttgggtttggggaggtcagtcccagtcaggacacagcatggacatgacgggtccccgctcagtcctcctggggcctcctgctgctctggctcccgaggtcgccagatgtgacatccagttcgacccagtcctccattccttcctgtctgcattctggtaggacgacagagtccaccatcctacgttcggccgggccagtcaaggactaattaactagttttatttaacgtcgttaggtactacgaacgaaccaaaaaccgaggggtaaaactccccgtaaagccttacccgtgtacttactagttgttacgctacgttcctactttagacgtaacggtcgggtccagtacgaaggttcgagtcggcgaggtaggactcggtagggaactagtaacttcactcgtacaactacacagcacgtccagcagtacctagactttgttacacttacttacgttctagactaacgngttaaccttaacgttaccgttaccgtcgttacgttacgggttaccggacgggtaacggaaccgggttaggacggtaaacgtacggtaaaccgaaacggtcgtgtaacggtctaaccgactacgcttccgtgttacccg

SEQ ID NO: 179502 - DNA, 710 bp, Homo sapiens
  misc_feature: GYAE6OF01BQ6PA.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtccaccatccacgttggacccgggccagtcaggacctaattaacagttattagcctggtatcagacaagaacgccgaggggacgacgtaccctaaatttagttagtaatccttcgtacgtctcgtccgtcccgtccttcgacgtaacggttccggggtaccctacttcgtcggttacaggtcgggtcggtggacgttcgtaacggtactaacgtaacttacgaccttctacccgtaacctactaccaaccctaaccgtcgacccaaccgtagaaacgtagttacggttaggttaaacgtttagttacgttacgtacgtaacggtaaccttaagttaacggttcggttaccgggtccccgtacttaccggtttacggtttaccggggaccgggtaaccgggtaaccgtaagggtaccggacgtaacggtaaaccgttaacggaaaaccggtaccggttaggtacgtaccggtacgaccctaaccgttacgttccgttagtttaccccg

SEQ ID NO: 179503 - DNA, 842 bp, Homo sapiens
  misc_feature: GYAE6OF01DADWG.13.87.H10.1.454.CMB.1.raw
tcagtcacgtactacacgaccggtgctcgatttagcagtactgcgttgggtttggggagctctgggagaggagccccagccctgagacttcccaggtgtttccattcagtgatcatcactgacacagagactcaccatggagttggactgagtcgttggttttccttattacttaattttaaaagtgtccagtgtgaggtgctaggttggtggagttcgtgggaggtacggtcgttcgggtacccggtacggggtcccgggggggtccctaggacgtacctctcgtagttcggtcgccggtcctcggtcgggaccttcccgaaccgttaccaaacctaacccaaacctacgacgtagacgtccggtcgggtaccccgaccgtaacggccgtaccgaaggggaacggtacgggacccggtagggtcggttaccttacgttaagtttaagttttacgtacgggttacggtaccggtacgtaccccgtaaagtctttacccgaacgtaccgtacggtacccgtcccgggttagggacccggggttacccgtttaccaactacgttaccgtaccccgaaagtaaccgtaactaaacgttaacccgaacgtaaaccgttacgggtagttaacttacgtttaaacgaaagttaccgaaaccggtccgtaaggacgtacgggtaacgacggtacccggtaacggttccctaacgttttacggtacgttaacgcggtaaaccgaaagtacgtaccggacgaaacgggtaccggaccccggggtaaccccgttaagggtcgggtcccgtttagggtacgggttaccggttttcttacggtttgaacccggg

SEQ ID NO: 179504 - DNA, 831 bp, Homo sapiens
  misc_feature: GYAE6OF01CV7EZ.13.87.H10.1.454.CMB.1.raw
tcagtcacgtactacacgaccggtgctcgatttagcagtactgcgttgggtttggggctgggagaggagccccagccctgagattcccaggtgtttccattcagtgatcagcactgaacacagaggactcaccatggagttggactgagctggtattttccttttggcttaattttaaaaggtgccctagtgtgaggtgcagcgtgggtggagtcgtgggaggaggcttgactccgacggtcccggttcggggggtcccctggacgtaccttccgttccgttggtcgccgtacgtcccgtcggttcgggttcctacccggtctacgtaccaacctaacctaacagttacggacggtccggttaccgggtcccggaccgaccggggtaccgtacccgggaaggggggtaacggggtccggtaggggtacggttcggtaccggtttacgttttaccgtttttaagttttaagttaaggttaggttaacggttaacgtacgtacgtacctccggacgtaacgcccgttccggtacggaccgggtcctaacgttccgaactacgttcctaccgaaggtaacgtaaccgttaacttaacccggaaaactaccgtaccgttaccgttttgtttaaccctaacgtaaagtccgaaactcgtacgttaggaacgtacgtaccgtaagtcgtaaccggtaccggtccgtttaacgtacgtttacggcggttacggacggaacgggttacgggaaaccgggtacccggggtacccttaaaacccgggtttaacgttaaccacgggttactaaccggggtacggttcccgggtaaccggggg

SEQ ID NO: 179505 - DNA, 646 bp, Homo sapiens
  misc_feature: GYAE6OF01A7R4E.13.87.H10.1.454.CMB.1.raw
  modified_base (200)..(200): a, c, t, g, unknown or other
  misc_feature (200)..(200): n is a, c, g, or t
tcagtcacgtactacacgaccggtgctcgatttagcagtactgcgttgggtttggggagtcagtcccagtcaggacacagcatggacatgagggtccccgctcagctcctggggctcctgcctggctctggctcccaggtgccagatgtgacatccagttgacccagtctccatccttcctgtctgcatcctggtagganacagagtcacatcacttggccggccagtcaaggtacattaactagtttattagtcgtggtatcaagtacaaaacgagggaaactcctaagctactgatctatagttgcatcctacgttgacgtaaacggtcggggtacccagtactaaggttccgaggccggcgtaaggtggacgttacgtgggaactaaggtaattcctaacgtcctaacctaactaacgtcctaacgccgaagtcccgtgtaccgagtccgtaaggtaacgttacttttacggaccttaaaccgtttacttaacgttacgtacctaaagacgttacttaacgttaccgttaccccgtacttccgttacggttaccggacggtaacgggacctaagggtacgtaagaacgttaaccaaacggtctaggttaccgcgttaccacgttaccacttccgtcgttaccc

SEQ ID NO: 179506 - DNA, 776 bp, Homo sapiens
  misc_feature: GYAE6OF01AJ20Q.13.87.H10.1.454.CMB.1.raw
  modified_base (626)..(626): a, c, t, g, unknown or other
  misc_feature (626)..(626): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccagataccagatgtgacatccagatgacccagtctccatccctccctgtctgcatctcgttggagacaggtagtccaccgtcacgttcggccgggcgagtccgaaccgactaatttaaacctactttaatttacgcccttaggtatcagcgaagaacgccgagggaagacgttaccctaaaatttatgtaactctctcgtctcggtccgtccgtccgttcgacgtaacgttccgggggtccctaacgttccgttcgggttacccgtagggttcggggaccgggttagggtacgtacccggttaagggtaaaccgtaaggttaaactttcccgtaacttcccgttacccaaacccgtacttacccaacccctaacccgtaccggaaccctaccccgttaaggaaacggttacgttacgggtttaagggtaaactttacgtttactacggttaccaacgtaaccttaggtaacggttcgggtacggtaccccgtnttaccgttacggttttcccgggacgggtaccgggtaaccgaacgggttagaccggtaaggtaacttaaccggaaaaccggttacgtaacgggttacggtacccgttacgggtaacccttaacgtaaccgggtttcctcggtttaaccccg

SEQ ID NO: 179507 - DNA, 773 bp, Homo sapiens
  misc_feature: GYAE6OF01CA7L7.13.87.H10.1.454.CMB.1.raw
tcagtcacgtactacacgaccggtgctcgatttagcagtactgcgttgggtttggggctgggagaggagccccagccctgagattcccaggtgtttccattcagtgatcagcactgaacacagaggactcaccatggagttggactgagctggtatttttcctttggacttaagttttaaaaggtgtccagtgtgaagtgcagcgtggtggagtcggtgggggagtcgttggacaggccgtaggcacggtccctgacgtacctcctccgtgtcgcacgtcccgtcgtaggtactttaccgtaccgttttgacttagtatttacgcgtaccagtcgaccgtacggtcgggtaccggacgtacggtccgtaccgggaggggtaacggtccgtagggtacggtcgggtactacggtaaggtttagtttaaggttacggtaagttacggtaggtacgtcgtaagtacggtacgtagtcggtaccggtacgtcggttacggtagggacggtaccgttactacccgtaacctacgttacccgtacgtaacggtaacgaccgtaggtaccggtaacccggaacgttaacccgtacccgtaactaccgtagtaccgtaacttaaacgtaccgtaaacggtacgttaccgggtaacggtaccggtaacggtacgggtaacccgtaccgggttaccgtttaggttaccgtttggacgggtttacgacgggtttacgtacggtcgtacgggttcggttaacggtttcggtaaccgttaaccggg

SEQ ID NO: 179508 - DNA, 971 bp, Homo sapiens
  misc_feature: GYAE6OF01A7FRV.13.87.H10.1.454.CMB.1.raw
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
tcagtcacgtactacacgaccggtgctcgatttagcagtactgcgttgggtttggggggagaggagccccagccctgagattcccaggtgtttccattcagtgatcagcactgaacacagaggactcaccatggagttgggactgagctggtattttccttttggcttagttttaaaggtgtccagtgtgaagtgcagctggnggagtcgtgggggagtcgttggtacagtccgtggaccgacggttaccccgtggacgtaccttccgttccgtcggttacggccncggtacccttccgttagggtaacttttccgtaacccgttttggaacttacggtaatttaacgttcggacccttaagttcggaccgtaaccggtttcgggggaccccggtaccaaacggtcccgttaccggaacgggggaacgggtccgtaggggtaagggtttccgggtactaccgtaagggtttagtttaacggggttaaggtaaagtttacgggtaggggtaacgtacgaggttaaacgggtcgttaacgttcggggaccggttacttacggtacggttaacgggtaacggggtacccgtacgtttacccgaccgttaagttacccgttaccgaaacgggaaccggaaacccgtaaaacccggacccgtaaaaaccgggttaaccccctttaacccggtttaacgttaacccgtttaaccgttaacgggaaacccttaaaacggtaaccgggtaaaacccgtaacgggttaacccccgaaggggttaaaaccggacccgggttaacgttaccgggggaaaccggtacccgtaaacccgggtttccgtttaaaacgggtttttaacgtttaacggtttcgggtaaagggtccccggggtaacgggttaaggtacccggggtaacccggggttaacccgaaaccggggtttttaaacccggtaaacggttcccgggttaaacggg

SEQ ID NO: 179509 - DNA, 644 bp, Homo sapiens
  misc_feature: GYAE6OF01BWGTD.13.87.H10.1.454.CMB.1.raw
  modified_base (606)..(606): a, c, t, g, unknown or other
  misc_feature (606)..(606): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
  modified_base (639)..(639): a, c, t, g, unknown or other
  misc_feature (639)..(639): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggcctcccaggtgccagatgtgacatccagttcgacccagtctccatcccttcctgtctgctatctggtaggagacagacgtcacctactcacgttcggacccgggccagtccaaggactaagttaacgtagttttaatttagtcgttaggtacttacaacgaaccaaaaaccgacgggtaaaacctacccgtaaagtcctaccgttgtattcttagttgttacgactacttcctactttgaaccgtaagggttccgggtaccctaagtacgtaacgggttacgacggccggtacgtaggtacggtacgtacggttacggaactaacgtaacgttcctaacctaccgtacctaacgtaacctccgtacgaccgacgtcccgtagaccgacgtacctaagtaacgttctttacgaccttaacttatctacgtacaatgttaactacgtaccgtactgtcgtaggtccggaggacggacgngtagacagtacaacgtntggcngtacncatctntgtac

SEQ ID NO: 179510 - DNA, 637 bp, Homo sapiens
  misc_feature: GYAE6OF01AJC80.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctggtaggagacagacgtccaaccatccacgtcggccggcagtcaggactattaactagttattagtcttggtatcaagaacaaaaccgaggtaaacgtacctaacgctactgtatctatcgttgactactcctacgttacgacgaaacggttcggtacctagtaccgtaacggttacaggcggtagaggtagtacgtcggtaggaactacggtaacttcgactcacaactaatcgacgcgacgcctacgacacgtcgtaagtacgtttcgttacgtacctaatttacgtacgtactaaccgaacttagtaactttaacgtaccgttacccgacgttccggtaacgggttccggaacgggtaaccggtacggtaacgggtagtaacgtaacgtaaccggaaacgttacggtgtacgtacgtacgaccctatacgttccgttcgttacccg

SEQ ID NO: 179511 - DNA, 669 bp, Homo sapiens
  misc_feature: GYAE6OF01ER5D4.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttcctttggcttatttttaaaaggtgtccagtgtgaagtgcagctggtggagtcgtgggggagcgttggtacgagccgtggcaggtccctgagctctcctgtgcagcctctggtacttctacctttagtagcttattgggatggacggcgttcggggtccgccgagggcctacggaaggggtacggggctgggaggtcgggtggacccaaagaagtaaagcgtaaaggttggaagtgaaagtaaactactagtggtagacttcgtagggtaggacgggtacctagttaccactactccctaccgaacggtaacgaaccgaaccgaccgaaaacgtaacctaccgtaactacggttacttacgtacgaactaaacgtacgaaacgtaccgtaccgtaggaacggtacggacccggaaggacccgacgggtaccttacggtaccgttaagttacgttggacggacggaagggtagtacgggttagggggacggttaaaggtagtacgg

SEQ ID NO: 179512 - DNA, 1040 bp, Homo sapiens
  misc_feature: GYAE6OF01A2XSK.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctccgtggggcctcctgctgctctggcctccaggtcgccagatgtgactatcctagttcgaccctagtctccacttcccttcctgtctgctattctaggtaggacgacagacgtaccaacctatacctacgttccggcccgggaccacgtcgacggtaacttaattaaacgttagttttaatttacggtccgttaggttactacgaacgtaaaacccgaaaaaccggtacgggtaaaaccgttcccctaaaggtcccttaccggtagtacgttcgttaagtggttacaccgtaaccgttcccgttaagtttaccggaacggttaaacgggtccgggttaaccctaggttaaccgttaacgggttccgaacggggtccggtaacggtacgggttaacggtaacgtttaccggggtaacggggtaaacttaaaccgggtttaaaccgtttacccctaaaccggtttacctaacccggttaaaactaaccgggtacccgtaaaacggtccccggaaccgtttaccccgggttaaccgaaccgggttaaacccggttacccgggttaaaagggttttaaccggttttttaaccgggtttaacgttaaaaccccccttttttaaaagggtttttacccctttaaccgggttttaaacccggtaaaacctttaaaccccggtttaacggtttaaaaacccgttttttaaccgggttaaacccccggtttaaccccgggtttaaccgttttacccggggggtttaaaccggggtttacccgggggaaaaccggggggttaaacccgggttaaacgggtaaaccggggggttaacggtaaaaccggttaaaccgttaaaccgggtaaaccgggtttaccgttcggggtaacgtaccccgttaacgtaacccctaggtttaccttcgtttaaccgttaacccg

SEQ ID NO: 179513 - DNA, 789 bp, Homo sapiens
  misc_feature: GYAE6OF01A7RV2.13.87.H10.1.454.CMB.1.raw
  modified_base (239)..(239): a, c, t, g, unknown or other
  misc_feature (239)..(239): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttaattttaaaaggtgtccagttgtgaagtgcagtctggtggagtcgtgggggagtcgttggtacngcctggccgacggtccctgacgtaccgtctccgtgtcgactagtcctcgtggtactttcctaccgttttgattgtaacttgtcggacctagttcgccgtacggttcggggtacccgacgaacgtccgtaccggaagggggaaccggtccgtacgggtgggtcggtcgtacggttagggttaagtttagggttaggaatttagggtagggtacgtacgttaaggtacggtacgttaaggtcgggtaccggtaccttacggttacgggtacggggtaaccgggtcccgttaacttaccccggtaaccctaccgttcccgtaacccggaaagggtacccgaaaacccggtaaacccggaccccgtaaaccggtaccctttaccccggtaggttaactaccgttacgaaacccgtaaaagttccgaaacggtcgacccgttagacggtaccgtggtaaccggacggtaccgtaccggttcgtttaagttacgtttagtcggtaactaacccgtaaactacctttaaccccgttaaaccccgtttggtttaacgg

SEQ ID NO: 179514 - DNA, 752 bp, Homo sapiens
  misc_feature: GYAE6OF01BAB4L.13.87.H10.1.454.CMB.1.raw
tcagtcacgtactacacgaccggtgctcgatttagcagtactgcgttgggtttggggctgggagaggagcccccagccctgagattcccaggtgtttccattcagtgatcagcactgaacacagaggactcaccatggagttgggactgagctggtattttcctttggcttaattttaaaggtgtccagtgtgaagtgcagctggtggagtcgtgggggaggcttaggtacacgcctggcgacgtcctgacgtactcgtctgtcgctacgtcctcgtggtacttcctaccgttttagattacgtaattagtcgtacctagtcggacccgtacggttcggggtacccgacgtaacggtcccgttaccgggaagggggtaaccgggtcccgttagggtacgggtttcgggttccgttacggtaggtttaacgtttaagggtaggtaaaggttaggttagggtacacgtaagtacggtctagtcggtacgtcgttacgtagggtacggacgggtacctacgtaccgtaaccgtactacccgtacgaaacggaacgtaaaccccgaacccggtaacccgaaacgttaacccgtttcccgtagttaaccttcggaactaacgtaaacgtacgaaacgacgtcgtaagtacgacgtacgtaggaaccggacgtaccggttacgtttagttattaggttcgaaacctaacgaaacgtacccgttaaccctacccggtttaggttagttttagggtaacg

SEQ ID NO: 179515 - DNA, 716 bp, Homo sapiens
  misc_feature: GYAE6OF01APMCQ.13.87.H10.1.454.CMB.1.raw
  modified_base (270)..(270): a, c, t, g, unknown or other
  misc_feature (270)..(270): n is a, c, g, or t
tcagtcacgtactacacgaccggtgctcgatttagcagtactgcgttgggtttggggagtcagacccactcaggacacagcatggacatgagggtccccgctcagctcctggggctcctgctgctctggctcccaggtgccagatgtgccatccagatgacccagtctccactcctccctgtctgctatctggtaggagacagacgtcaccatctacgttcggccggcaagtcgaggactattaagaatgtagttggctggtatacaganaacggaaaccgagggaaaccgaccccgtaagctacgttcgatctaacgtggtacgactacgtacccgtaaaggtttaaaacggtccggggtacctaacgttacgtaacggttcgacggtcggacgtagggtagtacgtcgtacggaccaacgtacgtaccttactacgttcctaacacctatcgtacgccgtacgtcccgacgtaccgaccggtcgtaacgttaacgttactttaccggaacctttaaaccgttttacgttaccgtttacgtaaccgttaaaccgtaacgttaactaccttaaactaacttttaacccggtcgttaaccgggttacccggtacgggtaaccgtaaaccggggtaaaccgttaaagggaacgttaaacggaaccctaaaaccggtgttacggaacgtccgtaacgtaaccgacccgtagtttacccg

SEQ ID NO: 179516 - DNA, 641 bp, Homo sapiens
  misc_feature: GYAE6OF01B7EDI.13.87.H10.1.454.CMB.1.raw
  modified_base (105)..(105): a, c, t, g, unknown or other
  misc_feature (105)..(105): n is a, c, g, or t
  modified_base (148)..(148): a, c, t, g, unknown or other
  misc_feature (148)..(148): n is a, c, g, or t
  modified_base (153)..(153): a, c, t, g, unknown or other
  misc_feature (153)..(153): n is a, c, g, or t
  modified_base (162)..(162): a, c, t, g, unknown or other
  misc_feature (162)..(162): n is a, c, g, or t
  modified_base (239)..(239): a, c, t, g, unknown or other
  misc_feature (239)..(239): n is a, c, g, or t
  modified_base (439)..(439): a, c, t, g, unknown or other
  misc_feature (439)..(439): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
  modified_base (509)..(509): a, c, t, g, unknown or other
  misc_feature (509)..(509): n is a, c, g, or t
  modified_base (529)..(529): a, c, t, g, unknown or other
  misc_feature (529)..(529): n is a, c, g, or t
  modified_base (584)..(584): a, c, t, g, unknown or other
  misc_feature (584)..(584): n is a, c, g, or t
  modified_base (609)..(609): a, c, t, g, unknown or other
  misc_feature (609)..(609): n is a, c, g, or t
  modified_base (625)..(625): a, c, t, g, unknown or other
  misc_feature (625)..(625): n is a, c, g, or t
tcagtcacgtactacacgaccggtgctcgatttagcagtactgcgttgggtttggggagtcagtcccagtcaggacacagcatggacatgacgggtccccgctcngcctccgtggggcctccgtgctgctcgtggcctcccgaggtcncagtntgtgacctntccgagactcgacccagtcctccctactccctcccgtgtctcactgtcgtaggtaggacgacagtacgtccaacctntcgtacggtccggaccgggtacacggtacgacgggtataagtaaggtaattcggtagttaagggtctaggttatccgaacggaagtacgacggaacggtagggtacgtaacgttaaccttaattcgtgtacgtccctgtcgtccgttcgccgttaccgccgttagaccgtaccgggtcggtctcgtacggttcgtacggnggtcggtcgtagtcgtactaggactattaacgctacgcactacncgtaccnctaccctgaaccctcgtanagttacgttgtaacggtttntacgtactgtacaacgtcgtgttacgcgtccgtccttaagtcgtcgttaaccggnggaccgtagggatcgaactgtaacnttacggagtttgaacnctagcttacggcttcg

SEQ ID NO: 179517 - DNA, 660 bp, Homo sapiens
  misc_feature: GYAE6OF01EPEY1.13.87.H10.1.454.CMB.1.raw
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (597)..(597): a, c, t, g, unknown or other
  misc_feature (597)..(597): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgactatccagttcgacccagtctccatccttcctgtctgcatctgtagagactagagtcacatctattcggccggtccagtcaggtactaattactagttattagtctggttatcaagaacaaaacagggtaaactcctaagtctacctagtntctagttcgttnctactcctactttagaccgtaaaggttccggggtacctaacgttacgtaacggttacgaacggtcggtacgtacgtagggtctacggtagggaactacgtaagttaccaccgttactactaaccgttagtacccgaagtcccaaggtccgttaccgacgtaaccgtccgtaacgtaagtttaaccgtttctaaccgttaactttaactttacgtactacgaactagttaacctaagttaaccgtacctcgttcgtacgttacgggacggtacggactaaacgggngtacgacgttaacgaacgtaaggtcggtaacgccgtatacccgaagtcgttcctcggttaccc

SEQ ID NO: 179518 - DNA, 801 bp, Homo sapiens
  misc_feature: GYAE6OF01C0BIJ.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtatttttccttttggcttattttaaaaggtgtccagtgtgaagtgcagcgtggtggagtcgtgggggagcttggtacagcctggcaggtccctggagactctcctgtgcagcctctggattcacctttgatgtattatcgcctaatgcctacggtggggtcccgacaagccgtaccggaaggggaacggtcccgtaggggtacgtgggttcctacggtaagggttaagtttagggttagggtaaagttacggttagggtagaccgtaaggtttaacggccgttaaagttcgggacccggttacgtccggttagggtacgggtaaccggggttcccgtaacgttaccctaaccgtaaccttacccgtacccgaacggtaaccgaaaccgtaaacccgacccgtaaaccggttaacccgtaccccgttacggttactacccgtaaggaaacccttaaagttaccgaaacgttaccgtaacccggtagaaccgggtacgtaccggtacgggaaccggtacccggtaaacccgggttacccttttaaggtttaaaccgttttaggtttaacggtaacgtaaaccggtaaaaaccttacccggttaaaccccccgtttaaaccccggtttaacgggtttttaaacggg

SEQ ID NO: 179519 - DNA, 767 bp, Homo sapiens
  misc_feature: GYAE6OF01CDOFW.13.87.H10.1.454.CMB.1.raw
  modified_base (553)..(553): a, c, t, g, unknown or other
  misc_feature (553)..(553): n is a, c, g, or t
  modified_base (747)..(747): a, c, t, g, unknown or other
  misc_feature (747)..(747): n is a, c, g, or t
tcagtcacgtactacacgaccggtgctcgatttagcagtactgcgttggggtttggggagtcagtcccagtcaggacacagcatggacatgacgggtccccgctcagctccgtggggctcctgctgctctcggcctccgagggtcaccgagtatggtacgactactcccgtagttaccgaccctacgtcctacctacttcccttccgtgtcctcgacctacttcgtaggtacggaacgaccgtagaccgtaccactactcctacgttcggccggcaagtacgacgtaactagttaacttagtttattacgtacgtacgtactacgtaaccgaaaaccggtaaaaccggtaagggtaaaccttaaccgtactaccgttaccgtagttactaacgttagtttacgtccgtacctacgttaccgttacgttacgaacggtaaccgggttcggtaacctacggtacgttaccggtagaccggtacgtcggtaaggtcgtaggtcggaacgtacgtatactccttacaccgactacgtacagtaccgctactaccgtnaccgtaccgtacgtacgtaagttcgttaacacgtaatttactacgttctacgacgtaacgtcgtagtaacgtacttaccgtacctccgttaccgaaccttccgggaacgttacccggaaccggtaaccggtaccgttaacggtaacggtaccggttaaacggtttaaacctaacggttaccgtacggtaaccgnggttaaccccgcttaaccgg

SEQ ID NO: 179520 - DNA, 756 bp, Homo sapiens
  misc_feature: GYAE6OF01AL6MO.13.87.H10.1.454.CMB.1.raw
  modified_base (561)..(561): a, c, t, g, unknown or other
  misc_feature (561)..(561): n is a, c, g, or t
  modified_base (659)..(659): a, c, t, g, unknown or other
  misc_feature (659)..(659): n is a, c, g, or t
tcagtcacgtactacacgaccggtgctcgatttagcagtactgcgttgggtttggggagctctgggagaggaggggccccagccctgagattcccaggttgtttacattcagtgatcagcactgaacacagaggactcacatggagttgggactgagctggtatttttccgtttggacttaattttaaaaggtgtcctagtgtgaagtgcagcgtggtggagtggtgggggagtcgttaggtacagtccgtggacgtacggtcccgtgacgtactccttccgtgtcgcacgtccttcgtcggttaccaccggtcacgtccaccaacctacagttcgacggtccgtcggggtcccaccggtacggccgtaccgggaagggggaacggggtcgtagggacggttcgtcgttactttacgttttaagttaagtaggttagtggtaactactactaccgtccgacgtaacgtccgtccggtacgggaccgggtacctatcccctaactacgttcctaccgaaggtaactaacctaacttaacgaaacgtacctacgttacgtttntttaccgtaaactaagtacgtaaccgtcggtacctaggaacggaccgttccgaaagtccgaaccgtacccggttcgtttaacgtaacgtttaccgggngtaacggtacgggaaagtacccggggtaacccggttaaccccgggtaaacccgttaaacggttaacccgttactaacccggtaggtaccggtacggg

SEQ ID NO: 179521 - DNA, 901 bp, Homo sapiens
  misc_feature: GYAE6OF01D0BST.13.87.H10.1.454.CMB.1.raw
tcagtcacgtactacacgaccggtgctcgatttagcagtactgcgttgggtttggggagctctgggagaggacgccccagccctgagattcccaggtgtttccattcagtgatcagcactgaacacagaggactcaccagtggagttgggactgagtctggtatttttcctttggtacttaagtttttaaaaggtgtccgtaaggttgtaggaagtcgacgtagtcgtgggtggacggtcggtggggggaagtcttgggtacaggtcccgttagggccgtacggtccctaggacgtaccttcctccgtgtcgcacgtcctgtggtactttcgaccttttgacttgtacttacgtcgcctagtcgaccgtacggtcgggtaccgacgaacggtccgtaacgggaaggggtacgggtccgtagggtacggttcgggttactagggtaaggtttaacgtttaagggttaggtaaagtttagggttacgggtaaccgtcgttaaacgggtacgggtacttaacgggtaccgggtaccgggttaaccgttccgggttaacgggtaccggggtaaacggggtacccgttaaaccgtttacccgtaacccgtaacgtttacccgttacccggaaggtaacccggtaacccgtaaacccgggtaaccctaaaccggttaccctttaacccgttaggttaaccgtaccgttaacgaaaccgtaaacgtaccgggtaaaccgtaccggtaacccgtagggaaccggtacggttaccggtaaacgggtaccgggtaaccgttaccgggttaccgtttaaggtttaacgtttaacgggttacgtaaacgtaaacccgttaaaacgttaccccgtttaaaccccggttaaaccgttttacgggttttaaacggg

SEQ ID NO: 179522 - DNA, 911 bp, Homo sapiens
  misc_feature: GYAE6OF01D06GJ.13.87.H10.1.454.CMB.1.raw
tcagtcacgtactacacgaccggtgctcgattttagcagtactgcgttgggtttgggggggagaggagccccagccctgagattcccaggtgtttccattcagtgatcagcactgaacacagaggactcaccatggagttgggactgagctggtatttttccttttggcttaattttaaaaggtgtccagttgtgaagtgacagcgtggtggagtcggtgggggagtcgttaggtacagccgtggccgaggttccctggacgtaccttcctccgttgtcgcctacgtcctcgtggtactttcctaccttttgacttgtattatcgcctagtcgacgtaccggttcggggtcccgacgaacggtccgtaaccgggaaggggaaccgggtccgtaggggtaacggttcgggtaccttacggtaacgggtttagtttaacggttagggtaaagttagggtacggttaacgacgtaaggttacggtacttaaggtcgggaccgggttaccgttcggttagggttaacgggtaaccggggtacccgttaacgttttacccgaaccgttaaccgtttacccgtaaccccggtaaacgggtaaacccgtaaaacccggaaaccccggtacccgtaaaacccggttaacccctttacccccggttaggtttaaacctacccggtaacgtaacctaaacgtaacgaaacccgtcggtaacccgttaggaacggtacgtaccggtaacggaccgggtaaacccgtaccgggtttacctttaggtttaacgttttaacggttaggttaaccggtaaaccgtaaaaaccgttacccctttaaaccccccggtttaaaccccgttttaacggttttaaagggttttttaccgggtaacgggttttaacgggtttaaaacccggg

SEQ ID NO: 179523 - DNA, 1027 bp, Homo sapiens
  misc_feature: GYAE6OF01EQ922.13.87.H10.1.454.CMB.1.raw
  modified_base (164)..(164): a, c, t, g, unknown or other
  misc_feature (164)..(164): n is a, c, g, or t
  modified_base (507)..(507): a, c, t, g, unknown or other
  misc_feature (507)..(507): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctccaggtgccagatgtgacatccagttcgacccngtctccagttccttcctgtcctgctatctgtaggagacagagtcaccgataccacgttcggcccgggacctaggtccaacgggtactaactttaaacgtaacgtttttacgttacggttccgttagggttaactaccggtaaacgtaaaccccgaaaaaaacgggtaaccggggtaaaaccgttacccccgttaaaaggtcccgtttaaccccgtaggtaaaactttccggtttaggtttacggtttaccgtaccgtaaacctttcccgtttaaacgttttacggaacgtaaaacgggtttcccggtaccctaacgtacgtaaccggttcgacgggtaccggngttaacggtagggtacttacgggtaaccggacgtaaacgtaacgttttacccgaaccttttcggtaaccctaacgtaacgttacccgaaacggtccgaccggttaccccgtgggaaccccgtcgggtaaaccctttagggtaaaccgtttttacgtttaccgaaaacccggttttaacttttttaaccgttaacggttccgtaaacccgttaaacggtttcccttttaaaaacggttttttaccccggtttaaaccccgggtaccccggtttaaccgtttacccggggggttttaaaccccggggtttaacccgggggggaaccggtaaaacccgggggggtttaaccccgggttaaaggggttaaaaccccgggtttaaacggtaaacccctttaaaacccgggggttaaaccggtagggtttaacccgggtttagggtaaccccccggttacgtaaaccccccccggggtttaaatttaaccccgggtttcccgtttaaagggttttttaaccccccg

SEQ ID NO: 179524 - DNA, 706 bp, Homo sapiens
  misc_feature: GYAE6OF01BJKMC.13.87.H10.1.454.CMB.1.raw
  modified_base (440)..(440): a, c, t, g, unknown or other
  misc_feature (440)..(440): n is a, c, g, or t
tcagtcacgtactacacgaccggtgctcgatttagcagtactgcgttgggtttggggagtcagtcccagtcaggacacagcatggacatgagggtcccgctcagctcctggggctcctgctgctctggctcccaggtgccagatgtcgacactccagttcgacccagtctccattcccttcctgtcctgctatctggtaggagacagatccaccatacacttgccggccacgtcaggactattaacagttatttagtctggtatcaagacaaaaccgagggaactccgaatcctcctgacttcttagtgttcgctacttccgtactttagacgtaaacggtcgggtaccagttcgtaaggttcgacggtcgagtacggtgacgtcgaggacgtagtaacttcgacttcgtacaactacgtctagcgtacgtcctggaacncggtacctaagggtactttaacgtttacgaaccgtttaaatttacgtacttaggtaacctaaacgttgttaaaccgtttaaaccggtccgtttaaccccgtcgttaacgggtttaccggtttaccgggggaacgggtaaccggggtaaacccgtaaaggggttaaacggtaaccgtaacgtttaaaacccgaaacccggttaggttacgggttacggtaaccgttaccgaaccccgtaacgtttccttccggtttcccggttaccc

SEQ ID NO: 179525 - DNA, 693 bp, Homo sapiens
  misc_feature: GYAE6OF01BIIS7.13.87.H10.1.454.CMB.1.raw
tcagtcacgtactacacgaccggtgctcgatttagcagtactgcgttgggtttggggagctctgggagaggagccccagccctgagattcccaggtgtttacattcagtgatcagcactgaacacagaggactcaccatggagttgggactgagctggattttcctttggctattttaaaggtgtccagtgtgaagtgcagctggtggagtcgtgggggagcgttggtacagtcctggcaggtcccctgagacctctcctgtcgcacgcctcgtggtactttcctaccttttggaattgtaatttatcggaccctatcgccgtaacggttcggggtcccgacgaacggtccgtaccggaggggaacgggtccgtgggaggttcgggtctacggtagggttactttagggttacggaagttaggttcgggtaagcgtaagttagggtcttaaggtcgggtacggtaccttcggtggttaacgggaaccgggtccgtaatttcccgaactcgtacgtacccagtaacgacaccgacctaagtaccctcccgttatacgtcgtacgactaagtacgaacctggacctagggaacgtcggcgttacggaacgggtacctaaccgggttcctttaggttaacttgttagtacgtaactaaacgtacccttaccccgttaaaccgtttaggtttaacgg

SEQ ID NO: 179526 - DNA, 711 bp, Homo sapiens
  misc_feature: GYAE6OF01AGVV4.13.87.H10.1.454.CMB.1.raw
  modified_base (172)..(172): a, c, t, g, unknown or other
  misc_feature (172)..(172): n is a, c, g, or t
  modified_base (472)..(472): a, c, t, g, unknown or other
  misc_feature (472)..(472): n is a, c, g, or t
tcagtcacgtactacacgaccggtgctcgatttagcagtactgcgtttgggtttggggagtcagtcccagtcaggacacagcatggacatgagggtccccgctcgagctccgtggggctcctgctgctcgtggctcccgaggtcgccagatgtgacactccagttcgacccngtcctccacttcccttcctgtctgctattccgtaggtaggagaccgagtacgtaccaaccctatccgtaaccgttcgggaccccgggtacaacggttcaacggtaacctaagtttaaaccgtagttttacgtttacgtcgtaggttactacgaacgtaaccgaaaaacggtagggttaaaccgtacccctaagcccgttaccctaggtaaccttcgttaagttggttaccgcttaaccttaccctagtttacgaacgtaaacgggtccggtaccctagtacgtaacggtcaaggccgtanaggtgtctacggaggactaacgtattcgaccttcgactaacagtacacggtacacgtccgtacgacgcgtactaggtaattcgtttacgaactttaccttattactcgtaacaacgtacgtttactaacgttaccgttccgtattcgttaggtcggaccggtaagccggtaagacgtacgtaaacgtacgtaaacggtcttaagggtccgacgttacacctttaagcgttcgttctacg

SEQ ID NO: 179527 - DNA, 887 bp, Homo sapiens
  misc_feature: GYAE6OF01AHZ2X.13.87.H10.1.454.CMB.1.raw
tcagtcacgtactacacgaccggtgctcgatttagcagtactgcgttgggtttggggagctctgggagaggagccccagccctgagattcccgaggtgtttccattcagtgatcagcactgaacacagaggactcaccatggagttgggactggagctggtattttccttttggcttattttaaaggtgtccagtgtgaagtgacagctgggtggagtcgtgggggagtcttggtacagcctggctaggtccctgacgacctctccgtggtcgacacggtccctcgtaggtactttccgtaccgttttagacttcggtaactttacgtcggtaccctagttcggaaccgttacggttacggggggtccccggaactaaaccggtacccggttaacccgggaaggggggtaaaccgggtcccgttggggtaaccgggttcggggttacctacggtaacggggtttaactttaggggttacgggtaaagttggtaacggggttacgtacgtaaacggttaggggtacctttaaggtcgggttacccgggtaaccgtttcgggttaacgggtaacgggggtaaccgggggtaccccgttaagtttaccccctaaacccggtacgttacccccggttaacccgaaaggggtaccgaaaaccccgtaaacccggacccccgtaaaacgggtacccctttacccggtagttaaacttccggtaaacgaacccgttaaagtaaccgaaacctcggtaaccccgtaggaaggttaccgcgttaacgggaaccggtacccgtaccggttacctttaaggtttaacgttaggttacgtaacggtaaaccttaaacggttaaaccctaccccccgtttaaaccgttaagtttaacggg

SEQ ID NO: 179528 - DNA, 738 bp, Homo sapiens
  misc_feature: GYAE6OF01AZMMI.13.87.H10.1.454.CMB.1.raw
  modified_base (633)..(633): a, c, t, g, unknown or other
  misc_feature (633)..(633): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatcccagttgacccagtcctccatccttcctgtctgcatctgtaggacacagagtcaccatcacttgaccgggcagtcaggactattaacagtttattagtcttaggtactacgaagtaaccaaaaaaccgagggtaaacgtaccccgtaaacgtccttacccgtaggtacttaccgttaagttcggtttacgcctaaccttacccgttaaccgttttacggaaccgtaaaacgggttccgggggttacccctaaggttaccgttaaacggggtcgtacgggaccgggtacgtaaggttcgggtacgttacggtacggggtaacctaacgtaaactttcctaacctccgtaaccgaactaacgttcaacggtccgaacgtccgttacgacctaaccggttacctaaggtacttaacgtttcgaccctttaaagtttacgtaactgtaacccaagtacttactttaacgtccgttaacccgtnttaacgtacggtttccggaacgggtacggaaccgtaagggtaggtaacgtaacgtaccgtaaaggtcctggtaccgtacgtccgactaacctgttcgtcttaccg

SEQ ID NO: 179529 - DNA, 882 bp, Homo sapiens
  misc_feature: GYAE6OF01E4EGV.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagagactcaccagtggagttgggactgagtcgtgggtactttttccgttttggactttaagtttttaaaaacgggtcgttccctaagttagtaggtaaagttcgaccgagtcgttgggtgggtacgttcgggtggggggacggtcgttagggtaccacggtccgtgggacccgtacgggttcccgtaggtaacggtaccttccttaccgtggttcgacccgtacggtcccgttacggttaggtacctttccgtaaccgttttgaagttacgttatttaacgtcggtacctaggttccgtaccgtaccggttcggggtaccccgacgaaccggtccgtaccgggaaggggtaacggtcccggtagggtacgggttcggttactacggtaacggtttagttacgggttaacggtaagtttagggttacggtagtaccgtaagttacggtacttaggacgggttacggtacgttcggtacgggtacggaccgggtaccttaacttaccccggacttacgtccgtaaacgagggtaaaccctaaccggaaccgtacccgtaaaccggttacccttccggtaagtaccgttaactacgttaaacgaacgttaactaacccgacggttacaacgggtacaacgggtaccggtacggaaacccggttaccggtcccgtttaacgttagtttaccgttaggtactaaacgtaaacccgtacgtaaacccccttccggttttaaacccggttgtttttaaccgggg

SEQ ID NO: 179530 - DNA, 879 bp, Homo sapiens
  misc_feature: GYAE6OF01AKL04.13.87.H10.1.454.CMB.1.raw
tcagtcacgtactacacgaccggtgctcgatttagcagtactgcgttgggtttgggggagtcagtcccagtcaggacacagcatggacatggagggtccccgctcacgctcctggggctcctgctgctctggctcccgaggtgccagatgtcgacatccgtagttcgacccagtctccattccctctgtcctcgctacgtcgtgtaggaacacgaggactacctacccattccgtacgttccggcccggggtaccacggttacgaaacgggtaaccttaacggttaaacttagtttaacgttttacgtcgttaggtactccgaaaacgaaaccaaaaaccggtacggggaaaacgtccccgtaaagaccgtcccgtaaggtactacgttaagttcggttagtacctaacgttcccgtaatttacgggaaacttaacgggtaccgggtaccctaagttaccggtaacggttaccgacggcggtgaacgggttgaacgtcgggtaaggaacgtaataaccgttcacccgttcctaagaaccataccgaagtaccgacgtaccgtacgtcgtaacgtaccggtttaacgttaacgggtttaccctttaaaggtaacccgttttaaaccttttaccgtttaaacgtcggtaaaaccgttacgttaaacccgtttacttttaaaacccggtaccccgtttaaaccccgttcgggttaacccgggtttaacccgggtaccgggggtaaacccggaacggggtaacccgtaaacggggttaacgggaaacgtaaaccggttaaaccaaaccgggttagttaccccggggaaaccgttcggtaacccgtcccgtaaacgtcccttttaaccgggcccggttttaacc

SEQ ID NO: 179531 - DNA, 891 bp, Homo sapiens
  misc_feature: GYAE6OF01CVL5J.13.87.H10.1.454.CMB.1.raw
tcagtcacgtactacacgaccggtgctcgatttagcagtactgcgttgggtttgggagtccagtcccagtcaggacacagcatggacatgagggtccctgctcgagctccgtggggcttccgtgctcgtcctcgtggcctcgtacgagggttcgaccgaggtacgtggtacgaacctacgttaccgaaggtaacttaccggacccctaacgttccctaccccgtaccgtttcccctttcccgtggttcccttagcctaacgttcggtacggtaacggaacgaacggtacgtacgttaccaaccgtactaccgtacgttcggaccgaagggccgtaacgtaccgtaacgtaacttaaacgtttaaaactaacgtttaaagtttaaacgttgtacgtacgaagaacgtaaacggtaaaccgaacggtaaaccctaccccgtaagttccgtacgtacgtacctacggtaactacacgtacgttaacgttaccgttaaaggttaaccggaaaacggttccggttaaccttaaggaacggttaagttacggaagggtaacgggtaacgttaggtacctaaggggtacgtacgtttagtttaaccttttaccgacgtactacggtacacgtacgacgtcgacgtaacgtccgtaacggtaacgtaacgttaacgttaacggacgttaaacgtagtttaactacgttaacgttcgtaacgttaaggtcgttaaacggttataccgttaacctaccgtacccgttccgtaaaccttaccggtaccggtaacccggaaaggtaaccccggtaacgttaaccggttacgggtttaaacccgaaaccgtttaaaggtaaccccggtacttaggggtaacccccttagggtaccccttacggg

SEQ ID NO: 179532 - DNA, 695 bp, Homo sapiens
  misc_feature: GYAE6OF01BCNBL.13.87.H10.1.454.CMB.1.raw
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
tcagtcacgtactacacgaccggtgctcgatttagcagtactgcgttgggtttggggagaggagccccagccctgagattcccgaggtgtttccattcagtgatcagcactgaacacagaggactcaccatggagttgggactgagctggattttcctttggctatttaaaaggntccagtgtgaagtcgcagctggtggagtcgngggggagcttggtacagcctggcgaggtccctgacggactctccgtgtcgcagcctcgtggactttaccctttagactgtacgttatcgcctagtgactacggtcgggtccgacaagtccgttacccggaaggggaacgggtcctagggacgttcgggtcgtacgtaaggtagtttacggttacggaagttaggttcggaacgacgaagttaagggccgtttaagtcggtcccggtaacttccgtgggtacgggaaacggggtccctacgtttacccaccgtaattcccaccgaggtaacgaccgtaaacgaccctaacgtacccgtccctagtactcgacgaacctaagttaccaacacgccgttaagcggtaacgtcgtacggacggaacgtcccggtacgtttagttaacgttattcgaacggtaccgtaaaacggtctacccccgtaaccgtttaagttcgttttaggaccgtttgggttaaccg

SEQ ID NO: 179533 - DNA, 750 bp, Homo sapiens
  misc_feature: GYAE6OF01A28I9.13.87.H10.1.454.CMB.1.raw
  modified_base (740)..(740): a, c, t, g, unknown or other
  misc_feature (740)..(740): n is a, c, g, or t
tcagtcacgtactacacgaccggtgctcgatttagcagtactgcgttgggtttggggagtcagtcccagtcaggacacagcatggacatgagggtccctgctcagctcctggggctcctgctgctctggctctcaggtgccagatgtgactatccagatcgacccagtcctccatccctccctgtctgctatctggtaggagacgagacgtccaccatctacttcgaccagggcgtaggtacgaaggacctaatttaaaaccgtaactttaaattttaaaacggtttggttaataccgtaagaccaaacggtaaaaccccgtaaggtaaaacccgtacccccgtaagccgttacctagtacgttacctacgatacgtactaacgttaccttaaaggtttaacgggaaaccggtacggggtacccctaaagttaccgtaaacgggtttaccgagggttagggtaaagggttcggtaagttaccggtacggggtaacttaacggtttaactttttaccgttacacgtactacgacgtacgacgaccttcgacgacgtccgtaaggtaagttacttaagttacgtaactaactaagttactttacgtacgtactacgtagtaagttagttagttaactaacttccgtaaccgtactccttacccggttaccggaaccggtaaacgggacctacggtacgtaacggttaacgtaaaaccgtaaacgtacgttagggaccggttnaacggtaccc

SEQ ID NO: 179534 - DNA, 815 bp, Homo sapiens
  misc_feature: GYAE6OF01BWATF.13.87.H10.1.454.CMB.1.raw
tcagtcacgtactacacgaccggtgctcgatttagcagtactgcgttgggtttgggggggagaggagccccagccctgagattcccaggtgtttccattcagtgatcagcactgaacacagacggactcaccgatggagttgggactgagctggtatttttccttttggcttaatttttaaaaggtgtcctagtgtagaagtgcagtcgtggtaggagtcggtgggggagcttggacagccgtggcctacggtccctagacggaccttccttccgtggtacgccacgtcctcgtaggtacttcctaccgttttgacttgtaattacgtcggacctagtcgccgtacggtttcggggccgacgtaacgccgtaccggaaggggacggtccgtagggtaggtcggtctacggtaaggtttacgttaggttaaggtaagttaggtagggtacgtataaggtacgtcttaagtcggtaccggtcttaggttacggtaagggaaccgggttaccttacgttacccgaaccgtacttacccggaccgaaagggaccaaaccggtaacccgtacccgtaaaccgtaacccttccccgttagttacctacgttacgaaacccttaaagtcccgtaaacgtaaccggtccgtaaggaggtaccgtcgtaacggtaacccgggtaccgtaccgtttcgtttaaggtttaacgtttacggtttaacggaaaccggtaaacttaaaacccgtccccgttaaacccccgtttaaaccggtttacgttttaacggtttacgggttaacgtttaacgggtttaacccggg

SEQ ID NO: 179535 - DNA, 175 bp, Homo sapiens; identical to SEQ ID NO: 179468
  misc_feature: GYAE6OF02GPMKE.13.87.H10.1.454.CMB.1.raw
  modified_base (173)..(175): a, c, t, g, unknown or other
  misc_feature (173)..(175): n is a, c, g, or t

SEQ ID NO: 179536 - DNA, 187 bp, Homo sapiens
  misc_feature: GYAE6OF02G7MGW.13.87.H10.1.454.CMB.1.raw
  modified_base (174)..(187): a, c, t, g, unknown or other
  misc_feature (174)..(187): n is a, c, g, or t
tcagtcacgtactacacgaccggtgctcgatttagcagtactgcgttgggtttgggggaaggaggaagactgacggtcccccaggagttcaggtgctgggcacagcggccctgggctgcctggtcaaggactacttcctagtacgtgactgagcgggctggcaaggcgcatagnnnnnnnnnnnnnn

SEQ ID NO: 179537 - DNA, 174 bp, Homo sapiens; identical to SEQ ID NO: 179424
  misc_feature: GYAE6OF02F37JN.13.87.H10.1.454.CMB.1.raw
  modified_base (173)..(174): a, c, t, g, unknown or other
  misc_feature (173)..(174): n is a, c, g, or t

SEQ ID NO: 179538 - DNA, 500 bp, Homo sapiens
  misc_feature: GYAE6OF02F8QNO.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagtattttgctaacttattactgtactacagtatacacaattactcctgggacgttcgaccaagggaccaaggtagaaactacaaacgtactagtcggactgaccacatccg

SEQ ID NO: 179539 - DNA, 175 bp, Homo sapiens; identical to SEQ ID NO: 179468
  misc_feature: GYAE6OF02IFQX0.13.87.H10.1.454.CMB.1.raw
  modified_base (173)..(175): a, c, t, g, unknown or other
  misc_feature (173)..(175): n is a, c, g, or t

SEQ ID NO: 179540 - DNA, 606 bp, Homo sapiens
  misc_feature: GYAE6OF02JXRYH.13.87.H10.1.454.CMB.1.raw
  modified_base (266)..(266): a, c, t, g, unknown or other
  misc_feature (266)..(266): n is a, c, g, or t
  modified_base (331)..(331): a, c, t, g, unknown or other
  misc_feature (331)..(331): n is a, c, g, or t
  modified_base (393)..(393): a, c, t, g, unknown or other
  misc_feature (393)..(393): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagcaaaaaccnggaaatcccaagctcctgatctatgttgcatccatttgcaaagtgggtcccatcaagtcagcggnagtgatcgtgggacagtaattcactctacgacaatccaagcagcctgcacgcctagaacgtnttttcgactaaacgtttactacttcgtaactaaacacggttctttaaaacttacggtttaccccgactttaccgtaacggttttaccgggacgggttaaccgggaaccgttacgggttacggaacggtaacgttaaccaaaacggggtaaaccctttggggtaggtacccttacggaacccgttaacctaacgttcccggttaagtttacccg

SEQ ID NO: 179541 - DNA, 535 bp, Homo sapiens
  misc_feature: GYAE6OF02GTQON.13.87.H10.1.454.CMB.1.raw
  modified_base (267)..(267): a, c, t, g, unknown or other
  misc_feature (267)..(267): n is a, c, g, or t
  modified_base (391)..(391): a, c, t, g, unknown or other
  misc_feature (391)..(391): n is a, c, g, or t
  modified_base (436)..(436): a, c, t, g, unknown or other
  misc_feature (436)..(436): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccnggaaagtccctaagctcctgatctatgttgcatccactttgcaaagtgggtccatcaaggttcagcggcagtggatcgtgggacagaattcactctcacaatcagcagcctgcagcctgaagtnttttgctaactttatactgtcaactagctttaaatagttacccgnttcaagtttcgggacggagggacctaagggtcggaagtagtaccgaaaacggtaaacttggtagggtccttacggaccaacccgtattacctgttaccc

SEQ ID NO: 179542 - DNA, 599 bp, Homo sapiens
  misc_feature: GYAE6OF02ISX3P.13.87.H10.1.454.CMB.1.raw
  modified_base (261)..(261): a, c, t, g, unknown or other
  misc_feature (261)..(261): n is a, c, g, or t
tcagtcacgtactacacgaccggtgctcgatttagcagtactgcgttgggtttggggctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtctgggggagcttggtacagcctggcaggtccctgagactctcctgtgcagcctntggattcactttgatgattatgcctatgcacgttgggtccgcaagcctccgaaggggaaggcctgggagttcggggtctcgaggttattaggtggaaatggtggtagcagtaggctagtgcggactcgtagtgaagggctagttcacgatctcagagacaacgcaaagacctcctagtatctagactaaatcgaactacgacctagaacgtagaccgtagacggtaccgaccggtaccgtttaggttaacgttacgttacggttaacgaacgtaaaaacgtaccgttaacccccgttaaaccccggtttaacggttaacgttttttagggtaaacggg

SEQ ID NO: 179543 - DNA, 172 bp, Homo sapiens
  misc_feature: GYAE6OF02GKJ48.13.87.H10.1.454.CMB.1.raw
  modified_base (171)..(172): a, c, t, g, unknown or other
  misc_feature (171)..(172): n is a, c, g, or t
tcagtcacgtactacacgaccggtgctcgatttagcagtactgcgttgggtttggggaagaggaagactgacggtccccaggagttcaggtgctgggcacagcggccctgggctgcctggtcaaggactacttcctagtacgtgactgagcgggctggcaaggcgcatagnn

SEQ ID NO: 179544 - DNA, 777 bp, Homo sapiens
  misc_feature: GYAE6OF02FXOBS.13.87.H10.1.454.CMB.1.raw
  modified_base (267)..(267): a, c, t, g, unknown or other
  misc_feature (267)..(267): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagcctntggattcacctttgatgattatcgccagtcgactacggtcgggtccgactaacgcctaccggaagggggtaacgggccgttaggggacggttcggggttacctacggtaagggtttaagtttagggttagggaaagtttagggttacgggtaacgacgtaaggttacggtacttaggtccgggacgttaaccgtttcggttagggtaacgggtaaccggggtacccgttaacgttacccgaaaccgtaaccgttcccgtaaccgaagggaaccgtaaacccgaaacccgaacccgtaaaaccgtaacccgttaccccgttaggttaaccttacgtaacggtaaactaaaacgttaacgaacgtaccggtaccgtaaggaaacgtacgtaccgtacgggaaccggtaacccggtaccggttaccgttttaggttaaagtttacgttacggtacgaaaccgtaaaaccggttaccctaacccccgtttaaaccccgtttaggttttaacggg

SEQ ID NO: 179545 - DNA, 615 bp, Homo sapiens
  misc_feature: GYAE6OF02JQHQF.13.87.H10.1.454.CMB.1.raw
  modified_base (238)..(238): a, c, t, g, unknown or other
  misc_feature (238)..(238): n is a, c, g, or t
  modified_base (418)..(418): a, c, t, g, unknown or other
  misc_feature (418)..(418): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacngttattagtctggtatcagacaaaacagggaaatccctaagctcctagattctatgttgctactcctactttgactaaaggttcgggtcccaagtactaaggttcaagcggacaggtaggatcgtagggactagtaattcactctacacaatcagctacgcctagcagtcctagaacgtntttcgactaaacgtttatacttacgtacctaaagtacgttacttaaacgttccgttaacccgtcttacgttacggtttaccggacggggtaacggtaaccgtaaggggttcgaaacggtaccggtaaccctaaaacgggtaactacgggttaacggtacgttaccgaacctaccgttaacgttccgttaacggttcc

SEQ ID NO: 179546 - DNA, 588 bp, Homo sapiens
  misc_feature: GYAE6OF02I50WY.13.87.H10.1.454.CMB.1.raw
  modified_base (177)..(177): a, c, t, g, unknown or other
  misc_feature (177)..(177): n is a, c, g, or t
  modified_base (495)..(495): a, c, t, g, unknown or other
  misc_feature (495)..(495): n is a, c, g, or t
  modified_base (572)..(572): a, c, t, g, unknown or other
  misc_feature (572)..(572): n is a, c, g, or t
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttcctttggctattttaaaggngtccagtgtgaagtgcagctggtggagtcgtgggggagcttggtacagcctggcagggtccctgagactctcctgtgcagcctctggattcatctttgatgtattatgcctatgcacgtgggtccggcaaggcctaccgaggggaggcctgggaggtgggtctcgaggttattacggtgggaattggtaggtaaactagtaggtctagtgcggtactcgtggtacgagggcctattcacctatctaccgagacgaaccaacgaccaaaggtacctcccgtagttactctacggactaaagtcgaaacagtcctagganacgtcgtaggaacgggtacaccggtcttaggtacttacggtgtacgaacgtaaaggttcctaagtttcgacgtaggnggttcgtcgttacccg

SEQ ID NO: 179547 - DNA, 529 bp, Homo sapiens
  misc_feature: GYAE6OF02FIYW6.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcagggtctacagcctagagtatttgcgtacttactattgtcaacagtagtttaccttctcccccggtacgttccggaccgtaacggaccgaacggtaggaaactacgaacgacgactgtggcgtcgcaccatcgtgtcttcactccttcccgcctac

SEQ ID NO: 179548 - DNA, 508 bp, Homo sapiens
  misc_feature: GYAE6OF02GL9XS.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtacccatcaaggttcagcggcagtggatctggcacagacttcatttctcaccatcagcagcctgcagcctagaagtattttgctaacttattactgttactacaagatacaactaattatcctgggacgttacggaccaagggaccaagggtgaaactcaaacgtaactgtaggctgacactatctacg

SEQ ID NO: 179549 - DNA, 619 bp, Homo sapiens
  misc_feature: GYAE6OF02IJ6BF.13.87.H10.1.454.CMB.1.raw
  modified_base (196)..(196): a, c, t, g, unknown or other
  misc_feature (196)..(196): n is a, c, g, or t
  modified_base (268)..(268): a, c, t, g, unknown or other
  misc_feature (268)..(268): n is a, c, g, or t
  modified_base (304)..(304): a, c, t, g, unknown or other
  misc_feature (304)..(304): n is a, c, g, or t
  modified_base (392)..(392): a, c, t, g, unknown or other
  misc_feature (392)..(392): n is a, c, g, or t
tcagtcacgtactacacgaccggtgctcgatttagcagtactgcgttgggtttggggtaggtcgagtcccagtcaggacacagcatggacatgagggtcccgctcagctcctgggctctgctgctctggctcccaggtgccagatgtgacatccagttgacccagtcctccatccttcctgtctgcatctgtaggngacagagtcacatcacttcgccgggccagtcaggacattaacagttattagtctggtatcagacaaaaacgngggaaactccctaagccttccagtactctatgttanctatccactttgacgtaaagtcgggtcccatcgtaaaggttcaggcggacaggtggacttcggagggactaagtaacttcgtaacgtntaccaactaagtcgaagtacacgtcctaggaccacgtccgtagagttagtttgacctaacttttacacgttagtacctaaatcgtaacgttaaactccgttaacccgtactaccgttaggtttaccgggacgggaagggtacccgtaaggggttcgaacggtaagtaaccgaaacgttaacggtgtaacgggtctacggtaccctaacggtacttccggtatacccg

SEQ ID NO: 179550 - DNA, 525 bp, Homo sapiens
  misc_feature: GYAE6OF02FMVM0.13.87.H10.1.454.CMB.1.raw
  modified_base (340)..(340): a, c, t, g, unknown or other
  misc_feature (340)..(340): n is a, c, g, or t
  modified_base (396)..(396): a, c, t, g, unknown or other
  misc_feature (396)..(396): n is a, c, g, or t
  modified_base (446)..(446): a, c, t, g, unknown or other
  misc_feature (446)..(446): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaagtccctaagctcctgatctatgttgcatccactttgcaaagtgggtcccatcaaggttcagcggnagtggatcgtgggacagaattcactctcacaatcagcagcctgcagcctagaagtnttttagctaacttattactgtacaactagtactttaaatacgtttacccnttccagtttcggcggtaacgggaccaagggtggaaggatacaaacggaactgtacggtctgaccacctatccttgtacc

SEQ ID NO: 179551 - DNA, 581 bp, Homo sapiens
  misc_feature: GYAE6OF02HL8EY.13.87.H10.1.454.CMB.1.raw
  modified_base (394)..(394): a, c, t, g, unknown or other
  misc_feature (394)..(394): n is a, c, g, or t
  modified_base (449)..(449): a, c, t, g, unknown or other
  misc_feature (449)..(449): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttattagtctggtatcagacaaaaaccagggaaactccctaagcctcctgatctatgttgcatcctactttgacgtaaaggtcggggtaccccagttcgaaaggttcaggcggacaggtggatcgtggggaacaaggtaacttcgaactctacaanaactcagaccagcctgcaggcctagtaagtattttcgactaaacttttataactntaccaaatgtaactttaataccgtttacccgcttcgtacggtttccggacgggtacgggtaccgaagggttggaaggtaactaccgaaaacgtacgtggtacggctacgacctaacctattccgtgttaccc

SEQ ID NO: 179552 - DNA, 601 bp, Homo sapiens
  misc_feature: GYAE6OF02GM01K.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagccctaagctcttgatctatggtgcataccaagtttaaaaggtggggtacccatcaaggttcagcggcagtggatcgtggacacagtacttctattctacaccatcagcacgcctgacacgcctaggtaacgtattttacgactaaacgtttactttaacgtcgttacttaacaaacgtattaccgtaacttaaattttaaccgtacgttaacggggtaccgtttaccggaccgaaacggggtaaccgaaaggggttaaggtaaaacgtaaccgaaaaccgtaacgtacggttacgggtaccgtacggacctaccgtaatttcccgg

SEQ ID NO: 179553 - DNA, 582 bp, Homo sapiens
  misc_feature: GYAE6OF02I80RA.13.87.H10.1.454.CMB.1.raw
  modified_base (316)..(316): a, c, t, g, unknown or other
  misc_feature (316)..(316): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccaggcagtcaggacattaacaactatttaaatggtatcagtcaagaaccaggtaaagcccctaagctactagatctacgatgcatccaatttggaaacngggtccatcaaggttcagtggtaagtgatcgaggactagtattttaccttcgacctatcgagcacgtcctagcagccttagaagtatagttgacctaaacgtattaattaaccgtgtaacaggtacctaagttagtacgaatttaacaccgttacccgaacttcccaacccgtttacgggacccgtaagggtaccgaaccggtacgttacgggaataaacgttaaaccgaacgttaggtacggtactacggacctacgtattaccg

SEQ ID NO: 179554 - DNA, 674 bp, Homo sapiens
  misc_feature: GYAE6OF02JTWOH.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgtacccagtctccatccttcctgtctgcatcgtggtaggagacagagtcaccgatcacttgccgggccagtcaggacattaacagttatttagtctggtatcagacaaaaccaggaaagtcctaagctcctgatctatgtgctatccactttgactaacggtcgggtacccatctaaggttcagcggcagtggatcgtagggactaggtattacgacgttcctactaactaacgttccaaggccgtaaacggtcccttaggacctaacgggtcccgttaagggaaacgtttatttttacggaacttaaaccgtttagtttaaccgttacggtaacctaaacgtaccgttactttaaacgttaccgtttaacccgtaccgtttacgttacggtttaccgggtaacgggtaacgggtaaccgtaaggggttagaacggttaacgtaaccggtaaacggtaacccgtaggttaccgggacgttacggaccttaaccgtacgtttcgtacgtttaacccg

SEQ ID NO: 179555 - DNA, 626 bp, Homo sapiens
  misc_feature: GYAE6OF02HN1O2.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccgggccagtcaggacattaacagttattagtctggtatcagacaaaaacgaggaaatcctaagctctgatctatgttgctatcctactttgacgtaaaggtcggggtaccccaagtacgtaaaggttcaggtaccggacgtaggttagggtacttcgtaggggaactaagtaacttacgtactactacaacaatcgaacgtcgacgtcctagaccacgtcctagtaagttattttacgacttaaactttattaactacgtaactaaacgtacgttaactttaaacgtaccgttacccgtcttacgtaacgggtttaccggacgggtaacgggtaaccgtaagggtggaacgtaacgtaaccgaaacgtaacgtcggtacgtctacgacctaacctagttccgtagttaccg

SEQ ID NO: 179556 - DNA, 538 bp, Homo sapiens
  misc_feature: GYAE6OF02GJ2VD.13.87.H10.1.454.CMB.1.raw
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
  modified_base (530)..(530): a, c, t, g, unknown or other
  misc_feature (530)..(530): n is a, c, g, or t
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtggtagtacatactccgcagactccgtgaggggccgattcaccatcctccagagacaattccaagaacacgctgtttcttacaaatgaacagcctgagacnccgatgacacggccgtgtacttactgtgcgagagngtcggggacccaacggtaacgttactacgctagtcggacgttcgnggggaccg

SEQ ID NO: 179557 - DNA, 683 bp, Homo sapiens
  misc_feature: GYAE6OF02I4GGP.13.87.H10.1.454.CMB.1.raw
  modified_base (278)..(278): a, c, t, g, unknown or other
  misc_feature (278)..(278): n is a, c, g, or t
  modified_base (590)..(590): a, c, t, g, unknown or other
  misc_feature (590)..(590): n is a, c, g, or t
  modified_base (597)..(597): a, c, t, g, unknown or other
  misc_feature (597)..(597): n is a, c, g, or t
tcagtcacgtactacacgaccggtgctcgatttagcagtactgcgttgggtttgggggtaggcgtctgggaggagggagccccgagccctgagattcccaggtgtttccattcagtgatcagcactgaacacagaggactcaccatggagttgggactgagctggattttccttttggctattttaaaggtgtccagtgtgaagtgcagctggtggagtcgtgggggagtcttgggtacaggcctggcaggtccctgagactctcctgtagcagcctntggattccacctttgactgattagtgaccctattgcctacggtcggggtccgacaacgctaccggagggggaacggtcctggggacgtcgggtactcgtaaggggttacttaggtaggtaaagttacggttggggtaacacgtaagttacggggcttaaggtggccgggtattaccggtaaggtacgggaaacgggggtcccgtaaatttccgaaacccgtagttccgtacccggaagtaaccggaacctaaaccggcccaaaaggtacccttcccgtaggttaatccgtacgacgtaaaattacgaaccgntacccgngaaagtgcctagggaacgaccgtacggtctttagtatttaacgtggtaccgacttaaagacctacccgttaaccccgtagtttagg

SEQ ID NO: 179558 - DNA, 523 bp, Homo sapiens
  misc_feature: GYAE6OF02G2LQ9.13.87.H10.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgccatccagatgacccagtctccatcctccctgtctgcatctgtagganacagagtcaccatcacttgccaggcgagtcaggacattaacaactaatttaaattggtatcagcagaaaccaggtaaagcccctaagctcctgatctacgatgcatccaatttggaaacnggggtcccatcaaggttcagtggaagtgatcgtggacagtattttactttcacctatcagcagcctgcagcctagaagtattattagcctaacattacttactgtcagcagtatgtaataactcctacccgtatccaccgttcggaccaagggaccacggactggaaagtacttaaacgacttcggtacggtctcgacctacctacg

SEQ ID NO: 179559 - DNA, 584 bp, Homo sapiens
  misc_feature: GYAE6OF02HA1WR.13.87.H10.1.454.CMB.1.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (450)..(450): a, c, t, g, unknown or other
  misc_feature (450)..(450): n is a, c, g, or t
tcagtcacgtactacacgaccggtgctcgatttagcagtactgcgttgggtttggggctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtctgggggagcttggtacagcctggcaggtccctgagactctcctgtgcagcctntggattcaccgtcagtcacacctanatgagcgtgggtccnccaggctccgaggggacgggctggagtgcgtcttcttttattatagtagtggtagtacattactccgnagtacctcggtagacggggcctagttccacctattcctaccgagacgaactacttaccaagacaccgtcttagtttactanaaatgaacagacctagacgagccgagtcgaacgacggtccgtagttaacttcgtggtacgcggaagacggtacgtccgggggtaccccaacggttaaccgttaccgtaaccggtcttaacggtcggtaaccggg

SEQ ID NO: 179560 - DNA, 578 bp, Homo sapiens
  misc_feature: GYAE6OF02HBB86.13.87.H10.1.454.CMB.1.raw
  modified_base (267)..(267): a, c, t, g, unknown or other
  misc_feature (267)..(267): n is a, c, g, or t
  modified_base (403)..(403): a, c, t, g, unknown or other
  misc_feature (403)..(403): n is a, c, g, or t
  modified_base (459)..(459): a, c, t, g, unknown or other
  misc_feature (459)..(459): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagctggtatcagacaaaaaccngggaaatccctaagctcctgatctatgttgcatccatttgcaaagtcgggtacccatcgaaggttcagcggcaggttgatcgtggacagaattcactctcaactaatcagtcaacgcctgacacgacctgaaagtnttttcgaccttaactttacttactgtacaactagtactttaaagtacgttacccgngttaccgtacggtttccggaacgggtacgggaaccgtaacgggttaggtaacggaataaccgtaaacggtaacttcggttaggacttacggaccgtaacccgtattacgtacgttaccg

SEQ ID NO: 179561 - DNA, 529 bp, Homo sapiens
  misc_feature: GYAE6OF02GNXFB.13.87.H10.1.454.CMB.1.raw
  modified_base (371)..(371): a, c, t, g, unknown or other
  misc_feature (371)..(371): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaacagggaaatcctaagctcctgatctatgttgcatccactttgacaaagtgggtcccagtcaaggttcagcgcagtggatcgtgggacagtattcactctcacatcancagcctgcagcctagaagtatttgactaacttattactgtacaactagtacttaaatacgttacccgcttacgtacggtttcggacggtaagggaccagggttgaggtataccgtaaacgagttacggtggtcgtagaccaccgattacgtgttaccg

SEQ ID NO: 179562 - DNA, 534 bp, Homo sapiens
  misc_feature: GYAE6OF02IOR5W.13.87.H10.1.454.CMB.1.raw
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggccagtcaggacattaacagttatttagtctggtatcagacaaaaaccgagggaaatccctaagctcctgatctatgttgcatcctactttgacgtaaaggttcggggtaccctagttacgaaggtttcaacggccggtcaggtggatcgtagggacaagacttcactctacacaatcagcagcctgcagcctagaagtntttagactaactttatactgtacaagntacttaatacgttaccnctcgtaggttcggacggtaggaccagggtggagtactacgaaacgtntggtaggctgaccactgtctnttcc

SEQ ID NO: 179563 - DNA, 179 bp, Homo sapiens
  misc_feature: GYAE6OF02JEZG9.13.87.H10.1.454.CMB.1.raw
  modified_base (173)..(179): a, c, t, g, unknown or other
  misc_feature (173)..(179): n is a, c, g, or t
tcagtcacgtactacacgaccggtgctcgatttagcagtactgcgttgggtttgggggaagaggaagactgacggtcccccaggagttcaggtgctgggcacagcggccctgggctgcctggtcaaggactacttcctagtacgtgactgagcgggctggcaaggcgcatagnnnnnnn

SEQ ID NO: 179564 - DNA, 538 bp, Homo sapiens
  misc_feature: GYAE6OF02GAATF.13.87.H10.1.454.CMB.1.raw
  modified_base (343)..(343): a, c, t, g, unknown or other
  misc_feature (343)..(343): n is a, c, g, or t
  modified_base (454)..(454): a, c, t, g, unknown or other
  misc_feature (454)..(454): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttattagtctggtatcagacaaaaaccagggaaactcctaagctcctgatctatgttgcatcctatttgactaaagtcgggtacccatcgaaggttcagtcggnacgtggatcgtagggacagtaacttcactctacacaatcagcagccctgacagtcctagagtatttcgacttaacttatactgtacaactgtacttaataccgttacccgnttacgtagtttcggacggtaggaccagggtgagtactacaaacggtactggtacggctacggacctacctattccgtagttccc

SEQ ID NO: 179565 - DNA, 178 bp, Homo sapiens
  misc_feature: GYAE6OF02G2GC6.13.87.H10.1.454.CMB.1.raw
  modified_base (175)..(178): a, c, t, g, unknown or other
  misc_feature (175)..(178): n is a, c, g, or t
tcagtcacgtactacacgaccggtgctcgatttagcagtactgcgttgggtttggggggaagaggaagactgacggtccccccaggagttcaggtgctgggcacagcggccctgggctgcctggtcaaggactacttcctagtacgtgactgagcgggctggcaaggcgcatagnnnn

SEQ ID NO: 179566 - DNA, 550 bp, Homo sapiens
  misc_feature: GYAE6OF02GEUSM.13.87.H10.1.454.CMB.1.raw
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccggcagtcaggacattaacngttatttagtctggtatcaagacaaaaaccagggaaagtccctaaagctcctgatctatgttncatccactttgacaaagtcgggtccagcaggttcagcgganagtggatcgtgggacagaacttcactctacacaatcacgcagctgacagacctagaacgtattttcgacttaatttactactgtacaaacagtacttaatacgttacccgtcttacgtacgtttcgggacggaagggaccgtagggtcggaagaacgtaaccaaacggtaactggtacggcgttacggaccaacgtacttctaggttacc

SEQ ID NO: 179567 - DNA, 633 bp, Homo sapiens
  misc_feature: GYAE6OF02I8NAS.13.87.H10.1.454.CMB.1.raw
tcagtcacgtactacacgaccggtgctcgatttagcagtactgcgttgggtttggggctgggagaggagccccagccctgagattcccaggtgtttccattcggtgatcagcactgaacacagaggactcaccatggagttttggctgagctgggttttccttgttgctattttaaaaggtgcccagtgtgaggtgcagctggtggagcgtggaggaggcttgatccagccgtcgggggtccctgacgactctcctcgtgcagcctctggttcaccgtcagtcacacctacactgacgctgggtccgccgagcctcgagggaagggctggacgtgactcgttcttttaagtttatagtagtaggtagtaacgtataaccgtccgacgagtactccggtagaggggtacccgtacttacgaccgacttcctaccgaagacgaacctaaacttcccgaaagaaccgtaaccgcgtttacgtttaccttacgtaaaagtcgaaacgtagtccctaggacgacgaccgagtcgacgacggtccgtagttacgtacgtgtcgacgagaaggtacgtcggggaccctacggttaaccgttactacggtaccgtagttacggtaccggtaggtaccgggg

SEQ ID NO: 179568 - DNA, 635 bp, Homo sapiens
  misc_feature: GYAE6OF02J0WOO.13.87.H10.1.454.CMB.1.raw
  modified_base (201)..(201): a, c, t, g, unknown or other
  misc_feature (201)..(201): n is a, c, g, or t
tcagtcacgtactacacgaccggtgctcgatttagcagtactgcgttgggtttggggaggtcagtccagtcaggacacagcatggacatgagggtccccgctcagctcctggggctcctgctgctctggctcccaggtgccagatgtgacatccagttgacccagtctccatcctcctgtctgcatcgtgtaggagacagngtcacatcacttgccggcagtcaggacattaacagttattagtactggtatcagacaaaacgaggaagtcctaagctctagatactagtgtgtcatcctacgttgacgtaaggtcgggtacctatcgtaaacggttcgacggacggtacgtaggtaggtacgttccgttacgggactaaccgtaaggttaaccttccgttaactttacctccgtaacccgtatacccgaaggcccgacggtccttcgacgtacggtacctagggaaactatttacggttacgaaccaaactagttaaactttactaggttaccaggtacctagtaacgttagaacttaacgtccttaccgactaccgtaccgtttacggacccgtaagggactaaccggagttacggaacttaacggaacctaacggtggttaccgattaccgg

SEQ ID NO: 179569 - DNA, 559 bp, Homo sapiens
  misc_feature: GYAE6OF02GBSBQ.13.87.H10.1.454.CMB.1.raw
tcagtcacgtactacacgaccggtgctcgatttagcagtactgcgttgggtttggggagctctgggagaggagccccagccttttgattcccaagtgttgtcattcagtgatcaggactgggcacagaggactcaccatggagtttgggctgaggtggtttttccttggtgctattttaaaaggtgtccattgtgaagtgcccctggtacaatctgggggaggcttggtcaaggccgggggatccctgagactctcctgtgaagcctcaacattcacttttgctcgtgcctgggtcgacctgggtcccgccaggctccgaggggaggggctgggagtggattggccatattaaggacagacctaatggcgcgacagcacactaccttagaactccgtacaaagacagattcatcatctacgagaggtgattccgaacaacacggttgtccttctcctatatcgagcagcctagaaactcgaacgacacgacggtacctatattactaggtcgacaggtgagtcgggaccacggaccacgtacgttttacggagttcggg

SEQ ID NO: 179570 - DNA, 607 bp, Homo sapiens
  misc_feature: GYAE6OF02FYIXB.13.87.H10.1.454.CMB.1.raw
  modified_base (380)..(380): a, c, t, g, unknown or other
  misc_feature (380)..(380): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagcaaaaaaccagggaaatccctaaagctcctgatctatgttgcatccatttgcaaaagtgggtcccatcaaggttcagcggcagtggatcgtgggacaagaattcactctaacaatacacganacgacgtcgtacgacgacctcgaagtaagttttattcgaaactttaattacttagtctaaacaacgtacttaaacttaagtttaacccgtaaccgttacctacgtttacggttccgggaaacggggtaccgtaaacgggtagggacggaaacttaccgaaaacggtaaaccgtaggttaggtaccgtagaccggtaacccaacgttacgttacgttcgtttaacccg

SEQ ID NO: 179571 - DNA, 550 bp, Homo sapiens
  misc_feature: GYAE6OF02F9TI6.13.87.H10.1.454.CMB.1.raw
  modified_base (309)..(309): a, c, t, g, unknown or other
  misc_feature (309)..(309): n is a, c, g, or t
tcagtcacgtactacacgaccggtgctcgatttagcagtactgcgttgggtttggggagctctgggagaggagccccagccctgagattcccaggtgtttacattcagtgatcagcactgaacacagaggactcaccatggagttgggactgagctggattttcctttggctattttaaaaggtgtccagtgtgaagtgcagctggtggagtctgggggaggcttggtacagcctggcaggtccctgagactctcctgtgcagcctctggattcacctttgatgattatgccatgcactggggtcccgnaagctccgaggggaacgggcctggagtgggtctcgaggtattaggtggaatagtggtagcagtaggctagtgcggactcgtgtaggaagggccgattccaccatctccagagaacaacgccaaacgtaacctccctagtactctagacaaatcgaacagcctagagacgctagaacggaccgacggaccttagtaacttagttaggacgtacaaaaggctacccgtaaccctagtttaacg

SEQ ID NO: 179572 - DNA, 548 bp, Homo sapiens
  misc_feature: GYAE6OF02GRQNL.13.87.H10.1.454.CMB.1.raw
  modified_base (198)..(198): a, c, t, g, unknown or other
  misc_feature (198)..(198): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
  modified_base (543)..(543): a, c, t, g, unknown or other
  misc_feature (543)..(543): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtcgccagatgtgacatccagttgacccagtctccatccttcctgtctgcatctggtagganacagagtcgaccatcacttgccgggcagtcaggacattaacagtttatttagtctggtatcagacaaaaaccagggaaatcctaagctcctagatctatgttgcatccatttgactaaaggttcggggtacccaagtcgaaaggtttcaagcggcaggtggatcgtgggaacagtaactttcacttcacacaatccaagcaagtcctagcagcctagaagtctttacgacttaagttntaacgtgtacaacgntacttaatacgttaccntcgtagttcggacggtacggacaggtacgacgtaacacgtaaacgacgttcgaggacctgacctacctataccgngttcc

SEQ ID NO: 179573 - DNA, 626 bp, Homo sapiens
  misc_feature: GYAE6OF02IH3JJ.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttctgtctgcatctgtaggagacagagtcaccatcacttgccgggccagtcaggacattaacagtttatttagtctggtatcagacaaaaaaccagggaaacgtccctaagctcctgatctattgtgcatcctactttgacaaaggttcggggtacccagtaccgaaggttacaggcgggcaggttggatcgtagggactaagtaattcactctacacaactcaagcaagcctgccagccctagtaagttagttttacgaccttaaacttttaatttacttacgtacctaaacgtaagttacctttaaagttaccgtttaacccgtacttacgttacgggtttccggacgggaacgggtaccgaagggttacggaacgttaagtaaccgtaaacggtaaccgttaggtacggtacgtcggtacccgaaccgttacttccgttacgtttaccg

SEQ ID NO: 179574 - DNA, 594 bp, Homo sapiens
  misc_feature: GYAE6OF02IWRNU.13.87.H10.1.454.CMB.1.raw
  modified_base (197)..(197): a, c, t, g, unknown or other
  misc_feature (197)..(197): n is a, c, g, or t
  modified_base (488)..(488): a, c, t, g, unknown or other
  misc_feature (488)..(488): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtagganacagagtcaccatcacttgccgggccagtcaggacattaacagtttattagtcttggtatcaagaacaaaaaccgagggaaacgtaccctaagctacctgactctagtgtgcatcctatttgacgaagttcgggtacccagtacgaaggttcaggcgacgtaggtggatcgtagggacagtaacttctactctacaacaactcacgcacgtcctgacctacgccttaggaattatttcgacttaacgtttatacgtctacaactagtaactttaacgtaccgttacccgtnttaccgtacgggtttacggaccgggtaagggaaccgtaagggtcgaagtaacgtaaccgtaaacgtacggtgtacggcgtagaccgtaacctattccgtcgttacc

SEQ ID NO: 179575 - DNA, 586 bp, Homo sapiens
  misc_feature: GYAE6OF02FSD8Q.13.87.H10.1.454.CMB.1.raw
  modified_base (290)..(290): a, c, t, g, unknown or other
  misc_feature (290)..(290): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacctttgatgattangccatgcacgtgggtcccgcaagctccgaggggaagggcctggagtgggtctcgaggtattaggttggaaattggtggtagcaagtagggcttagtgcggtacgtcgtggtgaacgggccgagttccacctatctccagagacaacgaccaagaactccgtagtactctagacaaagttacgaacgacgcccgtagagtacgcgtagacggaccgtaaccggccgtttaggttaatttaacgtttggttagtaccgtaaaacgtaccttacccgtaacccccgtttacgttaacgg

SEQ ID NO: 179576 - DNA, 670 bp, Homo sapiens
  misc_feature: GYAE6OF02IXRT2.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctgggctcctgctgctctggctcccaggtgccagatgtgacatccagttgacccagtctccatccttctgtctgcatctgtaggagacagagtcaccatcacttgccggcagtcaggactatttaacagtttattagtctggtatacaagaacaaaaaccaggtaaacgcccctaagcctctagtactactacgatcgactaactacctaagtttaggaaaaccgtacgggtaccctaagtacgtaaacgggttcaacggcggtacaggttacgggaattcgcgggactaacagtaccttcactttcgacaacctatcagaccacgtccgtgaccagtacccgtaagtacgtaacgtttttcgaccttaaacgtttaacttacttacgttaccaaagtaacgtaacttaccgtaaacttaagtttaccttaacccggtgggttaaccttccgggaaccgtaaccgggtaacgtaaccgggtaaaggtaaacctaaaccgtaaaacggaacgttacggtacggtacgttacgaaccgtaccccgtaattccgttagttacccg

SEQ ID NO: 179577 - DNA, 700 bp, Homo sapiens
  misc_feature: GYAE6OF02FZ981.13.87.H10.1.454.CMB.1.raw
tcagtcacgtactacacgaccggtgctcgatttagcagtactgcgttgggtttggggctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtctgggggagcttggtacagcctggcaggtccctgagactctcctgtgcagcctctggattcaccttttgatgattatgccatgcacgtgggtccggcaagctccgaggggaacggcctggagtgggtctcgaggtattaggtggaatggtggtagctaagtaggctatggcggtactcgtggtaggaacggggtccgtaagttccgaaccctacgtcctacccgaaggacgtaaccaaaccggacccaaacggtaacccttaccccgttagttaaccttaccgttacggaaccctaaaagtttcggaaaaccctacgggtaccccttaagggaaacgacggaccgttagggaaccgggtacccgtaacccgggtcccgttttaaggttaaacttttaacggttcggttaacgaacccgtaaaaacggttccttaaccccccgttaaaacccccggtttttaacgtttaaccggttttttacgggttaaacggg

SEQ ID NO: 179578 - DNA, 569 bp, Homo sapiens
  misc_feature: GYAE6OF02GBNF8.13.87.H10.1.454.CMB.1.raw
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
tcagtcacgtactacacgaccggtgctcgatttagcagtactgcgttgggtttggggagtcagtcccagtcaggacacagcatggacatgagggtccccgctcagctcctgggggctcctgctgctctggctcccaggtgccagatgtgacatccagttgacccagtctccatccttcctgtctgcatctgtaggagacagagtcaccatcacttgccgggccagtcaggacattaacagtttattagtctggtatcagtacaaaaaccgagggaaactccctaagcctcctgatctatgttgcatcctactttgactaaaggtcgggtacccatcaaggttcagcggcagtggatcgtgggacagtacttcactcacacatcancagccngcagcctagaagtnttttgacttaacttatactntacaaactgtacttaatacgttacccgcttacgtaggtttccggacgggtaacgggaaccctaagggtcggaacgtaacgtaaccgaaaaccgtaaccgttaggtacggcttacggaaccaaccctagttccgttagttacccg

SEQ ID NO: 179579 - DNA, 773 bp, Homo sapiens
  misc_feature: GYAE6OF02GPBRS.13.87.H10.1.454.CMB.1.raw
  modified_base (212)..(212): a, c, t, g, unknown or other
  misc_feature (212)..(212): n is a, c, g, or t
  modified_base (594)..(594): a, c, t, g, unknown or other
  misc_feature (594)..(594): n is a, c, g, or t
  modified_base (663)..(663): a, c, t, g, unknown or other
  misc_feature (663)..(663): n is a, c, g, or t
tcagtcacgtactacacgaccggtgctcgatttagcagtactgcgttgggtttggggagtcacgtcccacgtcgaggtacacgagtcattggacatgagggtccccgctacagctcctaggggctccctgctgctcgtggctcccaggtgcctagatgtgactaatccagttgaccagtcgtccatccttcctgtctgcagtcgtgtagganacagacgtcggaccatcacttcgccggcagtcaggacctattaacgagtttacttacgtcgtaggtatcaagtaccaaaaaccgagggtaaaccgtcccctaaggcccttaccgtaggtacttccgtaaggtcggttcgaccgtaacgttcccgtaacttttgggaaccgttaaaacgggtttccgggggttacccctaaggtttaccggtaaacgggtttaccaacggtccgggtaacctaagggttacgggtaacttccggtacgggggaaactaaacggggtaaccttttaccaaccctttaccgtacccaaactaagtacccgaaacgtaccgtacgtaacccgtacgacctaacggtaccgttaaggaaaccgtttnttttaacggaacctttaaacgtttactacgtcgtaacaacgtacgtaccttaaacgtccgttaccccgnttacgttacgttcggacgggtaaggacctaaggggtcgacgtaacgtaaccgtaaaacgtcgtacggtacggactacggtaccttaaccgcgtttccggtcgttaacccg

SEQ ID NO: 179580 - DNA, 696 bp, Homo sapiens
  misc_feature: GYAE6OF02IJK6E.13.87.H10.1.454.CMB.1.raw
  modified_base (148)..(148): a, c, t, g, unknown or other
  misc_feature (148)..(148): n is a, c, g, or t
tcagtcacgtactacacgaccggtgctcgatttagcagtactgcgttgggtttgggggagtcagtcccagtcaggacacagcatggacatgagggtcccgctcagctcctggggctcctgctgctctggctcccaggtgccagatgtnacatccagttgacccagtctccatccttcctgtctgcatctgtaggagacagagtcaccatcacttgccgggccagtcaggacattaacagttatttagtctaggtatcgagacaaaaacgaggaactaccctaagcctcctagatctagtcgttgcaactcctactttcgactaaaggttcgggtacccagtccgaaggttcagcggcagtcggatctagggactagtaacttcgacctataccaactaaacgtccaaggaccaacgtcccttagaccgtacgccttaaaggtaaacgttacgtttttacgacccgtttaaactttaagtttaccgtacggttaacctaacgttaacgttactttaaacgttaccggttaccccgtacttcgtaacgggttttaccggaaccgggtaacgggtaacccggtaagggttacgggtaacgtaaaccgttaaccggaaaaccccggttaaggtaccgggtttacggacccgtttacggtacccctaacggtttaacctttccgttaccggtttaaccccg

SEQ ID NO: 179581 - DNA, 570 bp, Homo sapiens
  misc_feature: GYAE6OF02HJ64H.13.87.H10.1.454.CMB.1.raw
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
tcagtcacgtactacacgaccggtgctcgatttagcagtactgcgttgggttaggggagtcagtcccagtcaggacacagcatggacatgagggtccccgctcagctcctgggctcctgctgctctggctcccaggtgccagatgtgacatccagttgacccagtctccatccttcctgtctgcatctgtaggagacagagtcaccatcacttgccggcagtcaggacattaacagttattagtctggtatcaagacaaaaaccgagggaaactcctaaagctacctagatctatgttgctatccactttgacgtaaagtcgggtacccagtacgtaaggttcaggcgacagtggatcgtaggacagattcactcncanatcagacgncctgcacgcctaggattatttgacctaatttattactacgactaacgcttacttaagttaccgttacccgcgttactagggttccgaacggggtacgggtacctaagggtacggaacggtacgtaaccaaaacgggacttacggaggtaccttacggaccctacgtagttccgtattacccg

SEQ ID NO: 179582 - DNA, 546 bp, Homo sapiens
  misc_feature: GYAE6OF02GMOZW.13.87.H10.1.454.CMB.1.raw
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaactcctaagctcctgatctatgttgcatccgactttgactaaaggtcggggtcccaagtcaaggttcaaggcggcagtggatcgnggacagatcactctcacatcagcagcctgcagcctagatntttgctaattattcngtacaatgtactttaatcgttacccgcttacgtacggtttccggacggtagggtacctagggtcggaaggtactaaccgaaacggtaacgttggttaggacgtacgcctaaccgtattaccgttgttacccg

SEQ ID NO: 179583 - DNA, 717 bp, Homo sapiens
  misc_feature: GYAE6OF02JGRL4.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggcagtcaggacattaacagttatttagtctggtatcagacaaaaaccgagggaaactccctaagcctcctagatctagttgttcgactactacctacgtttacgacgtaaaggttcggggtacccctaagtacgtaaacggttcaagggccggactaggtagggtacttaccggttaggggaactaaggttaaacttcccgtaaacttccgtaacaaaccgtaaacttaccgtaacggacctaaacggtcccgtacggtaccaacggtccctaaagggtaaacgttaggtttttaccgaaccttaaacgttttaactttaacgttacggtaacctaaacgtaacgttacctttaaacgttacccggtttaacccgtacttccgttaacgggtttacgggaccgggtaacggggtaaccgtagggttacggaacggtacttaacccgaaaggtaccgttggtaccggtactcggacctaacgtacttcgtagttacccg

SEQ ID NO: 179584 - DNA, 562 bp, Homo sapiens
  misc_feature: GYAE6OF02I8PXD.13.87.H10.1.454.CMB.1.raw
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (552)..(552): a, c, t, g, unknown or other
  misc_feature (552)..(552): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagacgtcaccatcacttgccgggcagtcaggacattaacngttattagtctggtatcagacaaaaaccgngggaaactcccaagctcctgatctatgttgcactccactttgactaaagtcggggtcccagtacaaggttcaggcggcagtggatcgtggacagtaatcacgtctacanaactctaagcacgccngcacgctagagtatttcgactaactttatactgtacaacgtgtacttaactacgttaccctcgttactacggtttccggacggtaacgggtaccaacgggtcggaacgtacgtaaccgaaacggtaacgtcggtacggacgttcgaccgaacgtactnttcggttacc

SEQ ID NO: 179585 - DNA, 806 bp, Homo sapiens
  misc_feature: GYAE6OF02GW652.13.87.H10.1.454.CMB.1.raw
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagttcgtgggggagcttggtacagcctggcaggtccctgagtactctcctgtagcagcctctggattcacctttgattgattatcgccatcgactacggttggggcccggacaacggtcctaccggaagggggtaacgggtcctagggtacgggttgggtaccttacggtaagggttatttagggttaggtaaagttagggtttagggtaaggctaaaggttacgggacttaagtcgggaccggtaacttccggtagggtaacggaacggggtcctaagtttacccaaccgttacgtacccgtaacccgtaaaggaaaccggaacccgtaaaacccggaccccgtaaaaacggttaaacccctttaccccgttaagttaaaccgttaccgtacggtaaacctaaaacgttacggaaaccgtcgtaacccgttaggaacggtaccggtacgtacgggaaaccggtaaccgtaaccgggttaccttttaggttaacgttttaaggttacggttaacgtaaacgtaaaaccggtccttaaacccccgttaaaccccggttttaagtttaacggtttttacgggaacggtttagggtttaaccgg

SEQ ID NO: 179586 - DNA, 548 bp, Homo sapiens
  misc_feature: GYAE6OF02F1GS4.13.87.H10.1.454.CMB.1.raw
  modified_base (266)..(266): a, c, t, g, unknown or other
  misc_feature (266)..(266): n is a, c, g, or t
  modified_base (336)..(336): a, c, t, g, unknown or other
  misc_feature (336)..(336): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcacatcacttgccggcagtcaggacattaacagtttattagtctggtatcagacaaaaaccgnggaaactccaagctcctgatctatgttgcatcctactttgactaagtcgggtccagtacaggttcagcgnagtgatcgtaggacagtacttcactcacacatcagcagcctgcagcctagatatttgactacttatactgtacactagtacttaacgtacgttacccgcttacgttacggttcggacgggttacgggtaccgtagggtacggtaacgtactaacgtaaaccggtacgttggtacggccgttacggaccctacgtaacttccgtatttacccg

SEQ ID NO: 179587 - DNA, 858 bp, Homo sapiens
  misc_feature: GYAE6OF02HBOFR.13.87.H10.1.454.CMB.1.raw
  modified_base (262)..(262): a, c, t, g, unknown or other
  misc_feature (262)..(262): n is a, c, g, or t
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctntggattcacctttgatgattatgccatgctacgtcggggtccggcaacggccgtaccggaaggggaaccgggccgtaggggacggttcgggtcttacgaagggttagtttacggttaggaaagttaggttgggtaagacgtaagtacggtacttaagtcggacgggtaaccttcggttagggtacgggtaaaccgggggtcccgttaacggtttacccgaaacccgttacgtttacccgtaacccgtaaagggtaaaccgaaacccgtaaacccgggacccgtaaaaaccgggttaacccctttaaccccggttaacgggtttaaccttacccgttaacgggtaaaccctaaaaggtttaccggaaaaccgtaccgggtaccccgttaagggtaacggtaaccgggttaccggtaaccgggtaaacggggtaacccgtaaccggggttacccgttttaaggtttaaacgttttacggtttaagggtaccggtaaaacgtaaaaccggttacccgttaaacccccgtttaaaccccggttttaacggtttaacggtttttttaacggggtaaccggttttacgggtttaaacccggg

SEQ ID NO: 179588 - DNA, 591 bp, Homo sapiens
  misc_feature: GYAE6OF02FYUNM.13.87.H10.1.454.CMB.1.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttcgacccagtcctccatccttcctgtctgcatctgtagganacagagtcaccatcacttgccggcagtcaggacattaacagtttattagtctggtatcagaacaaaacgaggaactcctaagcctctgatctatgtnctactcctactttgactaaggtcgggtaccagtcgaaggttcagcgtcaggtggactcgagggaactagtaacttcactctacaacaactcacgcacgtctaggcacggtcctagtaacgttatttacgaacctttaactttacttacgtgtaaccaaatacgttaactttaaacgtccgttaaccgtcgttaacgttacgggtttacggacggggtaacgtaccgtaagggtcggaagtaaccgtaacaaacggttcgttggacggtcacggtaccacctcttacgtcgttacc

SEQ ID NO: 179589 - DNA, 177 bp, Homo sapiens
  misc_feature: GYAE6OF02IGQ53.13.87.H10.1.454.CMB.1.raw
  modified_base (174)..(177): a, c, t, g, unknown or other
  misc_feature (174)..(177): n is a, c, g, or t
tcagtcacgtactacacgaccggtgctcgatttagcagtactgcgttgggtttgggggaagaggaagactgacggtccccccaggagttcaggtgctgggcacagcggccctgggctgcctggtcaaggactacttcctagtacgtgactgagcgggctggcaaggcgcatagnnnn

SEQ ID NO: 179590 - DNA, 633 bp, Homo sapiens
  misc_feature: GYAE6OF02I98ZD.13.87.H10.1.454.CMB.1.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (290)..(290): a, c, t, g, unknown or other
  misc_feature (290)..(290): n is a, c, g, or t
  modified_base (492)..(492): a, c, t, g, unknown or other
  misc_feature (492)..(492): n is a, c, g, or t
  modified_base (607)..(607): a, c, t, g, unknown or other
  misc_feature (607)..(607): n is a, c, g, or t
tcagtcacgtactacacgaccggtgctcgatttagcagtactgcgttgggtttggggagtcagtcccagtcaggacacagcatggacatgagggtcccgctcagctcctggggctcctgctgctctggctcccaggtgccagatgtgacatccagttcgacccagtcctccatccttcctgtctgcatcgtggtaggagacagagtcaccatcacttgccggcagtcagacattaacagtttattagtctgtactcganaccaaaacgngggtaaactcctaagcctacnggaactctagtgtcgactactccgttattgacgtaagtcgggtaccctatacgtaacggttcaggtcgtactaggtggtactggtacgggtaactaagactttacacgttcgtacaacctaactacgtaacgcctaacggtccctaaggtctaacgaccttaggaacgttaagttggttaaacgggtaatttacgtacgttntacgtaacgtagttacgtacggtcggtccgtacccgtaattcgttaacggtttacgggacgtacggtaacgtacggtacgacgtaacgaaggttaaccaacgggtactttcgggnttaccgacggtccgtactacggttac

SEQ ID NO: 179591 - DNA, 729 bp, Homo sapiens
  misc_feature: GYAE6OF02JTDPZ.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttggcttattttaaaaggtgtccagtgtgaagtgcagctggtggagtcgtgggggagcttggtacagcctggcaggtccctgacgactctcctgtgcagcctcgtggtacttcctacctttgattgtattatcgccatcgctacgtcgggtccgcaacgccgtaccggaaggggaacggccgtaggggacggtgggtacctacggtagggttacgtttagggttaggaaagttaggtgggtaacgacgtaaggtacggtacttacggtggtaccgggtacttccggtaggtacgggtaaacggggcccgtaacttaccgaaccctagttacccgtaccgtaagggaacgtaacccgtaaaccggaccctaaaacgggtaccccttcccgtaaggttacctacgtaccgaactaaaacgtcgaaaccgtacgtacccgtaggaacgacgtacgtacgggaacggaccgtaacccgggttacctttaggttaacgtttacggttaggtaacgtaacgtaaaaccggttccttaacccccgttaaacccgtttagttttaaacggg

SEQ ID NO: 179592 - DNA, 727 bp, Homo sapiens
  misc_feature: GYAE6OF02IXYJM.13.87.H10.1.454.CMB.1.raw
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtcctccatccttcctgtctgcatctgtagagacagatcacntcacttcgccggccagtcaggactattaacattatttagtctggtatcagaactaaaacgaggtaaacgtccaagctacngtaactctaacgtgttacgactacgtaccttacttacggaactaacggggttacggtacccctaattacgtaaacggtttaccgacggtacggtacgacggttacgggaacttcggtacggggaactaaacggttaaactttcccgaaccgtttaccgtacctaaacaaccgttaacgtaaccgggaacctcggtaccctacggtaaccgaccgttacggttaacgtaaacgttcgtttttaaccgaaacctttaagttttaacctacggtaaccttacgtaaaaccgtgttttaaccgttaacccttacggttaacccccgtgttaccggttaaacgggttccgaacggggttaacgtaccgtagggtacggtaacgtaactaaccggtaataccggtaggtcgtaccgtacgtacccgttacgacttcggtactttacc

SEQ ID NO: 179593 - DNA, 625 bp, Homo sapiens
  misc_feature: GYAE6OF02GM4T8.13.87.H10.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (501)..(501): a, c, t, g, unknown or other
  misc_feature (501)..(501): n is a, c, g, or t
  modified_base (519)..(519): a, c, t, g, unknown or other
  misc_feature (519)..(519): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtagganacngacgtcaaccatcacttggcccgggtcaggtcaggactattaacagttatttagtctaggtactcagacaaaaccgagggaaacgtcctaagctcctagactcttatgttcgctatcctactttcgacaaaggtcggggtaccctatacgtaaggtttcaacggcgggtaccaaggttggtacgtcgtacgggactaacggtaacttacgacttccgtacaactactcaacggccaacggtccttacggcaacgtccgtagaacgttactttacgacttaacttacttactagtactaacgntaacttagtacgttaccncgttactacggttacggacggtacggtaccgagggttggacgtaactaaccgtaaacgtaccgttaggttaccgacgtagtacccacgtaacgttcgtccgttacg

SEQ ID NO: 179594 - DNA, 628 bp, Homo sapiens
  misc_feature: GYAE6OF02GL434.13.87.H10.1.454.CMB.1.raw
  modified_base (199)..(199): a, c, t, g, unknown or other
  misc_feature (199)..(199): n is a, c, g, or t
  modified_base (270)..(270): a, c, t, g, unknown or other
  misc_feature (270)..(270): n is a, c, g, or t
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
  modified_base (519)..(519): a, c, t, g, unknown or other
  misc_feature (519)..(519): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttcgacccagtctccatccttcctgtctgcatctggtagganacagatcaccatcacttgccggccagtcaggacattaacagtttattagtctggtatcagacaaaaaccgngggaaactccctaagctacctagtactcgtatgttgctactcctacgttgacgtaaggtccgggtccctagtacgtaaaggttcgaggtccggactaggtaggacttcggtaggaactaagtaacttcgactctaacaactaatcganacgacgccgtgaccgacgtccgtaaggtaacgtttntttaccgaacttaactttacttacgtacgtaacaacgtacgttaacttaacgttaccgttacccngttaccgtaagggtttccggacgggtaacgaccggtaggtacggaacgtaactaaaccggaaacggtatcggtaacgccgttacgacctaccgttatccgtattacccg

SEQ ID NO: 179595 - DNA, 698 bp, Homo sapiens
  misc_feature: GYAE6OF02F4KIZ.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttcgacccagtcctccatcccttcctgtctgcatctgtaggagacagagtccaaccatccacttcggccggcagtcaggacattaacagttattagtctgtatcagaacaaaacgaggtaaactcctaagcctacctagacttctagtgttcgactactacctacgtttacgaacgtaaacgggtcgggtacccaacgttaccgtaaaggttccgacggaccgggtactacggtaggtacttcggtagggtaacgtaagtaacttaccgtaaccttccgtaacctaactaacgtcgaagtcaacgtccgtagacctacgaccgtaaggtaattacgttttacacgtttaaacgtttattacgtacgtacctaaacgtacgtaactttaaacgtaccgttaaccgcgttacgtaacggttcggtaacggggtaacggtaccggtaagggttggaaccgtaaacgttaaaccggtaaacggtaaaccgttggtaaccggttaccgtacggtaccccgtaaacgttcttacggttacgttaaccc

SEQ ID NO: 179596 - DNA, 747 bp, Homo sapiens
  misc_feature: GYAE6OF02GXSC1.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagcgtggtattttccttttggcttaattttaaaaggtgtccagtgtagtaagtgcagtcgtggtggtaggtcgtgggggagtcgttgggtacaggcccgtggtcgacggtcccgtaggtacggaccttcgtcccgtgtcgctacgtccgtcgtaggtacttcctacctttgaacgttgacttagtccggacctagttcgcgtacggttccgggtcccgacgtaaacggtcccgtaccgggaacggggtaacgggtcccggtagggtacggttcgggtctacggtaagggttaagttgggttacggtaaagtgggtagggtaacgtacgtaggttaacggtcgttacgtcggtaaccggttacgtagtaggttacggaacggggtcccgtaacgttaccgtaccgtacgttccgtaaccgtaaggaccgtaaacgtaccgaacctaaaccgtacgtcctagtactacgtacgactaaagtacgtaacaccgtcgtagacgacgtacgtacgaacgtacggtaccgtcgttagttaacgttagttacgtagtacccgtaaaacgtacctttaaccccgtaaccgtttagtttaacgg

SEQ ID NO: 179597 - DNA, 674 bp, Homo sapiens
  misc_feature: GYAE6OF02FYL6S.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttcgacccagtctccattccttcctgtctgcatctgtaggagacagagtccaccatcacttcggccggccagtcaggacattaacagttattagtctggtatcagacaaaaaccgagggaaactccgtaagctacctgtatctagtgtgctactcctactttgacgtaaagggtcgggtacccagtacgtaggttcaggcggtataggtgaacgtcgtagggaacaagtaattccacttctaaccacctactcagctaacgacgtacggaacctgaacgtctttagaccttttaacgtttacttcggttacgtacctaaccggtattacgggttaggtaaccgggttacccttaccggttaacccgtttacggttttaccggaccggtaacccgggggtaaacctaacgggtccggttaacgggactaaccggtttaaccgaaccgggttactaaccgggtttcggtaccgggtactacccgggtacccgaaccttcggttacccgttcggtttaccc

SEQ ID NO: 179598 - DNA, 679 bp, Homo sapiens
  misc_feature: GYAE6OF02GDM8Y.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggatttttccttttggcttattttaaaaggtgtccagtgtgaagtgcagctggtggagtcgtgggggagcttggtacagcctgggcacgggtccctgagactctcctgtgcagcctctggtacttcctaccgtttgattgaattttatcgccctatcggcctacggttcggggtcccggacaaggtccgtccggaaggggaacgggtccgtaggacggttcgggtcctcgtaagggttactttagggttggtaaagttaggttgggtagctaaggttaggcttagcggtaccggtacttcgtaggtaggtaacggggtcccgtattaccgaacctactacctaccgagaacggaaccgaaccgaccgaaacgaacctcccgtacgttaactcctacgacgtaaactacgaacgtacgcctaggaagacgacgtaggacggtaacgacggtaccctttaggttaacgtttagttaggacgtaacgaaaacgtaccctaaccccttaacccgttacgtttaacgg

SEQ ID NO: 179599 - DNA, 813 bp, Homo sapiens
  misc_feature: GYAE6OF02HV8DF.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccattccttcctgtctgcatctgtaggagacagagtacaccatcctacgttcggcccggggtaccaacggttacgaacgggtaactaaacgtttaaaaccgtagttttaattttaacggttcgttaggttaactaccgaaacggaaaccaaaaaaacccggaaggggaaaaccgtacccccgttaaaaggtccctttacgttacgtaagttaccgttaagtagggttacgactaacgttaaccgtaaaagggttttaaaaaacggtcggggttaacccctaagttaccggtaaaggttaccgaacgggtaccggtcgtaaggtaggacttacggtagtacaacgtaacgttaacttactaacgtttacctacgtaacctaataccgacgtacctaacgccgtacggacctaacgaccgttaaggtaaagtttacgtttaaccggaactttaaaccgtttaacgttaaccgttagtacggtaacgtaacgtaagttaaacgtagttaaacttaacgttcctaaccgtaaccttacccgtaacccggttaccggaccgtaacgggtacaaccggtaaggtaccggtaaaggtaaaccgttaaacggacgtacggtacggtcgtaaccggactaccgtaagttcccg

SEQ ID NO: 179600 - DNA, 615 bp, Homo sapiens
  misc_feature: GYAE6OF02HMDEU.13.87.H10.1.454.CMB.1.raw
  modified_base (242)..(242): a, c, t, g, unknown or other
  misc_feature (242)..(242): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtcctccatccttcctgtctgcattctgtaggagacagagtcacatcacttggccgggtccagtcaggactattaacngtttattagtctggtatcaagaccaaaaacgtaggtaaacgtacctaagcctacctagattactatgtgcatcctactttgactaaggtcgggtaccagtacaaggttcaggtacggcgtaggtaggtagtcgtacgggactaacggtaacttcacgttcctacgtaaccgtaatcgaaacgtccgaacgtcctacgacgacgtcctaggtaagttacttttacggacttaaacgtttactagtacgttaactaacgagttaacttaacgtcgtacctacgtacgtacggttcggcgtaacgggtactaggtggaacgagttaaccgaacgtagtcgtacggtacgtcgtaccgacctagtcccttacgttcg

SEQ ID NO: 179601 - DNA, 771 bp, Homo sapiens
  misc_feature: GYAE6OF02J005I.13.87.H10.1.454.CMB.1.raw
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
tcagtcacgtactacacgaccggtgctcgatttagcagtactgcgttgggtttgggggggagaggagccccagccctgagattcccaggtgtttccattcagtgatcagcactgaacacagaggactcaccatggagttgggactgagctggtattttccttttggtctaagttttaaaaggtgtacctagtgttgaagtgcagtcgtggtggagtcgtgggggagcgttggtacngcctggcacggtcccngacgctctctgtgcgacgtcctcgtcggtattccgtacctttaggactaggttaattacgtcggaccctatccggacgtaccggtcggggtcccggacaacggtcccgttaccggaacggggtaaccggggtccgtagggtacgtgggttacccgtggtaggttagttacggtagggtaacgtaggttcggggtaatccggtaagttagggtaccttaggtcggtacgggtaccttcggttaagggtacgggaacgggtaaccgtaccgtttaggaaccttaccgtaccgtaaccgaacgaacgtaaaccgaccgtaaccgaaaccggtaacctaccgttacttaacgtcctacggaactaacgtaccgtaacgacgtaccgttagaacggtaacgtccggtaacggaaccgggtaactaaccgggttctttagttacgttaagttacgttacgaacgttaacgtacctaacccgtttaacgtacgtttaggttttacggtaacgttcgtttaaacggg

SEQ ID NO: 179602 - DNA, 791 bp, Homo sapiens
  misc_feature: GYAE6OF02HLG9C.13.87.H10.1.454.CMB.1.raw
tcagtcacgtactacacgaccggtgctcgatttagcagtactgcgttgggtttggggctgggagaggagccccagccctgagattcccaggtgtttccattcagtgatcagcactgaacacagaggactcaccatggagttgggactgagcgtggatttcctttggctattttaaaaggtgtccagtgtgaagtgcagctggtggagtcgtgggggaggtcgttggtacgagccgtggcaggtcccgtgacgacttcctccgtgtcgcgacgccttcgtaggtacttccaaccgttttgaacttggtaatttacgtcggaccctagtcggaccgacgtttcggggtcccgtacgaacggtccgtaccggaacgggggaacgggtccggttagggaggttacggggtacccgtaggtaagggttaacgttttaagggtacggggttaaattaggggttagggtaacggtaccgtaaggttaaggtaccgtttaacgttcgggacccggttactttccggttagggttacggggtaaccggggtacccgtacgtttacccaaccgttaacgttacccgtaccggaaacgtacgaaacccgtaaacccgtacccgaaaaccggtaacccttacccgtacgttacctacctacgaacctaaagttcggaaacctacggtaccgtagacgtacgtccgtagaaccggaccgtaacggtccgtttaggttaacgttgttagtacgtaacaacgtaccgttaacccgtaacccgtttacgtttacgtttcggtaacgg

SEQ ID NO: 179603 - DNA, 820 bp, Homo sapiens
  misc_feature: GYAE6OF02GX6X6.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagatgagccagtctccgactcccaccctgtctgccgtctctcgggacgacgagggtccaccatctacgttggccgggactaaggtccaagaactgtttacggactaacttcttttaaattcggtaatcgtagcaaggtaacgtcgacgggacgaaccggaccccgtaacccgttcctacgtattacccggtaacggtaaccgtactaccccgtaacgttttcgacccgtaatacgggtacggggtacttaccccgtaagttacccgtaaagggtttaccagggttacgggacgttaaacggttaacgtaacttaccggttaacggggtaaaaccttacggttttaaaacccgtttttaccccggaaccttaacccgtaacgttaccggtaacgggggttacccttaacggacgtacccgttagggtaaacgtttcgtttaacggacccgttaactttaacgttaagtttacctaaccgtaacgtacggttaacgtttaaccccgtttacccggttacccccgggttacgtttaccccggaccggtaaaccgggtaccggtaaacgggtaacggtaaacaccggtaacgtccgaacgttccggtcggtaactcggtaaccacccgtgttccgtacgtttaccttatcctttaccggtcccctaacg

SEQ ID NO: 179604 - DNA, 670 bp, Homo sapiens
  misc_feature: GYAE6OF02F9Q8E.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctccaggtgccagatgtgacatccagttcgacccagtctccattccttcctgtctgcatctgtaggagacagacgtccaccatcacttcggcccgggacctagtacaggacctaattaactagtttattagtctaggtatcaagaacaaaaccgagggtaaactcccgtaagcctacctagtacttactagttgttcgctacttcctactttcgacgtaaagggttccgggtacccagttaccgtaaggttcaggccgagtaggtggtactcgtagggacctaagtaacttccacgttcctaacacgtaactacacgtcaacgtctacgccacgtccgtaaggtaacgtttacgtttaagacctttaacgtttaagttcctagttaacccaagtaacgttaacctttaagtaaccgtttccctacgttacgtaccggttcgggaccgggtaacgggaccgtagggtacgacgtaacgtaaccgtaaaacgtcgtacggtacggtaccgtacgtaccgttacctacgtttcgacgtttaccg

SEQ ID NO: 179605 - DNA, 650 bp, Homo sapiens
  misc_feature: GYAE6OF02FJUKD.13.87.H10.1.454.CMB.1.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (432)..(432): a, c, t, g, unknown or other
  misc_feature (432)..(432): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccaggatgtgacatccagttcgacccagtctccatcccttcctgtctgctatcgtgtaggagacagacgtcacctntcacttcggccggcagtcaggacattaacagttattagtctgtatnagaacaaaacgaggtaactcctaagctacctagactctagttgtcgactactacctacgttagacgtaacggtcgggtacctagtaccgtaaggtcgaggtcggtcgtaggtgtacgtcgtagggaactaacgtaacttccaccttactactaactaacgtcgagtaccncgtcgtacgacgtacgtaccgtagtaacgtttatttacgacctttaaagttcttacgtactaacctaacgtacgttaacgttaacgttaccgttacctacgttacggttacggttaccgggaacggaacgggtaaccggtaggacggtaacgtaacgtaaccgtaaacgtcgttacggtacggtcctacgtaccgtaaccgtcgtttactacgttacc

SEQ ID NO: 179606 - DNA, 681 bp, Homo sapiens
  misc_feature: GYAE6OF02I2A4H.13.87.H10.1.454.CMB.1.raw
tcagtcacgtactacacgaccggtgctcgatttagcagtactgcgttgggtttggggagctctgggagaggagccccagccctgagattcccaggtgtttacattcagtgatcagcactgacacagaggactcaccatggagttgggactgagctggtatttttccttttggcttattttaaaaggtgccctagtgtgaggtgcagctgggtggagtcgtggaggaggcttgatccagtccgtcggggggtccctgacgactctcctgtgcagcctcgtgggttccaccgtcagtcaccacctacatgacgtcgtcgggccgccgaggcctaccgaggggacgggcgtagggagtcgtcgttcttcttttatttatggttaggtgttaacgtactagttactccggcacggtaccgttccggagggtaccggggccgtaacgttctaacccgtaactcctaccgaaggaactacctaacttacccaaacgaacctacgtcctttacgttttacctaactaaagtacgaaacgcaccgttaggaagtacggtaccgtacgtacggaaccgtaccggttaccgttagttactttcggtacggtcggaacggaagggtacggtccgtcgggggaaccccctaagggtttaaaccttacccggtaacggtacttacgggtacggg

SEQ ID NO: 179607 - DNA, 829 bp, Homo sapiens
  misc_feature: GYAE6OF02JFCIF.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacaggaggactcaccagtggagttgggactgagtcgtggtactttttcctttggacttaagttttaaaggtgtctagtgtaggaagtgcagtcgtggtggtagtcggtggggggacgtcgttagggtacacggtccgtagggccgtacggtccccgtggaacgtaccttccgtccgtgtgcctagtacccctgtggtactttccctacgttgaattgtacgtttacgtggaccctgtaccgtccgtacgggttaccggggtccgtaccgtaacggtcccgtaacccggggtaaggggtaacggtccggttagggtaacgggttccgggttccgtacggtttaagggttcggttttaacgggttaaggtaaagggtttacgggtaggttaaccgtaggtaacgggttaacggttccttaaagggtccgggtaccctacggttcggttaaggggtacggtaaccgggtaccgtacgttaccgtaccgtaacgttcccgtaaccggaagtaccggaaccaacggtaccgtaaagtaccccttacgtagtaccttaggtaccgtaacgaaacgttaccgaaacggttcgtaccgttaacggacgtacgtcggtaacgtaaccgtacgtaccggtacgtttagtaacgtttagtacgttaacgaaccgtaaacgttccccgtaaacccggtttaccgtttaagggttacgg

SEQ ID NO: 179608 - DNA, 812 bp, Homo sapiens
  misc_feature: GYAE6OF02I6BI8.13.87.H10.1.454.CMB.1.raw
  modified_base (308)..(308): a, c, t, g, unknown or other
  misc_feature (308)..(308): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagagactcaccatggagttggactgagctggtatttttccgttttggtcttaagtttttaaaagggtgttaccagttgtagaagtgcagcgtggtggagtcggtgggggagtcgttaggtacgagtccgtggcgtacggttcccctggtaacgtccgtccgttccgtggtcgcacgtccctgnggtactttacctaccgttttgacttagtatttacgtcgtaccctacgttggacccgtaaccggttcgggggtaccccggacgaaaccgggttccgtaaccccggggaaagggggtaaccggggtaccgtacgggggtaacgggtttccggggtaccttacggtaaggttaacgttttagggttaggtaaacgttgggtacgggtaagacgtaagtacggtactagtcggtaccgacgtttcgtaggtacggaacgggtccgtaacttacccgaacctacgttaccgtaccgaaggtaacgaacccgtaaaccgaacccgaaaccgtaacccttacccgtaacgttactaccgtacgtaactaaagtcgaaccgtacgtaccgagtacggagtaccgtaggaccggtaccgtaccgggtttacttaacgtttacgtttaaggttcgtaacgttaaaccgaaaaccgttaccgttaacccccgttaaaccgtttaggttttaacgg

SEQ ID NO: 179609 - DNA, 761 bp, Homo sapiens
  misc_feature: GYAE6OF02IB65K.13.87.H10.1.454.CMB.1.raw
  modified_base (184)..(184): a, c, t, g, unknown or other
  misc_feature (184)..(184): n is a, c, g, or t
  modified_base (582)..(582): a, c, t, g, unknown or other
  misc_feature (582)..(582): n is a, c, g, or t
tcagtcacgtactacacgaccggtgctcgatttagcagtactgcgttgggtttggggggagaggagccccagccctgagattcccaggtgtttccattcagtgatcagcactgaacacagaggactcacatggagttgggactgagctggtatttttccgtttggacttaagtttttaaaaggngttccaaggttgtagtaagtcgacagctgggtggagtcggtgggggagtcttggtacagcctggccacgggtccctggaacgtcctcctacgtgtgccagtcctgttcggtactttacctacgtttggaattgtaatttcgagcctagtcgacgtacggtcggggtaccgacgtagtcgtaccggaggggtacggccgtagggcggtcggtactaggttaacggttagttacggtaaggtagttagggtacggtaagactaagttacggactttgggaggtacccgttagtaccggtaggtaaccggggtacggtaccgtacgttaccgaccttactccgaacgtacgtaacgaccgtaaccgaacgaaccgttaccgtacccgttagttacccgttntaacgaagtaacgtacgtaacgtacgtacgtagacgttacgcgttaaacgggccgtaacggtccgttacgtttaggttaagttacgttaacggtacgtaaaccgtaaaccgttcccttaaacccgttacccggtttaacggttttaaccggtttacgggttacggttacggttaacggg

SEQ ID NO: 179610 - DNA, 748 bp, Homo sapiens
  misc_feature: GYAE6OF02GMRLM.13.87.H10.1.454.CMB.1.raw
  modified_base (604)..(604): a, c, t, g, unknown or other
  misc_feature (604)..(604): n is a, c, g, or t
tcagtcacgtactacacgaccggtgctcgatttagcagtactgcgttgggtttggggggggagaggagccccagccctgagattcccaggtgtttccattcagtgatcagcactgaacacagaggactcaccatggagttgggactgggctggtattttccttttggcttattttaaaaggtgtccagtgtgaagtgcagctgggtggagttcgtgggggaggtcttgggtacacggtcctgggcgacgggtccctggacgaccttcctcctggtcgcacgcctctggtacttcctacctttgattgtaatttagtcgtaccctgtcgaccgtacggtcgggggttacccgggacctaacggtcccgtacccgggtaacgggggggaacggggttcccggtagggggtaacggttcggggttacccttacgtaaactttagtttaaggtcggttaccgttaggtcgggttaccgacccaacccgtaactaacgttaacgtaacgccaaacggtaccgtcccggtagggaaccgggtccgtacttacccgacctacgttcccgtaccgacggaacgaacctaaacgttacccgaaacgtaaaccncgtactagttactacgtagtactaaagtcgaactgtacgtagacgtacgtacgtacgaacggaccgtacgttcgtttagtagttcgtagtacgtaaccgtaaacggtttctagtttacgcgtaggtcggttaccgtcgttaccc

SEQ ID NO: 179611 - DNA, 605 bp, Homo sapiens
  misc_feature: GYAE6OF02H4OCZ.13.87.H10.1.454.CMB.1.raw
  modified_base (296)..(296): a, c, t, g, unknown or other
  misc_feature (296)..(296): n is a, c, g, or t
  modified_base (497)..(497): a, c, t, g, unknown or other
  misc_feature (497)..(497): n is a, c, g, or t
tcagtcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtcctccatccttcctgtctgcatctgtaggagacagagtcaccatcacgttgcccgggtccaggtcaggactattaacagtttatttagtcttggtatcaagaacaaaaccagggaactcctaagcctcngtatctatgtgctactcctactttgacaaaggttcgggacctagtacgaaggttcacggtcgctaggtggaagtcgtagggacctaagaacttccgactcgtacacgtatacagccaagtcctgacgtacaccgtagaagttatttcgtacctaactttattacgtacgtaacaactagtaacgtttaataccgttaccgnttacgtaggttcgggaacgggagggtaaccgtagggtggaacgtaagttaaccggaaagttacgtacgtacgggtacggtacacccgtacgtaccttcttagttaccc

SEQ ID NO: 179612 - DNA, 725 bp, Homo sapiens
  misc_feature: GYAE6OF02ILW5G.13.87.H10.1.454.CMB.1.raw
  modified_base (376)..(376): a, c, t, g, unknown or other
  misc_feature (376)..(376): n is a, c, g, or t
tcagtcacgtactacacgaccggtgctcgatttagcagtactgcgttgggtttggggagtcagtcccaaccaggacacagcatggacatgagggtccctgctcagctccgtggggctcctgctgctctggctctcgaggtcgccagatgtgacatccagatcgacccagtcctccactccctccctgtctgactatcgtagtaggagacagtacgtcaacctatactacgttgaccgaggcgagtacgaacggaactaacttaaactaaacttaaatttaaagttacggttaataccgtaagaacgaaacggtaaaaccgaaacggtaaaccgtaaccccttaacggaccttaccgtagtaacttaccgaacgtanacgtactactaacgtaaacgttacggaaaacgtacgggtaacctaagtaacgtaacggttacgaaaggtaacggtaaggtacggtaagtaccggttaaggtaaccgtaaacggttttaaccgttttaaactttaaccacgtaacttacgaaacggctacgactacgtacgacgtacgtaggaatagttaactcgaacaatataccttagtacgacatacgaagtactaataacgtactaccgacctaatccctaaccggtaccgtaacgaaacggtaacgacggtaacggtaaggtaacggtaaacttaaaccggtacgtacggtacggaacttaccgggtactaaccg

SEQ ID NO: 179613 - DNA, 858 bp, Homo sapiens
  misc_feature: GYAE6OF02IQWNW.13.87.H10.1.454.CMB.1.raw
  modified_base (202)..(202): a, c, t, g, unknown or other
  misc_feature (202)..(202): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtncagctgggtggagtcgtgggggagtcgttggtacaggccgtggcgacggtccctgacgacctccgtccgtgtcgcacgtccctcgtggtacttccgtaccgtttgatgtatttacgtcgaccattcgctaccggtcggggtccgcgaacgcctaccggacggggacggtccgtgggtaggtcggtaccgtacggtaagggttaacgtttagggttagggtaaagtttacgggttacggttaacggtacttaacgggttaagggtaccgttaaggtaccggggtaccgggtaccgttacggtttacggggttaacgggggtaaaccgggcccgtttaacgtttaccccgaaccgttaacgttacccgtaaccccggtaacgtaaaccgggaacccctaaacccgggaaccccctaaaacggtaacccccgttttaccccgtagttaaccgttaacgttacccggtaaaccgtaaaacggttccggaaaccctacgggttacccgtaggtaaaccgggcgtaccgtaacggggtaacggtaccccgggttaacggttaccccgttttaggtttaaaccgttttggtttaacgacgggtttaaaccctaaaaggttacccctttaacccccggttaaaccccgttttaggtttaacggg

SEQ ID NO: 179614 - DNA, 719 bp, Homo sapiens
  misc_feature: GYAE6OF02F5XFK.13.87.H10.1.454.CMB.1.raw
  modified_base (224)..(224): a, c, t, g, unknown or other
  misc_feature (224)..(224): n is a, c, g, or t
tcagtcacgtactacacgaccggtgctcgatttagcagtactgcgttgggtttggggagtcagtcccagtcaggacacagcatggacatgagggtccccgctcagctcctggggctcctgctgctctggctcccaggtcgccagatgtgactactccagttcgacccagtcctccacttcccttcctgtctgcattctaggtaggagacgagtacgtccacctntccgtacgttcggccgggtccagtcgaacggactattaacagtttactttagtctaggtactacaagaaaccgtaaaaaccgaagggaaaccgtaccctaaagtcctacctagtacttcctaagttggttcgactacttaccttacgtttacgaacggtaaacgggttccgggaccctacgttacgtaacggttcgacgggcgtacgtaggtagacggtacggtagggaactaacggtaacttaccgaccttaccgtaacaactaacgtacgaacgtacgaccgtccgtacggtaccacgggtaccctaaggttaacttagtttaacaccttaacgtttattaccgtacacctaagtacgtaactttaagttaccccgttaccgactttacggtacggtttacgggaacgggtacgtacgggtagtacggtactaacggtaacgaaaccggtagtacggtacggactacgtaccaacgttctaccgttagtttcc

SEQ ID NO: 179615 - DNA, 819 bp, Homo sapiens
  misc_feature: GYAE6OF02GOKZ4.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctcatccttcctgtctgcatctgtaggagacagatcaccatcacttcggccggaccagtcaggacattaacagttatttagtctaggtatacagaacaaaaaccgagggaaacgtccctaagctacctagtactacttattggttcgacgtacttcctaacttttggaacctaaacgggttcggggttaccccaagttaacgtaacggttacgacgggtacgggtactaaggttagggtaacgttacggtacgggtaaactaacggtaactttcccgtaaccgttcctaccgtaaacgtaacgtcctaaacggtcctaaacggtccctacggtacctaaccggttaccgtaaggtaaaccgtttacgtttttaccggaaaccgttttaaaacgtttttacgtttaaacccgtaggtttttaaaccctaaacggtaaaccggtttacttaaacccggttaaacctttaaggtttaacccgttaccggggtttaacggggttaccggtttaacccgggaaccgggttaacgggtaaacccgtaaggggttaaccggttaaaacgttaaaacccgtaaaccggggttacgtaacgggtttacggaaccgtttccggaaaccctttaccgggtactttaccgggttacctttaaccg

SEQ ID NO: 179616 - DNA, 721 bp, Homo sapiens
  misc_feature: GYAE6OF02HTWKC.13.87.H10.1.454.CMB.1.raw
  modified_base (119)..(119): a, c, t, g, unknown or other
  misc_feature (119)..(119): n is a, c, g, or t
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
tcagtcacgtactacacgaccggtgctcgatttagcagtactgcgttgggtttggggagtcagtcccagtcaggacacagcatggacatgagggtccccgctcagctccgtgggctccngctgctctggctccgaggttcgccagatgtgacatccctaggttcgacccagtctccatccttccngtctgcatctaggtaganacgagtcgtacacgtactcctactggccgggccagtcgaggactatttactatttattagtcgtaggtactgacgaacaaaacgaggaaactcctaatccncctgacttcgttatggtctctactaccgttactttacggacgtaacgggtacggtacctacgtaccggtaacggtttcgacgggtacgngttacggacgtagtacggacgggtanaagttaacttcctaacgacgtacaacgtaccagacgtacgtacgtcgtacgacgtaccgtacggtacgttacgtttaagtttaccgtaactttaacggtttaccttaacgttcgttaaaccaccgttaagtttaacccgttaaggttacccgttacccgtacgtttaccgggttagggtttacccgggcggtaacggggtaaccgttcgggggttaacaacgggtaacgttaaccggtaacggttaacgggtacgttggaccggttaccgacccgacgtttcccgttacttaccggtttacc

SEQ ID NO: 179617 - DNA, 764 bp, Homo sapiens
  misc_feature: GYAE6OF02IP1WD.13.87.H10.1.454.CMB.1.raw
  modified_base (140)..(140): a, c, t, g, unknown or other
  misc_feature (140)..(140): n is a, c, g, or t
  modified_base (548)..(548): a, c, t, g, unknown or other
  misc_feature (548)..(548): n is a, c, g, or t
  modified_base (606)..(606): a, c, t, g, unknown or other
  misc_feature (606)..(606): n is a, c, g, or t
tcagtcacgtactacacgaccggtgctcgatttagcagtactgcgttgggtttggggagtcagtcccagtcaggacacagcatggacatgagggtccccgctcagctccgtggggctcctgctgctctggctccaggtcnccagatgtgacatccagttcgaccctagtcctccacttcccttcctggtctcgcctatctaggtaggaagacaaggtacctccaaccactaccgaccgttcggaccgggaccacgtaccgaacggtactaacgtttaacctaggttttaactttgtacgtggtaactacgaacggaaactaaaaaccggagggtaaacctacccgtaagtccttaccgtagtaacgttcttacgtggttacgacctacgttaccctacgtttaacgaacgttaaaacggggtccggttaacccctagtaaaccggttaacggtaccgacgggtccgtaaggtacgggtgtaccgtaacggtacggaaacgtaacgtacgtttaccaaccgtttatacacctagtaccagcgcgtaccngaccgtagtactacgtaagttactttacgacttaacgttacgtaataccgtaactaanaagtaacctcgtaaacttagtaccgttacgtaaccggttccggttaaccggaacggttaaccggaacgtaacggttaacggaaaccgttaaccgaaaccgggtaacgttcggtagtacccggttacacccgttaactaacggtccttacggttaaccc

SEQ ID NO: 179618 - DNA, 674 bp, Homo sapiens
  misc_feature: GYAE6OF02HXTWJ.13.87.H10.1.454.CMB.1.raw
  modified_base (288)..(288): a, c, t, g, unknown or other
  misc_feature (288)..(288): n is a, c, g, or t
tcagtcacgtactacacgaccggtgctcgatttagcagtactgcgttgggtttggggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttgggtacagcctgggcagggtccctgagactctcctgtgcagcctctggattcacctttgatgattangccatgcactgggtccgcaagctccgagggaaggcctggagtgggtctcgaggtattaggttggaataggtggtagcaataggctatggcggactcgtggtagaacggggccgatttccgaacctattccctaccgaacggtaacgaaccgtaaaccggacccgaaaacgtaacccgttccccgttacgttaacttacccgtaggaaccctaaaagtaccggaaacctacggtacccgtaggacggacggtaccgtaggaacggaccgtacccggttccgtttaggttaacgtttagtttacggtagtaaccgttaaaaggtaccttaacccgtaaccccgtttaacggttaacgttttttacgggacggtttaggtttaaaccgg

SEQ ID NO: 179619 - DNA, 777 bp, Homo sapiens
  misc_feature: GYAE6OF02GQWVP.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctccgtggggctcctgctgctctggctcccaggtgccagatgtgacatccagttcgacccagtctccatccttcctgtctgctatcgtgtagacgacgagtacgtaccaccgtatccgtacgttcggcccggtccagtccgaaggtactaacgttaaactagtttacgttagttcgttaggtactcgaacgtaaaccgaaaaaccgtaagggtaaaccgtcccgtaacgtccttaccgtagtacgttacttacgtcggttcacgtaacttcccgttacgtttcgaaaccggtaaacgggttcccgggtaacctacggttaccgtaaacgggttaccgaacggtccggacgtacgggtacggtaacgtcggtaacgggtaaactaacggtaacttccgaacgtttaccgtaaccaaccgtagtacccgaaggtcgaacctccgtacgtacgacctaccggtaagtaaacgtttgtttaccgaacctttaaaccgtttagtaaccgttataaccggaaacgttaacgttaaccgtttaacgttacccgtaacccgttgtttaccgtacgggttacgggtaacggaaccgggaacggtaagggttccgaacggtaacgtaaccgtaaaccggttacgggtccgtacacggtacctaacggtacttcgacgttcc

SEQ ID NO: 179620 - DNA, 976 bp, Homo sapiens
  misc_feature: GYAE6OF02HI0U9.13.87.H10.1.454.CMB.1.raw
tcagtcacgtactacacgaccggtgctcgatttagcagtactgcgttgggtttgggggagtcagtcccagtcaggacacagcatggacatgagggtccccgctcagctcctggggctcctgctgctctggctcccgaggtgccagatgtgacatccagttgacccagtctccatccttcctgtctgcatctgtaggagacagacgtcacctatcctacgttcggcccgggtaccaggtacgaggactaattaacgtaagttttaacgtttaggtcgttaggttactacgaacgtaaaaccgaaaaaaccggtaagggtaaaaccgttacccgtaaaggtacccttaccgttaagtaccttacttaacgtttggttacgaccttaaccgtttacccgttaacgttttacggaaaccggttaaacggggttacccggggttaacccctaaacggtttaaccggtaaccggtttaaccggaacggggtaccggtacggttaacgggttagggtacggtttacgggtacggggtaaaccgttaaaggtaaaccttttaccccgtaaacctttcctaaaccgtaaccgtaaacgttccgggaacgtaaccgtaacccggtaccgtccggtaacgtaccggtaacccgttaaagggttaaacgttttacttttaaccgggtaaaccgttttaaaccgttttaccttttaaccgggtaccttaaaccttaaaggttaacccgttttaaaaccgtttaaaccggttttaaccccggtttaccccttaaccggtttttacgggtttaacccgggtttaaccgggggaaacggggttaacccggggttaaacggttacgggggttaacgggtaaacgtaaaccgggttaaaacccggtttaaaaccggttaacggtcccggggttaaggtaccctttacgggaaccctttacccggtttaacggtttaccgttccgttttaacccg

SEQ ID NO: 179621 - DNA, 795 bp, Homo sapiens
  misc_feature: GYAE6OF02GG5IG.13.87.H10.1.454.CMB.1.raw
tcagtcacgtactacacgaccggtgctcgatttagcagtactgcgttgggtttggggagtcagtcccagtcaggacacagcatggacatgagggtccccgctcagctcctggggctcctgctgctctggctcccgaggtgccagatgtgacatccagttcgacccagtctccatccttctgtactgccatctgtaggagacagagtcaaccgtatcacgttacggcccgggcctagtcgaaggactaacttaactagtttaatttgtacgttggtactcgaagtaaccgaaaaaccggagggtaaacgtaccccgtaagtcccgttaccgtaggtacttacgttacgttggttacggacctaacctttacccgttacgtttacggtaacggtaaacgggtttcccggggtacccttaaaggtaccggttaaacgggttaccggacgtccggggtaacgtacggggtaggttacggtaccgggtaaggggaactaacgggtaaacttaccgtaaccttacgtaacccgtaagtaaccgttacgaacgtaacgtacccgtaccggacgtaccgacgtcccttaaagggttaacgttacgtttacgtaaccgttaacttacgttacgtactacgtaacgtacgttaactttaacgttaccgtaccttacgttccgttacggttccgggaacgggtaaccgggacgttagggtacggtaacggaccgttaaacgtaaccgggaccgttaggtaccggtacgtaacggacctaacccggtattacgttaccggttaaccc

SEQ ID NO: 179622 - DNA, 719 bp, Homo sapiens
  misc_feature: GYAE6OF02JZTOA.13.87.H10.1.454.CMB.1.raw
  modified_base (102)..(102): a, c, t, g, unknown or other
  misc_feature (102)..(102): n is a, c, g, or t
  modified_base (691)..(691): a, c, t, g, unknown or other
  misc_feature (691)..(691): n is a, c, g, or t
  modified_base (703)..(703): a, c, t, g, unknown or other
  misc_feature (703)..(703): n is a, c, g, or t
tcagtcacgtactacacgaccggtgctcgatttagcagtactgcgttgggtttggggagtcagtcccagtcaggacacagcagtggacatgagggtccccgntcagctccgtggggctcctgctgctctggctcccagtcgccagatgtgacatccagttcgaccctagtctccatcctaccgtgtctgcctatctgtaggacgacacgtagtccaccagtccacgttacggccgggccaaggtaccgacggtactaacttaaccgtaagttttacttaagtccgtaggttactacaacggaaactaaaaccggtagggaaaccttacccgtaagtcctacccgtagacgttacttacggtcgttacgaccgttacttacccgttagtttacgacccggttaaagggttccgggtaccagtacgtaaagtcgaacggtcgtacgtaggtccggacgttacggtaacgggaataacgtacgtttaccacgtcgtaactactaacgtcgtacggacctacgtcgtacgactacgtactaccgaaagttccgtttacgacttaacgtttagacccttaacggaccttaaagacccgttaattaaccgtttaccggttacccttagtaaccgggttaccgtcgggtaaacgggacgtaacggtacggtagtaaccgacgttaacggattaccggngtcgagtcctancggttactagtcgtac

SEQ ID NO: 179623 - DNA, 898 bp, Homo sapiens
  misc_feature: GYAE6OF02H2I8T.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgaacacagagactcacatggagttgggactgagtctggtacttttccgtttggactttaatttaaaggtcgtacctaggttgtaggtaagtgactaggtcgtaggggtcggaggttcgggtaggggggcggtacgttacgggtacgacggtccggttacggggacgtcgggttacccgtaggaacggtacccttccgttccgttgggtacgtaccgaacgggtttccccgtacggttggggttaacccttttaccgtaaccggtttttaggaaccgttagttaagtttaagttcccgggtacccctaaaggttctacccggtaacgggtcgggttaccccggaagtaacggtacccgtaaccggggaagggggttaacggccggttacgggggtacgggttcgggtaaccgttcggtaaaggggtttacgtttaacggggttaaggtaacgttaaggggtttggaaacggtacgtaagtttacgggtctttaacgggcgggtaacccgttagtttacgggtacgggtacggggtaaccgggtaccgttaacgtaccgtaccgttacggtacccttacggaacgttaacggaaacccgtaaccgaaacccgtaaccgtaaaccgtccgttaaccggtacgttacgaacctacgtaaaccggttaacgaaccgtgaaccgtacgaaagtccgtaggacgtaccggtacggtccgtacggtttactaagttacgtgaacgtacgtaaacgttcctaaacccgttacgttaacggtttaacgg

SEQ ID NO: 179624 - DNA, 738 bp, Homo sapiens
  misc_feature: GYAE6OF02HFUTZ.13.87.H10.1.454.CMB.1.raw
tcagtcacgtactacacgaccggtgctcgatttagcagtactgcgttgggtttggggagctctgggagaggagtccccagccctgagattcccaggtagtttccattcagtgatcagcactgaacacagagactcaccatggagttgggactgagcgtaggtacttttccgttttggcttaattttaaaaggtgtaccgagttgtcggtaagtcgacagtcgtggtcgggtagttacggtgggggacgtccgttaggtaccgacggtcccgtaggccgttacgggttaccccgtgtacgtaccgttccgttcccgtaggttccgacgtacggacccgttcgttacggtactttaccgttaccctttagacgtttacgtagttaaccttcggaccctagtacgctaccggttcgggccgacgacgttccgtacggacggggtaaccgcggttcggtaggtcgggttactacggtaaggtttacttagggtaacggtaacgttgggtacgtataccgtagtaggtcctagtacggtcgtacgtcggtgacggtacggaccgttagtacaccgtactacgacgtacacgtacgaccgacaacgtcctacgtactagttcctagaacctagtcgaaacgtcgtaccggtacgacggactacggtcgaacgttcgaccgtctttacgttaaggttcgttaagtacgactaacggtacctaccccgttaccgttagtttaacgg

SEQ ID NO: 179625 - DNA, 735 bp, Homo sapiens
  misc_feature: GYAE6OF02H1Q9Y.13.87.H10.1.454.CMB.1.raw
  modified_base (155)..(155): a, c, t, g, unknown or other
  misc_feature (155)..(155): n is a, c, g, or t
  modified_base (332)..(332): a, c, t, g, unknown or other
  misc_feature (332)..(332): n is a, c, g, or t
  modified_base (491)..(491): a, c, t, g, unknown or other
  misc_feature (491)..(491): n is a, c, g, or t
tcagtcacgtactacacgaccggtgctcgatttagcagtactgcgttgggtttggggagctctgggagaggagccccagccctgagattcccaggtgtttccattcagtgatcagcactgaacacagaggactcaccatggagttgggactgagngtggtatttttccgttttggcttaattttaaaggtgtccagtgtgaagtgcagctgggtgagtcgtgggggagtcgttggtacaggcccgttggaccgtacgggtccctaggacgtccttcccttcgtaggtcgaccgtagtccccttcgtagggttcctttacccgtcttttaggnttacggttatttacgcgtacctagttcgccgtacggtcgggtcccacgacgtcctccggaaggggtacggcctaggggtcgtcgggtcacgtaggttactttaggtagggtaattcgggtaggaactcgtaaagttgggaccgttagtcggaaccggtnttcggttacggtaggtagggtacccccccgttagtaccgtacctacgtacctccgtaacgacgtaaccgtacccgaactaaccgtacctacctacggtactccgtagtacaaacgtacgtaccacgtccggtaacggcgtacgtacgtacgaaccggtaccgtaccgttccgttacggttatttacggtgtaaccgtaactaaaccgttaacccgtaacccgttacccgtttacgtttaacggg

SEQ ID NO: 179626 - DNA, 624 bp, Homo sapiens
  misc_feature: GYAE6OF02GFW6Z.13.87.H10.1.454.CMB.1.raw
  modified_base (363)..(363): a, c, t, g, unknown or other
  misc_feature (363)..(363): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagtcacgtactacacgaccggtgctcgatttagcagtactgcgttgggtttgggggagtcagtcccagtcaggacacagcatggacatgagggtccccgctcagctcctggggctccgtgctgctctggctcccaggtcgccagatgtgacatccagttgacccagtcctccatccttcctgtctgcatctggtaggagacagacgtcgaccatccacttggccgggccagtcaggactattaacagtttattagtctggtatcagaccaaaaacgagggaaactccctaagcctaccagatctatgtgcatcctactttagactaaggttcgggtacccagtacgtaaggttcagcggtnaggtgacgttacgaggtataaggtaacttcaccgttcactaactagtaccganacgtancctgtacctaggtcctaagtacgttagtttacgaccttaacgttacttacgtcttaaccaacgttacgttacttaaacgtccggttaccctcgttacgtacgggtttcccggaacgggtacgggtaaccgtaggtacggaaccgtactacggaaaccggtccgtggttacgcccgtagaccctaaccgctagttcgttaccg

SEQ ID NO: 179627 - DNA, 741 bp, Homo sapiens
  misc_feature: GYAE6OF02GTEHC.13.87.H10.1.454.CMB.1.raw
  modified_base (208)..(208): a, c, t, g, unknown or other
  misc_feature (208)..(208): n is a, c, g, or t
tcagtcacgtactacacgaccggtgctcgatttagcagtactgcgttgggtttggggagtcagtcccagtcaggacacagcatggacatgagggtccccgctcagctccgtggggctcctgctgctctggcctcccaggtcgccagatggtagacatccagttcgaccctagtcctccacttcccttcctgtctgctatctgtagganacagatcacatcactggccggacagtcaggactattaacagtttatttagactaggtactacgagtaaacgaaaaaccgtaagggaaacttaccctaaacggtccttacccgtagtaacttacttattcgtacgacctactcctacgtttcgaacgtaaagggtccgggtacctactacgtaaggtcgaggcgtagacgtagacgtaggtggaactagtaacttccgtaacttccaacgaacctaaagtccgtaacgaccgtaacgtcccgtacgtaccgacgttaccgtaagggttaaacgttacgtttacggtaaccttaactttacgttaaccttcgtaaccgtaaacgttacggttaaccttaaaccggtttaccttaacccggtccgttttaacgttaccggggtttacgggaaccggttaacggggaacccggttaagggtacggtaacgaaccgttaaacggtaaaccggtaacgttaccgggacggttacgttaccgaccgtaaccgtctacggttacccttacg

SEQ ID NO: 179628 - DNA, 801 bp, Homo sapiens
  misc_feature: GYAE6OF02HQ2O4.13.87.H10.1.454.CMB.1.raw
  modified_base (460)..(460): a, c, t, g, unknown or other
  misc_feature (460)..(460): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
tcagtcacgtactacacgaccggtgctcgatttagcagtactgcgttgggtttgggggagtcagtcccagtcaggacacagcatggacatgacgggtccccgctcgagctccgtggggccttccctgctgctcgtcggacctcccgaggtcaccagtactgtagacacgtccctaaggttccggaccctagttccctacctacctttccctttaccgttggtcctagtccgtacttccgtaggttaggaacgaccggtagtactaccaacctacgtaccttaagtccggaccgggtaccacggtaccaaggtacctaagttaacgtaatttagtttacgtcgttacggtatcgaaagtaaccaaaaccggtagtaaccgtcctaagccttacacgtacgtacttagtctacgtcctactccgtagttaccggagtaacgtcggtacagtacgtagttacncggacgtagtcgtaagtcgacgtcgaactatactccacttgaacgacataccgnggtacncgtactcggaccgtacgtcgtaacgttagttaggttaaccctagttaaattttaccgtaacggctttaaaccgacgttaaacgtttaccgtttaacccggttaaacccgttccggtttaaccttaaccggggtttaaccgggtttacggaacgggtttaaccggttaacggggacgttaccggtaagttaaacccgtaaccgttaacccgggtaacgtttccgtacggtaccggtaaccggttaccgtaaaccgtttccgttacgttacccgttttaaccc

SEQ ID NO: 179629 - DNA, 1018 bp, Homo sapiens
  misc_feature: GYAE6OF02G88WB.13.87.H10.1.454.CMB.1.raw
tcagtcacgtactacacgaccggtgctcgatttagcagtactgcgttgggtttggggagctctgggagaggagccccagccctgagattcccaggtgtttccattcagtgatcagcactgacacagagactcacatggagttggactgagctaggtattttccgttttggacttaagttttaaaaggtcgtacctaggttgtaggaacgttgcgtaggccgttgggtggaggttcgtagggggagtcgttggtacaggccgttggcctacggtcccctaggacgtaccttccgttccgttggtcggtaccgtcggtccccttacggtacggtacttttaccgtaacccgtttttggaagtttacggtaagtttaccgttcggaaccctcggttacggtacccggtaaccggttaccgggggggtaccccgtaaccggtaacgggttccccgtaaacccgggtaaaagggggtaaccgggggttcccgttaacggggggtacgggttaccggggttccgttaacggtaacggggtttaaggttttaacggttaggggtaacgtttaagggttaacgggtacgtaacgtaaggttaaacggacgtttaggccgggtttaccgtacgtcgttaacggggtacgggtaaaccgggtcccgtaaacgtttacccgaaccgttaccgttacccgtacccgaaacggtaacccgaaacccggttaaaccccgaacccgggaaaaccgtttacccccttacccggttaaggttccccttaagggtaaccgtaaccgtaaaagtttacccggaaaaccgtttccgggtaaccccgttaaagggtaaaccggtacggtttaccgggaaaccggttacccgggggaaaccgtttcccccgggttttaaggtttaacggttttaaacggtttccggtttaaacgtaacggtaaaaccccgttaaaccgggtttacccccttttaaaccccccgggttttaaacccggttttaacgggttttttaacgggg

SEQ ID NO: 179630 - DNA, 798 bp, Homo sapiens
  misc_feature: GYAE6OF02I57OM.13.87.H10.1.454.CMB.1.raw
  modified_base (451)..(451): a, c, t, g, unknown or other
  misc_feature (451)..(451): n is a, c, g, or t
tcagtcacgtactacacgaccggtgctcgatttagcagtactgcgttgggtttggggagtcagtcccagtcaggacacagcatggacatgagggtccccgctcagcctccgtggggctcctgctgactctggcctcccgaggtcaccgagtagtgtcgacatccgtaaggttcgaccctagttcctaccgtactccctcccgttgtctcggtactacgttcgtacggtaacggacgacgtaacggtacctcctaaccgtacttcctaccgttacggacccgtagggtaccgtaacggttaccgaacggtaacttaacgttaaaccgttaaaaccgttttaagttttaaaacgttcggttaacgttacgtaaccggtaaccgtaaaccggaaaaccggttaacggtaaacccggtaaccctaacggtacctacggtacgtactacgacgtanacgactacgtacttagtacgacgtcggacctagtacgtagtactaaggtacggtaacgtcgttacggtaccggtaggtaacttaacgtttacgttttaccctaccgaaccgtttgaaccgtaggtaccacgttcgacggtaccgacgttacgtacgaacgttacttacgtacgaacttacgttacttacgttaagcgtaccgtaatcggttaattaagttaccacgtttacctaccgtaccgttacctcccggtaacgttaccgaacggtacgtaaccgtcggtataaaccgggtattaaaccgttaacgacgttcgacgaccgtaccggtacctacgtccgttacg

SEQ ID NO: 179631 - DNA, 909 bp, Homo sapiens
  misc_feature: GYAE6OF02IQICE.13.87.H10.1.454.CMB.1.raw
tcagtcacgtactacacgaccggtgctcgatttagcagtactgcgttgggtttggggagtcagtcccagtcaggacacagcatggacatggacgggtccccgctcagctccgtggggctcctgctcgctctggcctcccgaggtcgaccgaggtatcggtacgactactccgtagttacggacccctagttccctacctacctttccctttacctcgttctcggtctacttcggttaggtaacgggaacgtaccgtaggtaacctacctaacctacgttaccgtaccgttcgggcccggggaactaacggtccgtaacgggtacttaaacggttaacgtaaaaggttcggtaacgtttaacggcgtttaggtaactaccgtaaacggtaacgaaaaccggtaaacccggaaaccgggtaaacccgtaccccgttacggtaccttacgttacgtacgttagttacgtacggtacgtacctaacgttaaccgtaaaggttaacggtccggttacagttaacgtacggtacgacggtacgagttacggtgtaccgtcgacgtacgacgtacgttactacgttccttaccggtaacctaccgtagtaccgtaccgacgtaccgtaccggtacgtaccgtaccggttaacgttaaacgttacgtttacgttttaaccttaaccggttaaaccgttttaccgtttacgttaaccgttcgtaaaccgtaacgttaacctacctttaaacgttacggtttaaccgttcccgggttaacggtacccgggttaaccggtaaccgggtacgaaccgggttaacggtaacggtaaccgttaacccggtaaacggttacggtacccggtttagggaaccccttacgggtaaccccgttaagttaccgttaccggtttacccg

SEQ ID NO: 179632 - DNA, 684 bp, Homo sapiens
  misc_feature: GYAE6OF02JHTFJ.13.87.H10.1.454.CMB.1.raw
  modified_base (103)..(103): a, c, t, g, unknown or other
  misc_feature (103)..(103): n is a, c, g, or t
  modified_base (651)..(651): a, c, t, g, unknown or other
  misc_feature (651)..(651): n is a, c, g, or t
  modified_base (659)..(659): a, c, t, g, unknown or other
  misc_feature (659)..(659): n is a, c, g, or t
tcagtcacgtactacacgaccggtgctcgatttagcagtactgcgttgggtttggggagtcagtcccagtcaggacacagcatggacatgagggtccccgctnagctcgtgggctcctgctgctcgtggcctcccgaggtcgacagtatgtagacactccgagttcgaccctagttcctcctattcccttcctgtctcgctaatcgtaggtaggacgacgagtacgtcacctactctaccgtcggaccggctacgtcaaggtactaagttaactaagtttattagtctggtatacgtaagaaccgaaaacgaacgggtaaacgtaccgtaactcctacccgtagtactcgttacgtttacgtacgttaccgtacttaccgttacttaaggaaccggtaaggtccgggtacccttaagaacggttcgtaccgaggtccgtaacggtgtactacgtcgtacgtacgctacgtaacttctacttacacctacgtactacgtacgacgacctacgacgactacgtcgtacgttagttacgttagtaccgttaaacttacgttctaacgtacaacgttaagacttacaacgttactcgttacggtacggtacgcggtaacgacggtacgaacgtaataaccgtagtaacgttacgnggtaccgnttaccgaccgtacgtcttacgtacg

SEQ ID NO: 179633 - DNA, 592 bp, Homo sapiens
  misc_feature: GYAE6OF01DPIT0.33.62.F07.1.454.CMB.1.raw
  modified_base (588)..(589): a, c, t, g, unknown or other
  misc_feature (588)..(589): n is a, c, g, or t
tcagtacacacactcacgaccggtgctcgatttagtagtcgcataaagggaaagggtctgtgaagccttcacagaccctgtccctcacctgcactgtctctggtggctccatcaacagcggtggttactactggagctggatccgcaaccacccgagggaaggcctggagtggattgggaacatctattacaggtggagtaccgactacaacctgtccctcaagagtcgaattaccatatcagtagacacgtctaaagaacctagttttccctgaacctgaggtctgtgactgccgcggacacggccgtgtattactgtgcgggatatagtggctacgatgcggtctttgatatcgtggggaccaaagggacaagtggtaccaccgttctctttcacgtccctccaaccgaacgggcccaacgttccggttaccctttcccccgtcggccctacccctccctacccgaacgacgccacccgtcgtcggggccacgacgccggtcccgtcgggctcgccgtcggtcgaacggacttacgtcgtagttgtgtgtacgtgaggcgggcgtcggcgaacggccgacgatagnngcg

SEQ ID NO: 179634 - DNA, 619 bp, Homo sapiens
  misc_feature: GYAE6OF01CA6CX.33.62.F07.1.454.CMB.1.raw
tcagtacacacactcacgaccggtgctcgatttagtagtcgcataaagggaaagggtctgtgaagccttcacagaccctgtccctcacctgcactgtctctggtggctccatcaacagcggtggttactactggagctggatccgcaaccacccagggaagggcctggagtggattgggaacatctattacagtgggagtaccgactacaacctgtccctcaagagtcgaattaccatatcagtagacacgtctaaagaaccagttttccctgaacctgaggtctgtgactgccgcggacacggccgtgtattactgtgcgggatatagtggctacgatgcggcttttgatatcgtggggccaaggggacaagtggtcaccgtctcttcagcctccaccaagggcccatcggtccttccccctggccaccctcctcccaagacgccacccgtccgtcgggggccacgacggccggcccgtcggggcctcggcccgttcgggtaccgaaacgggtaccttaccgtttcccgaaggttcggttcggttacggttaaccgttgggaacggtccgggggtccgtcggggaccgaaacggggtccgacgaagttacggcgtgcg

SEQ ID NO: 179635 - DNA, 620 bp, Homo sapiens
  misc_feature: GYAE6OF01EI2S0.33.62.F07.1.454.CMB.1.raw
  modified_base (347)..(347): a, c, t, g, unknown or other
  misc_feature (347)..(347): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
tcagtacacacactcacgaccggtgctcgatttagtagtcgcataaagggaaagggtctgtgaagccttcacagaccctgtccctcacctgcactgtctctggtggctccatcaacagcggtggttactactggagctggatccgcaaccacccagggaaggcctggagtggattgggaacatctattacagtgggagtaccgactacaacctgtccctcaagagtcgaaattaccatatcagtagacacgtctaaagacctagttttccccagaacctgaggtctgtgactgccgcggacacggccgtgtattacgtgtgcgggatataggtggctacgatgcgtntttagatatcgtggggaccaagggcaagtggtcaccgtctcttacacgccctccaacgaacgggccctacgtccgttccttcccccgtcggtcccctacccctccctacccaagaccgcctacccgtccgtcggggaccacgacgccggcccgtgggcctcgaccgttggtaccaacggtaccttaccgttccgtaggttcgttacggtcgttaccgttagggcggtccggggtcgtacggggtacgaacgggtccggactaacgtggngngn

SEQ ID NO: 179636 - DNA, 889 bp, Homo sapiens
  misc_feature: GYAE6OF01AO4RX.33.62.F07.1.454.CMB.1.raw
  modified_base (116)..(116): a, c, t, g, unknown or other
  misc_feature (116)..(116): n is a, c, g, or t
  modified_base (186)..(186): a, c, t, g, unknown or other
  misc_feature (186)..(186): n is a, c, g, or t
  modified_base (886)..(886): a, c, t, g, unknown or other
  misc_feature (886)..(886): n is a, c, g, or t
tcagtacacacactcacgaccggtgctcgatttagtagtcgcataaagggaaagggtctgtgaagccttcacagaccctgtccctcacctgcactgtctctggtcgctcatcaacngcggtgtactacgtggagctggatccgacaaccaccgaggggaggccctgggacgtggagttcgggaacngtctattacgaggtgggataccgactaccgaactgtacccgtcgaagtacggtcaaactttaccagttaacacctaagggtaacggtaacctacggttacctaaaacgtaacccgttacggtttttaccccctacggtaaaccgtttcgggtaaagttcccgttagtacggtaaccgttacggggcccgtacggggtaacgtaccggggcccggttaagtttacgtaccgttgggtacgggtaccggggtaattagggttaacggtcgggtaccctaacgggtacgttcgggtaccgggttttaccgtttttaggaacgtttaaccggtttccgggtaccggggggtaaacccgttaaaacgggggtaacgttaaaccggggttttcggtaccccggtaaaccgtttccggttttacccgttaccaccgggtttacccccgaaacccctaaaccggtaccggggtacccgtaaccgttccccggtttaccccgttacccccggttacggtacccccgttacccttaccccgtaacccgtaacgccgtacccgtaccggtcccgggtacgggacccaaccggtccggaccggtcccggtcggtaccgtccggtaccgtaccggtacgaacggtaccctccgtaccgtacgtggtaccgtggtacccgtggcgtcggcgtcggcgtacggtcacgtagcgcngtg

SEQ ID NO: 179637 - DNA, 779 bp, Homo sapiens
  misc_feature: GYAE6OF01BVSW8.33.62.F07.1.454.CMB.1.raw
  modified_base (775)..(775): a, c, t, g, unknown or other
  misc_feature (775)..(775): n is a, c, g, or t
tcagtacacacactcacgaccggtgctcgatttagtagtcgcataaagggaaagggtctgtgaagccttcacagaccctgtccctcacctgcactgtctctggtggctccatcaacagcggtggttactactgggagctggatccgcaaccacccagggaaggcctggagtggattgggaacatctattacaggtgggagtaccgactacaactgtccctacaagagtacgaaattaccaatactcaagtaacgacacgtactaaacgaacctacgtttccctagaacctgacggtctgtgactggccgtacggacgacgggccgtacgtaagttacgtggtacgacgggattagtacgtggactacgagtgcggtctttaggattagtcgtacggggaccgtaaaggggactaagtcggtacctaccggtcttacttccgaacgtccctaaccaaccggaaccggacccgtacgttcccgggtttaccccttccccccggttacggtacccctaaccccgttaccctaacccggtaacggaaccggtaccctaaccccgttccggacccggggggtaacctaaccggaaccggtccgggccccggttcggggtacccgtccggtaccgggttaccgggtaacccgtaaacgggtaacccttaccgttacccggttacggttagggttaccgttacggttaaccggtacggtacggggtaccgggtacgggttaccggtaacgggaaccggtaccgggacgtaaagtaacggcgngtag

SEQ ID NO: 179638 - DNA, 718 bp, Homo sapiens
  misc_feature: GYAE6OF01ETCTF.33.62.F07.1.454.CMB.1.raw
  modified_base (279)..(279): a, c, t, g, unknown or other
  misc_feature (279)..(279): n is a, c, g, or t
  modified_base (369)..(369): a, c, t, g, unknown or other
  misc_feature (369)..(369): n is a, c, g, or t
  modified_base (713)..(713): a, c, t, g, unknown or other
  misc_feature (713)..(713): n is a, c, g, or t
  modified_base (717)..(717): a, c, t, g, unknown or other
  misc_feature (717)..(717): n is a, c, g, or t
tcagtacacacactcacgaccggtgctcgattttagtagtcgcataaagggaaagggtctgtgaagccttcacagaccctgtccctcacctgcactgtctctggtggctccatcaacaggcggtggttactactggagctggactccgcaaccacccgaggggaacgggcctgggagtggattgggaacatctattacaggtgggagtaccgactacaacctgtccctcaagagtcgaacttaccatatcagtagacacgtctaagacctgttttcccngaacctggacgtctgtcgactgccggcggacaccggtccgttgttactttacgtgggtggcggggtattagtacggtcgggactacggtnttcgggcggttcttttggactacgttcggcggggtaccgaaagggactaagttcgggtacctccggttacttcgttacgaccgtcccgtacccaacgggtaaccgggtcccgtacgttcccggtttcccccgtttacccccgtcggtaccccctacccccgttccctaacccgtaaacgccgtacccgtacccgttcgggaccggggtaccaccggacgggtcccgggtccggttcgggccgtcggtccggttacggtacgtacggtaccgttacttccggacgttggtcgtcggttacgtcggtacgggcgggtccgtacgggagacggggcacggtaagcgntcgng

SEQ ID NO: 179639 - DNA, 530 bp, Homo sapiens
  misc_feature: GYAE6OF02HDQ5W.33.62.F07.1.454.CMB.1.raw
  modified_base (528)..(530): a, c, t, g, unknown or other
  misc_feature (528)..(530): n is a, c, g, or t
tcagtacacacactcacgaccggtgctcgatttagtagtcgcataaagggaaagggtctgtgaagccttcacagaccctgtccctcacctgcactgtctctggtggctccatcaacagcggtggttactactggagctggatccgcaaccacccagggaagggcctggagtggattgggaacatctattacagtgggagtaccgactacaacctgtccctcaagagtcgaattaccatatcagtagacacgtctaagaccagttttccctgaacctgaggtctgtgactgccgcggacacggccgtgtattactgtgcgggatatagtggctacgatgcggcttttgatatctggggccaagggacaatggtcaccgtctcttcagcctccaccaggcccatcggtcttccccctggccaccctcctccaacgacgcacctcgtcgggggccacgacgccggccctgggcctcgcctggtcaaggctacttccagtgtgtgtacgtgagcgggctggcaggcgcatgnnn

SEQ ID NO: 179640 - DNA, 569 bp, Homo sapiens
  misc_feature: GYAE6OF02GRA2G.33.62.F07.1.454.CMB.1.raw
  modified_base (566)..(567): a, c, t, g, unknown or other
  misc_feature (566)..(567): n is a, c, g, or t
  modified_base (569)..(569): a, c, t, g, unknown or other
  misc_feature (569)..(569): n is a, c, g, or t
tcagtacacacactcacgaccggtgctcgatttagtagtcgcataaagggaaagggtctgtgaagccttcacagaccctgtccctcacctgcactgtctctggtggctccatcaacagcggtggttactactggagctggatccgcaaccacccagggaagggcctggagtggattgggaacatctattacagtgggataccgactacaacctgtccctcaagagtcgaattaccatatcagtagacacgtctaaagaaccagttttccctgaacctgaggtctgtgactgccgcggacacggccgtgtattactgtgcgggatatagtggctacgatgcggtcttttgatatctggggccaagggacaagtggtcaccgtctcttcagcctccaccaacggcccactcggtccttcccccgtcggcccaccctccctccaacgacgccaccgtccgtcggggccacgacgccggcccgtgggcctcgccgtcggtccgaacggacctacttccgtagtgtgttcgtacgtggacggcgggcgtcggacgaacggcgacgagtagnngn

SEQ ID NO: 179641 - DNA, 541 bp, Homo sapiens
  misc_feature: GYAE6OF02IR2KS.33.62.F07.1.454.CMB.1.raw
  modified_base (227)..(227): a, c, t, g, unknown or other
  misc_feature (227)..(227): n is a, c, g, or t
  modified_base (336)..(336): a, c, t, g, unknown or other
  misc_feature (336)..(336): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (503)..(503): a, c, t, g, unknown or other
  misc_feature (503)..(503): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (536)..(536): a, c, t, g, unknown or other
  misc_feature (536)..(536): n is a, c, g, or t
tcagtacacacactcacgaccggtgctcgatttagtagtcgcataaagggaaagggtctgtgaagccttcacagaccctgtccctcacctgcactgtctctggtggctccatcaacaggcggtggttactactggagcgtggatccgcaaacccacccgaggggaagggccctggagtggattgggaacatctattacagtgggagtaccgatacaacctgtccctnaagagttcgaaattaccatatcagtagacacgtctaagacctagttttccagaacctgaggtctgtgatgccgacggacacggcgtgtattactgtagcggatagtagnggactacgatgcggtctttagatatcgtggggaccaagggacaagtcgacacgtctntcngcctcacgaggccngtcgtctcccgtgcacctctcaagctcactcgtgggccagacgccggtccgtgggctacgccgtgtacgacgtctacgtcgtagtgtgtcgtntcggtagccggtntcggnacggtcagtaagtgnagtcg

SEQ ID NO: 179642 - DNA, 630 bp, Homo sapiens
  misc_feature: GYAE6OF02GCXJM.33.62.F07.1.454.CMB.1.raw
tcagtacacacactcacgaccggtgctcgatttagtagtcgcataaaagggaaagggtctgtgaagccttcacagaccctgtccctcacctgcactgtctctggtggctccatcaacagcggtggttactactggagctgggatccgcaaccacccagggaagggcctgggagtggattgggaacatctattacaggtgggagtaccgactacaacctgtccctcaagagtcgaattaccatatcagtagacacgtctaaagacctagtttccctgaacctgaggtctgtgactgccgcggacacggccgtagtattactgtggcgggatagtagtggactaccgagtgcggtcttttgattacgtcgtggggtaccgaaagggaccaagtcgggttactaaccggttctccgtttcacgtacccgtaccaacccggaaacgggcccaacggttcggtccccgttccccccgtcggtacccaccccgttaccctaccgaaacgacgcctacctcggtacggggccacgacggccgccgtgggcctcggcctcggtcgaacggacctcttaccgagtgtgtgtacgtggacgcgggtcgtggaccgtaggtccggtactaggtcgatcgtc

SEQ ID NO: 179643 - DNA, 707 bp, Homo sapiens
  misc_feature: GYAE6OF02HR70F.33.62.F07.1.454.CMB.1.raw
  modified_base (703)..(703): a, c, t, g, unknown or other
  misc_feature (703)..(703): n is a, c, g, or t
  modified_base (705)..(705): a, c, t, g, unknown or other
  misc_feature (705)..(705): n is a, c, g, or t
tcagtacacacactcacgaccggtgctcgatttagtagtcgcataaagggaaagggtctgtgaagccttcacagaccctgtccctcacctgcactgtctctggtggctccatcaacagcggtggttactactggagctggatccgcaaccacccagggaaggcctggagtggattgggaacatctattacagtgggagtaccgactacaacctgtccctcaagagtcgaattaccatatcagtagacacgtctaagaacctagttttccctgaacctgacggtctgtgactcgccgacggacacgggtccgtgttacttaccgtggtggacgggatagtaggtggctacgatcgcgtcttttgattatccgtaggggaccgtaagggacaagtcggtactacccggttcttacctttacgaacggtccccttccaaaccccggaaaccggggtcccaaccggtttcccgggtttacccctttccccccggtcgggcccctaaccccgtttccctacccgaacggtaccgccctaacccgttccggtacgggggcctaaccgccggtcccggtacccggttgggtccgtcccggccgttacgggtaaccgtaccggttaccgttaccttacccggtaagttcgttacggttcgttacggtacggtacgggtccgggtcgttcggacgaacgggtcacgactagngnag

SEQ ID NO: 179644 - DNA, 777 bp, Homo sapiens
  misc_feature: GYAE6OF02JFLM6.33.62.F07.1.454.CMB.1.raw
  modified_base (135)..(135): a, c, t, g, unknown or other
  misc_feature (135)..(135): n is a, c, g, or t
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
  modified_base (420)..(420): a, c, t, g, unknown or other
  misc_feature (420)..(420): n is a, c, g, or t
  modified_base (599)..(599): a, c, t, g, unknown or other
  misc_feature (599)..(599): n is a, c, g, or t
  modified_base (772)..(772): a, c, t, g, unknown or other
  misc_feature (772)..(772): n is a, c, g, or t
tcagtacacacactcacgaccggtgctcgatttagtagtcgcataaagggaaagggtctgtgaagccttcacagaccctgtccctcacctgcactgtctctggtgctccatcaacagcggtggttactactgganctggatccgcaacccacccgaaggggaacggcctagggaggtggagttgggaacngttctattacgaggtgggaacgtaccgactacacctcgtcccnaagagtacgaattaccatatcgaagtacacacgttactaaacgaaccttcgttttaccctacgtaccttaggtacggttctacggtacgtacgtccggacccgtcggaaaccggtaccggtccgttacgttaacttaccgtggtcgggtaaccgggtaatttacggtacggtcggtaacgttacggngttaccgggtcggtttacgttttacgagtttacgtccgggtacggggtaaccaaaggggtctaacggttcgggtacctccgttcgttccttacgaccgtcccgtaccgaacggaccggtacctacggtcccgttcccctccccggtccgtcccctaccttacccgtacgaaccggtccnccgaccgttaccgggtcgggacctacgaccggtccggtccgtcggtaccgtccgtccgtacggtaccgtaacggtaccttaccgttaccgtggttacggttacttacggttccggtaacgggtcggtaaccgggtggtacccgtacggttaccggacgtaccgtacgtacggncggtg

SEQ ID NO: 179645 - DNA, 496 bp, Homo sapiens
  misc_feature: GYAE6OF01BT0TR.26.5.A05.1.454.CMB.1.raw
  modified_base (317)..(317): a, c, t, g, unknown or other
  misc_feature (317)..(317): n is a, c, g, or t
  modified_base (491)..(491): a, c, t, g, unknown or other
  misc_feature (491)..(491): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggagcagctccaacatcggggcaggtcgtaatgtacactggtaccaacatcttccaggaacacgcccccaaatcgtcatctctacaaacngcattcgggcctcgacggggtccctgaccgattctctggctccaagtctggcacctcacgccctccctggccatccactggactacgaggctgaggatgaggtcttattattactgacctaatcctatcgacaccgctggattggtttgtgtatttcggcggtcggacagctcngtacg

SEQ ID NO: 179646 - DNA, 840 bp, Homo sapiens
  misc_feature: GYAE6OF01DTUVL.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacaggagggtcaccatcctcctgcacgtgggagcagctccaacagtcggggcaggtcgtaatggtacacgtacggtaccaacgattccttaccgaaggaaccaccggaccccccaaaacttccgtaccactacctacctaaccaaaacgacgacctaagtttccggggacccttaccggacgggggttcccctacggaacccggtaactttccgtccgttacgggtccttaccgtaaacggttccgttcgggaccctacccgttaccgaacccggtccccttaccccggtcggacccctaacgttacccgtaaccgttacgggtaacccgttaacccggacgggtacccgttagggaacggggtaacgtttacggggtaacgggtttaccgttttaaacgttttaacgtttaacccggttaccggttaaccccgttaaacgtttaccccgttaaacgttaaccggtaaaccccgttaaaccccgggttacccgttacggggttaaacgtttttgggggttttttaccggttacggggttttaaccgggttttttacccgggggtcccgggggtaacccggggtaaaccccgttaaacgggttccccgtttaaaccggaacccggtttaaacccgggg

SEQ ID NO: 179647 - DNA, 629 bp, Homo sapiens
  misc_feature: GYAE6OF01CPALG.26.5.A05.1.454.CMB.1.raw
  modified_base (237)..(237): a, c, t, g, unknown or other
  misc_feature (237)..(237): n is a, c, g, or t
  modified_base (337)..(337): a, c, t, g, unknown or other
  misc_feature (337)..(337): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccaggacaggagggtcaccatctcctgcacgtgggancagctaccaacagtcggggcaggtcgtaatgtacactcggtaaccaactatcttccgaaggaaccaccgaccccaaactcgtcactctactaaccaaacngacagttccgggccctacgacggggtccctggaccgtactttcctcgtcggtacctaccgaagttccgtcggcctaacccgtccacgtcccctcccgtcggccctactccacgtcggaacctacgacggacctaggacggtagtacggtaggtactttaatttaacttacgtccgtaacctaacgtcctaacgtcgaacccaaccgtccgtaggtacgtttgggttttagttggttaccggttttcgggaccgggtaccgggtaacctaaggtccgtaccgtacgtaaccgg

SEQ ID NO: 179648 - DNA, 570 bp, Homo sapiens
  misc_feature: GYAE6OF01AWIXV.26.5.A05.1.454.CMB.1.raw
  modified_base (247)..(247): a, c, t, g, unknown or other
  misc_feature (247)..(247): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
  modified_base (465)..(465): a, c, t, g, unknown or other
  misc_feature (465)..(465): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtccaccatcctcctgcacgtgggagcacgcctccaacngtcggggcaggtcgtaatcgtacacgtcggtaccaacatcctaccgaaggaaccacgacccccaaactcgtcactcctactaacaaacagcagttccgggcctcgacgggtcccngaccgtattcncgtcggctcgagtctcgcctccgtccgccctcccgtgtcatccgacgtcgggcctcgaggtntggaggtatggagtctagtacttagttacncgtactagttcgatacgaacgtacgttaccttacgttgttagttcgggtcgggacggtacgggaccgtagggttaccgtaccccgtccgtacggtcctaacccgg

SEQ ID NO: 179649 - DNA, 624 bp, Homo sapiens
  misc_feature: GYAE6OF01BLMCI.26.5.A05.1.454.CMB.1.raw
  modified_base (232)..(232): a, c, t, g, unknown or other
  misc_feature (232)..(232): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacaggagggtcaccatctcctgcactgggancagctccaacagtcggggcaggtcgtaatgtacacgtggtaaccaacatcttccaaggaaccacgacccccaaactcgtacatcctactaacaaacagacagttccgggcctacgacggggtccctaggaccgtacttctcgtcggtcctaccgaagttccgtacggccctacccgtccgaccgtccccttaccccgtcggaccctactcctacgtcggaccttacgacggctggaggtatggacgtactttattacttacgtacgtacctaactcctagtacgacctaacccggtaccgttacggtacgtttgggttttagttacggttacggttttccggggaccgggtaccgggtaacccgtaaggtcccttaccgtaacgttacccgg

SEQ ID NO: 179650 - DNA, 629 bp, Homo sapiens
  misc_feature: GYAE6OF01CP2O5.26.5.A05.1.454.CMB.1.raw
  modified_base (344)..(344): a, c, t, g, unknown or other
  misc_feature (344)..(344): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacaggagggtccaccatcctcctgcacgtgggagcagcctaccaacagtccggggcagggtcgtaatgtacacgtggtaaccaacatccttaccgaggaaccaccgacccccaaactccgtacactcctactaaccaaacngctagttccgggcctcgacgggtccctgaccgtatctcgtggcctccgaagttctcggccacctcacgccctccctcggccactccacgtcggtacctacgaggtctaggacggtagtggtacggttactttagtttacgttacgtacgtaccctaagttacctaacttaccggaacctaacccggtccgttagggttacgtttgggtttttacgtcggtttacgggttttcccgggaccggggtaccggggtaaccctaaggtcccgtaccgtaccgtaccggg

SEQ ID NO: 179651 - DNA, 567 bp, Homo sapiens
  misc_feature: GYAE6OF01C2FZA.26.5.A05.1.454.CMB.1.raw
  modified_base (325)..(325): a, c, t, g, unknown or other
  misc_feature (325)..(325): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagagcctgggcctcagtgaaggtctcctgtcaggcttctggttacactttcgtgaccatggtatcagctgggtcgcgacacggcccctggacaagggcttggaggtgggtggatggatcagtccccttanaggtggtgacacagactatcatccgagagtaacgttccgaggggccggtacaccgtatcgtccagtcggacctacgttacacgaacacagtctacagtggagctaggacgtagtcgtgacgtcgtagacgacgacggtccgtgttacttacgtgtgcgagaccgtacccgttagttcgttagttttacgacgttacggtcgggaccgtaacgggtacccgtggtacccgtccgttcgtaccg

SEQ ID NO: 179652 - DNA, 675 bp, Homo sapiens
  misc_feature: GYAE6OF01A8UB9.26.5.A05.1.454.CMB.1.raw
  modified_base (234)..(234): a, c, t, g, unknown or other
  misc_feature (234)..(234): n is a, c, g, or t
  modified_base (353)..(353): a, c, t, g, unknown or other
  misc_feature (353)..(353): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacaggacggtcaccatcctcctgcacgtgggancagcctaccaacaggtcggggacaggtacgtaatcgtacacgtcggtaaccaactacttccttaccgaacgggaaccacccgacccccaaaacgtccgtactactcctactaacaaacncgactacgttccgggcctacggtaccggggtccctagacccgtatttctcgtcggtccctaccgtaacgtctcggcctacctccgacgtcccctccccgtcggcctacgtaccaccgtcggaacctaccggaggtcgtagggacggtagtacgggtacggttacttttaagtttacttaccgttacgaacccttaacttccctaagtccggaaacccgtaacccggcgttacggtacgttttgggttttacggttcggtttacggtttccggggacccgggtccgggaaccctaaacggtccctaacgtcccggttaaccgg

SEQ ID NO: 179653 - DNA, 657 bp, Homo sapiens
  misc_feature: GYAE6OF01EQ124.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccaggacaggacgggtcaccatcctcctgcacgtgggagcagctccaacagtcggggcaggtcgtaatgtacacgtggtaccaacatccttccgaaggaaccacgacccccaaactcgtacatctactaacaaacagcagttcggcctacgacggggtcccctagaccgtattacctcgtcggcctaccgaagtctcggcctaccctcgacgtcccctccccgtcggaccctactaccgacgtcggaacctacgacggtccgtaggaacggtagtacggtaacggttacctttaagtttaactttaaccgttcgtaacctaacgttaccctaacgttacgaacccgtaaacccgtccgttaagggtacgttttgggttttacggttcggttaaccggtttttccggggaccgggtaccgggtaaccctaaggtcccgttaaccgaccgttaacccggg

SEQ ID NO: 179654 - DNA, 716 bp, Homo sapiens
  misc_feature: GYAE6OF01BXEO2.26.5.A05.1.454.CMB.1.raw
  modified_base (236)..(236): a, c, t, g, unknown or other
  misc_feature (236)..(236): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccaggacaggagggtcaccatctcctgcacgtgggancagcctaccaaacacgtcggggctagggtacgtaatcgtaacacgtcggtaaccaactactccttaccgaaggaaccaccgaccccctaaacttccgtacactacctacctaaaccaaaacacgctaacgttccggggaccttacgacggtcggtaccctacggaacccgtactttccgtacgttcggcccttaccgtaaacggttccgtacggtccctaccctaccgaccgtccccttcccgtcggtaccctactccctaaccgttacggtaacccgtaacgacgggtccgttagggaacggtacgttacggtaacggttacctttaatttaacgtttaccttacgtaacctaaccttaccgttaacgtacgtaacccgtaacccgtaccgttacgggtagtttacgggttttacgttacggttacggttttccgggtaccgggtaccgggtaacccgtaacggtcccgtacgtaaccg

SEQ ID NO: 179655 - DNA, 525 bp, Homo sapiens
  misc_feature: GYAE6OF01COJ4A.26.5.A05.1.454.CMB.1.raw
  modified_base (353)..(353): a, c, t, g, unknown or other
  misc_feature (353)..(353): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggagcagctccaacatcggggcaggtcgtaatgtacactggtaccaacatcttccaggaacacgacccccaaactcgtcatctactaacaaacagcattcgggcctcagtcgtccctgaccattcnctggctccaagtctggccacctcacgccctcccgtcggcccatcactcgacctacgacggctggaggatggaggtcttagttacttactcgtacctaatcctatcgaccaaccgcgtggtattggtttgtagttagttttcgggcgggtacggacctaacgtcctcgtaacg

SEQ ID NO: 179656 - DNA, 927 bp, Homo sapiens
  misc_feature: GYAE6OF01C59F9.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagccgtggggcctcgagtgaaggtctccgtgtcaggcttctggttacactttcgtgacctatggtatcagcgtgggtgcgacgacggcccctggacgaagggtccgtttaggagggttggggtagggtagttagggacttaccgacggtacccctttaaggaggttgggtacgaccgacaacggtaactaactacgaacgttacccgaaggtaaacggtaaacggtttcccgggaacgggggtccccgggttaccgaaacccgtaagttccgggttaacccgtaaggttaccgggtaaccgtaaccgggttttacccgaaacccgggtaaaacccgtaaccgtaaaccggttaacccgttaaaccggtaaggttacggggaacggttacccggttacgggtaacccggtaacggtttaccggttacgggtaacccggtttaccggtaaccgggtaacccggtaaacccggtaacccggggttaccccggttaaggtttaaccgttttaccggttacgggttaccgggtaacccgggtaaaccgggtaaccccggttaaaccccgtttaaacggtttttaacccggtttaacggttttttaaccgggtaaacccggttttaacccggggtttaccgggggtaacccccgggttaaacccgggggtttaaacccccgggtttaccggggttaaccccggtaaccccgggtttcccggtttaacccccgggg

SEQ ID NO: 179657 - DNA, 559 bp, Homo sapiens
  misc_feature: GYAE6OF01BQ6OW.26.5.A05.1.454.CMB.1.raw
  modified_base (375)..(375): a, c, t, g, unknown or other
  misc_feature (375)..(375): n is a, c, g, or t
  modified_base (436)..(436): a, c, t, g, unknown or other
  misc_feature (436)..(436): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccaggacagacgggtcaccatctcctgcacgtgggagcagcctaccaacagtcggggcaggtcgtaatgtaacacgtggtaccaacactcttaccgaggaaccacgacccccaaactcgtacatctactaacaaacacgcacgttccgggcctcgacggggtccctcgaccgtattcnctggcctacaagtctcggctacctcacgtccctcccgcgccactctacgtaggacctacgnggctaggagatggacgtacttattacttactgaccaatcctatcgacctaccgccgttggtactttggtttggtcgttacggtttccgggacgggtaccgggtaacagtcctacgcgtaccgg

SEQ ID NO: 179658 - DNA, 578 bp, Homo sapiens
  misc_feature: GYAE6OF01CUVJ3.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacaggagggtccaccatcctcctgcacgtgggagcagctccaacagtcggggcaggtcgtaatgtacactggtaccaacatccttccaggaacacgaccccaactcgtcatctctaacaaacagcatcgggcctcgacgggtccctgaccgtacttctctcggctccaagtctggcacctcacgcccctcccgtcggacctactccactcggaacctacgacggcctggaggtactggaaggtcttaatttacttactcgacctaactcctaagtacgtaaccctaacccgtccgtcgggtaactttgggtttttaggtggttacgttttcggggaccgggtccgggtaacctaggtccttcgaaccgttaccgg

SEQ ID NO: 179659 - DNA, 777 bp, Homo sapiens
  misc_feature: GYAE6OF01CUNKO.26.5.A05.1.454.CMB.1.raw
  modified_base (237)..(237): a, c, t, g, unknown or other
  misc_feature (237)..(237): n is a, c, g, or t
  modified_base (352)..(352): a, c, t, g, unknown or other
  misc_feature (352)..(352): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgcctcagtgtcgtcggggccccaggacgagagggtcaccgatctcctgcacgtgggacncacgcctaccaacgacgtcggggactaggtacgtaatcgtacacgtacggtaaccaactactccttaccaaggaaccacgaccccaaacgtccgtacactcctacgtaacaaacncgactacgttccgggaccctacggtacggggtccctacggaccgtattcctcgtcggtacctaccgtaacggtccgttacggacctacccgtccgaaccgtccccgttaccccgtacgggaccctacgtacccgtaacgttaccgggaacccttaaccggacgggtaccgtaacgggtaacgggtaacgttacgggtaacgggtttaccttttaaacggtttaacgtttaaccgtaccggtaaccttaaaccgttccgttaacgttaaccggtaaacccgtaaacccggttaccgtttaacggggttaacggttttacggggttttttacggtacgggtttttaaccggggttttacccggggaccggggtaccccgggtaaacccgtaacgggtcccgttaacccggaccggtttaaacccggg

SEQ ID NO: 179660 - DNA, 540 bp, Homo sapiens
  misc_feature: GYAE6OF01AQKWT.26.5.A05.1.454.CMB.1.raw
  modified_base (332)..(332): a, c, t, g, unknown or other
  misc_feature (332)..(332): n is a, c, g, or t
  modified_base (438)..(438): a, c, t, g, unknown or other
  misc_feature (438)..(438): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttacaacttttcgtgaccatggtatcagctgggtgcgacaggcccctggacaagggcttgagtgggtgggatggatcgagcccttagagtggtnacacagactatcatccagagaacgttcgaggggccggtcacgatcgtccagtcggacacgttcacgaacacacgtactacagtggagctagacgagtctgacgtcngacgacgacggtcgtagttacttacgtgtcgcgacgacgtacccgtagttcgttatttcggactacgtgggacctacgggaccctggtcctaccgtcgtccg

SEQ ID NO: 179661 - DNA, 760 bp, Homo sapiens
  misc_feature: GYAE6OF01CM7G3.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccaatctgtgttgacgcagcccgcctcagtgtcgtcggggccccagggcaggacgggtcaccgatctccgttggttttcgggacttacctccaaacgtagtccgggggactaagggttatggtaatgtaacacgttacggtaacccaaagtaacggttcccgaaggtactccgaccgtacccccaaatccctactaactcctacgtacgggaaaccaccgtaacgtcccggccctacggaccgggtaccctacggaacccgttacttcctacgtcggcctaccgaagttccgtcggaccctaccggtccgtcccttcccgttacggtacctaacgttccgaacggtcgggtaccctaccggaagggtacgttagggacggtacgttacggagggtaccgttaggttaacttttaacgtttaccgtacggtacccgttaagggtttaccgttagtaccgtaaccgttaacccgttccgttaacgtttaggtacgtttcgggttaccggggacgggaaacggggtacccgtagggggttacctaaccccggttaccgttaccgtaccggaccgacccggtaacggtcccgtcccgttaccccccgg

SEQ ID NO: 179662 - DNA, 659 bp, Homo sapiens
  misc_feature: GYAE6OF01D6CV2.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacaggagggtcaccatcctcctgcacgtgggagcagcctaccaacagtcgggcaggtacgtaatgtacacgtcggtaaccaacattccttaccgaggaacacgacccccaaactcgtcatcctactacaaacagcagttccgggcctcgacggggtccctggacctattcctcttcggccttaccgaagttcgtcggaccacccgtcacgtccccttcccgtcggaccctacgtaccaccgtcgggtaaacctacggacgggtcctagggacggtagttcggaacggttaccttttaatttaacgtttacctacggtaaccctaattcccctaataccgaaccgtaacccggccgtttagggtacgttttggggtttttaggttcggtttacggttttccggggacccggggttaccgggtaaccctaaggtcccttaccgtaacgttaacccggg

SEQ ID NO: 179663 - DNA, 678 bp, Homo sapiens
  misc_feature: GYAE6OF01BVARV.26.5.A05.1.454.CMB.1.raw
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagagactatactcacgaccggtgctcgatttagatagatagacaggggacccaaaaaccacacccctccttgggagaatcccctagatcacagctcctcaccatggactggacctggagcattccttttcttggtggcagcagcaacaggtgcccactcccaggttcagttgctgcagtctggagctgagatgaagaacgccgtggggcctcagtgaaggtctcctgtcaggtctcgtggttactacgtttcgtgaccattggtatcgagtcgtgggtcgcgacgacggccccgtggaacgaaggggtcttaggaggtggggtgggatgggatccgacgtcccgttacgaggtggtagacacacgacttancaacnccgaagagaacggtttcccgaggggtcccggtacaacgagttccgtaccgaagtcggtaacctaccggttacaaccgaacaacgtacggtaacctaacgtagtcggtagtccgtagacgtacggtcgtacgtaccgtacgtcggaaccgaccgtaaccgggtacgttacggttaacttacggtacgtacggtacggaaccggtaaccgtaccccgtttagtttaccggttattttaacgggccttaacgggtacggacccggtaacggtaccccgttggtacccgtaccgtccgtacccg

SEQ ID NO: 179664 - DNA, 610 bp, Homo sapiens
  misc_feature: GYAE6OF01DW86E.26.5.A05.1.454.CMB.1.raw
  modified_base (246)..(246): a, c, t, g, unknown or other
  misc_feature (246)..(246): n is a, c, g, or t
  modified_base (270)..(270): a, c, t, g, unknown or other
  misc_feature (270)..(270): n is a, c, g, or t
tcagagactatactcacgaccggtgctcgatttagatagatagacaggggacccaaaaaccacacccctccttgggagaatcccctagatcacagctcctcaccatggactggacctggagcatcctttctggtggcagcagcaacaggtgcccactcccaggttcagttgctgcagtctggagctgagatgaagagcctgggcctcagtgaaggtctcgtgcaggtcttctggttacactttcgngaccagtggtatcgagcgtgggtnacgacgacggcccctaggaccgtaagggcttaggaggttcggggtggatggatcgacgtcccttagaggttgacgacacagactatcatccgagaagtacgttccgagggcccgtacacgtagtcgaccagtacggacctacgtacgaacgaacacgtacgtactacgagtaggacgtacgtagacgtacgtactcgtaccgtcgaacgaccggtacaccgggtcgttacgttacgttacgtggtcgaccgtaacgtacgttaaccccttgtttaccgttagtttacgacgttacggtcggaccgtacgggtaacccgtggtaccgtccgtcgtacccgg

SEQ ID NO: 179665 - DNA, 649 bp, Homo sapiens
  misc_feature: GYAE6OF01A3AZR.26.5.A05.1.454.CMB.1.raw
  modified_base (436)..(436): a, c, t, g, unknown or other
  misc_feature (436)..(436): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagccgtggggcctcagtgaaggtctcctgtcaggtcttctggttacaactttcgtgaccatggtatcagcgtgggtgcgacacggcccctggacaagggcttggaggtggggtgggagtgggactcgacgtcccttagaggtggtagacacagactatcatccagagtaacgttccgacgggccggtacaccagtcgccagtcgactacgttacacgaacacagtctacgatagggancgtgacggcgttcgtacgaccgtacgtcggaaccgtaccgaccgggtccggtagttaacgttacgtcggtacggccggtaacggtacccggtaaacccccgtttagttaccggttttaagtttttacggaacccgtttacgggtccggggtaacccgtaccgggggttaaccccggttaccgggttaccccgtacccggttccgttacccggg

SEQ ID NO: 179666 - DNA, 538 bp, Homo sapiens
  misc_feature: GYAE6OF01DXB6X.26.5.A05.1.454.CMB.1.raw
  modified_base (331)..(331): a, c, t, g, unknown or other
  misc_feature (331)..(331): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcacgtgggagcagcctccaacagtcggggcaggtcgtaatgtacactggtaaccaacatccttccgaaggaaccacgacccccaaactcgtacactctactaacaaacngctagttccgggcctcgacgggtccctagaccgtatctctggcctaccaagtcctggacctacctcacgtccctcccgtggacccatccactgactacgngcngagatgagtcttattacttactgacctaatcctatcgaccaccgtcgtaggtatttgggtttgtgttacgtttcgggaccggtaccgggacagcctcgcgtacg

SEQ ID NO: 179667 - DNA, 621 bp, Homo sapiens
  misc_feature: GYAE6OF01A3X04.26.5.A05.1.454.CMB.1.raw
  modified_base (327)..(327): a, c, t, g, unknown or other
  misc_feature (327)..(327): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcacgtgggagcagctaccaacagtcggggcaggtcgtaatgtacacgtggtaccaacactcttccgaggaacacgaccccaactcgtacatcctactaacaaacngactacgttccgggcctcgacggggtccctagaccgtattccgtcgtggtcctccgaacgtctcggcacctcaccgccctcccgtcggcccagtccactcggaacctacgacggtccgtaggaggtagtaggtacggttacttaagtttacgttaccgtcgtaacctaactttaccctagtacgtaaccctaacccggtccgttaggtacgtttagggttttggttcggttaccggttttccggggacgggtacccgggtaacctaaccggtccgttaccgtaaccgtaccggg

SEQ ID NO: 179668 - DNA, 643 bp, Homo sapiens
  misc_feature: GYAE6OF01ASVT8.26.5.A05.1.454.CMB.1.raw
  modified_base (255)..(255): a, c, t, g, unknown or other
  misc_feature (255)..(255): n is a, c, g, or t
tcagagactatactcacgaccggtgctcgatttagatagatagacaggggacccaaaaaccacacccctccttgggagaatcccctagatcacagctcctcaccatggactggacctggagcattccttttcttggtggcagcagcaacaggtgcccactcccaggttcagttgctgcagtctggagctgagatgaagaagccgtggggcctcgagtgaaggtctctgtcaggtcttctggttactaactttcgngaccatggtatcgaggcgtgggtgcgacgacggccccgtggacaagggtcttggaggtggggtggtagtggatcgacggtcccttacgagttgggtcgaacgacgagtacgtaatccaacgtccgaaggaacggtaacgttccggaacggggtcccgggtacaccgtagtcgtacctaagtcgggtaactaccggttacaagtacgaaactacgtaagtacctaagagtagggaactcgtacggaggttaacgtctcggtaccgtctacggacgtaccggacggtccgttagttacttacggtgtacgtcggacgtaccgtacccgttgtttactagtttcgaacgttcggtcgggaaccgtacgggtaccctcggtacctccggtcg

SEQ ID NO: 179669 - DNA, 777 bp, Homo sapiens
  misc_feature: GYAE6OF01CYRY2.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactcctcctcgctcactgcacgacgggtcctcgggcccagtctgtgctgacgcacgcccgcctgagtcgtccgtccggggacccagggacaggacgggtccaacctactcctccgtgacctacggtgggacgccgacgcctaccgaagtacggtcgggacgtaggttacgtaagtcgtaacacggtacgtaaccaactacttacctaccgaacgaaccacccgtaacccctaactccgtactacttactaacctaaacaaacgcgtaccgtacggttcccgggacccgtaccgggtaacccggggtccctacggaaccgttacgtttcccgtccggtacggtacccgttacccgtaacggttcccgtacggacccttacccgtaccgtaccccgttcccctccccggttaccggcccttaaccgtacccgtaaccggtaccggtaaccgtaaccgggtacgaccggttaggaacgggttacgttacgggtaacgtttaactttaacgtttaaccgtactaccgtaacctacttacgtaaccgtaccgtaaccgtacccggttcgttaggttacggttttggtttacggttcggtttacgggttaccgggccggggtaaccgtaacccgaggtcctaaccgtaccggtaacggg

SEQ ID NO: 179670 - DNA, 693 bp, Homo sapiens
  misc_feature: GYAE6OF01B4LG3.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtcggggccccaggacaggaggtccaccatcctcctgcacgtgggagcagctccaacagtcggggcaggtcgtaatgtacactggtaaccaactatccttaccaacggtaaccaccggaccccaaactccgtactacttcctacctaaaccgaaaactacgtacctaacggtttccgggaccctacggtaaccggggttcccctacggtacccgtactttccgtacctcgggtacccttacccgaacgttccgtcggtacccaacccgtccgaaccgtccccttccccgtcggaccctacgtcctaccgtacggtaacctacgacggtaccgttaggaacggtagttggaccggttactttaactttacgttacgttacgtaccttaactccgttaagtacgtaaccacccgtacgttagggtacgtttgggtttacggttggttacggttttaccgggacgggttaaccgggaccttaacggtccgtacgtacgttaacccggg

SEQ ID NO: 179671 - DNA, 891 bp, Homo sapiens
  misc_feature: GYAE6OF01B1GT3.26.5.A05.1.454.CMB.1.raw
  modified_base (235)..(235): a, c, t, g, unknown or other
  misc_feature (235)..(235): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccaggaccagaggtcaccatctcctgcacgtgggancagcctacctaaacagtccgggggactacgggttacgtaaagtcgttaacctacgttacgggtaaaccccaacgtacgttacccgtttacccgaaacgggaaacccaccggaaccccccctaaaacgtcccgtacaacttaccttactaaaccaaaacacgtacgtaacgtttccggggacccttacggtaaccgggggttccccttacggtaacccgtaactttccgtaccgttcggtacccttacccgtaaacgggttccttaccgggtaccctaaccccgttaccgaaccggttcccccttaccccgttacgggaccctaaaccgttacccgtaaccggtaccgggttaaaccgttaacccgtaacggggtcccgtttaagggaacccgggttaagtttacgggaaccggggtttaaccttttaacgttttaaccgtttaaccgtaccggttaaccccttaaacgttaccccgttaacttaaccgggtaaaaccccgtaacccgggttaccccgtttagggggttaaacgtttttgggggttttttaaccggtacgggttttaacccgggtttttaccggggacccgggggttaacccggggtaaccccgttaaacgggttcccctttacccggaaacccggtttaacccggg

SEQ ID NO: 179672 - DNA, 695 bp, Homo sapiens
  misc_feature: GYAE6OF01D89RZ.26.5.A05.1.454.CMB.1.raw
  modified_base (256)..(256): a, c, t, g, unknown or other
  misc_feature (256)..(256): n is a, c, g, or t
  modified_base (350)..(350): a, c, t, g, unknown or other
  misc_feature (350)..(350): n is a, c, g, or t
tcagagactatactcacgaccggtgctcgatttagatagatagacaggggacccaaaaaaccacacccctccttgggagaatcccctagatcacagctcctcaccatggactggacctggagcattcctttttcttggtggcagcagcaacaggtgcccactcccaggttcagttgctgcagtctggagctgagatgaagaagccgtgggcctcgagtgaaggtctcctgtcaggcttctggttacaacttttcgngacctatggtatcgagtcgtgggtgcgacacggcccctgggacaagggtcgttggaggttggggtgggagtgggatcgacgtccccgtttaagnggtggtacgacaacgtagactagtactaactccgaaggtaacgtaacggtttccggacgggggtcccggtaccaacccgtagttcggtacccagtacggaacctacggttacaacggtaaaccacgtacgtacctaactagtgggaacgtcgtacggaacgtagtcgtacggtaccgttacgtacgggaacccgtacggtacccggttccggttagttaacgttcgtggtcggaacgtacgtacccgttacccctttagtttccgtttaagtttcgaaccggttacggtacggggaacccggttacgggtaacccgtcgggttacccgtaccgttccgtacccgg

SEQ ID NO: 179673 - DNA, 555 bp, Homo sapiens
  misc_feature: GYAE6OF01ALLC4.26.5.A05.1.454.CMB.1.raw
  modified_base (231)..(231): a, c, t, g, unknown or other
  misc_feature (231)..(231): n is a, c, g, or t
  modified_base (320)..(320): a, c, t, g, unknown or other
  misc_feature (320)..(320): n is a, c, g, or t
  modified_base (417)..(417): a, c, t, g, unknown or other
  misc_feature (417)..(417): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggancagctccaacagtcggggcaggtcgtaatcgtacactggtaccaacatcttccaggaacacgcccccaaactcgtcatctctaacaacngcagttcgggcctcgacggggtccctgaccgtattcctctcggctccgaagtctggcctacctcacgccctccctggccactccactggacctacgnggcctggaggtatggacggtacttttacttacttactcgccctaatcctaagtcgacctaacccggcttacggtattgggttttgtcggttacgttttccggggcggtaccgggaccaagtccgtcgaccgttaccgg

SEQ ID NO: 179674 - DNA, 675 bp, Homo sapiens
  misc_feature: GYAE6OF01CC6HX.26.5.A05.1.454.CMB.1.raw
  modified_base (185)..(185): a, c, t, g, unknown or other
  misc_feature (185)..(185): n is a, c, g, or t
  modified_base (223)..(223): a, c, t, g, unknown or other
  misc_feature (223)..(223): n is a, c, g, or t
tcagagactatactcacgaccggtgctcgatttagatagatagacaggggctctgcttcagctgtgggcacaagaggcagcactcaggacaatctccagcatggcctggtctcctctcctctcactctcctcgctcactgcacgagggtcctgggcccagtctgtgctgacgcacgcccgccctnaggttcgtcgtcggggccccagggcaggacggtcaccntctccgttggttttcggacgttacctaccgaacgtaggttccggggactaggttaatggtatacgtactacgtcggtaaccaactaacggttccaaggtactaccgaaccgtacccctaaactcctacatcctacgtacggaaccaccaacgtccggacccctgaacggtactcccgtagtacctaattcgcgactaccacgtcgtacggaacacgactccactcacgacctataccgacggccgggaccaggacccgaacgggagacggaacggactaacgtacttagtcgacgtaggcggtaacggagtaacgttagttacggttagtaggttagggttacggacggggtaacgggtaccgacgggtaccggtaccggtaaccggttaccggtaacgggacccgtaaccgacccgtaaagggccccgttacccggcccggtttacccggg

SEQ ID NO: 179675 - DNA, 802 bp, Homo sapiens
  misc_feature: GYAE6OF01DA6S1.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtccgtcgggccccaggacaggaggtcaccatcctcctgccacgtgggagccacggcctaccaacgtacgttccggggtacaacgggttaccgtaatcgtaccaccgttacgggtaaccccaaactacttcccgtttaccgaacgggaaacccaccggaccccctaaaacgttccgtaccaacgttcctaacctaacaaaacgacgtaccgtaacggtttcccggggacccttacgggaaccggggtttaccccgtacggaacccggttaacgtttcccgttccgtaaccgggttccctttaaccccgtaaacggtttcccgttacgggacccctaacccgttaccgtaacccggtcccccgttaccccgttccgggaccctaacgtacccgtaacgtaccggtaacctaaccgacgggtaccgttagggaacggtacgtaggtaacggttactttaacgtttacgttacctacggtaaccttaacgttaccgtaacgtaccgtaacccgtaaacggttcccgtaagggttcgtttagggtttcggttacgtttacggtttaccgggaccggtaccgggtaaacctacggttaccctacgtaaccgttaaccgg

SEQ ID NO: 179676 - DNA, 695 bp, Homo sapiens
  misc_feature: GYAE6OF01A5HXH.26.5.A05.1.454.CMB.1.raw
  modified_base (248)..(248): a, c, t, g, unknown or other
  misc_feature (248)..(248): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaggtctctgtcaggcttctggttacactttcgngaccagtggtatcgagcgtgggtgcgacgaggcccctggacgaagggtcttggaggttggggtgggagtggacgtcgacgtcccttagacggtggtacgaacacgtaacgtactatactacgtccaaggaacgtaacggttcccggacgggggtcccggtaccaaccgtacgtcgtaccctaagtcggtaacctaccggttaccaaccggaaacctaccgtacgtacgtaactaggtagggtactccgtacggtaacggtacgtcgtacggtaccgtcggtacgaaccggaaccggtaccgggttaccgttaggtttaacttaccggtggtacggtacggaacggtacccgttaacccgtttagtttccggtttagtttaccggtacgttaccgggtccgggtaaccgaccggggttacccttagggtaccctccggttctacccgg

SEQ ID NO: 179677 - DNA, 714 bp, Homo sapiens
  misc_feature: GYAE6OF01CQG77.26.5.A05.1.454.CMB.1.raw
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacaggacggtcaccatcctcctgccacgtggancgagctaccaacagtcgggcaggtntaatgtacactggtaccaanactctaccgacggaaccaccgaccccaaatccgtacactctactaacgaacngactacgttccgggcctacggtacggggtcccttagaacccgtattcctacgtcggtctcccaaggttccgtacggtaccctaccctaccgacccgtaccccgttccccgttccgggtaccctaccgtacctacccgttaggtaacccgtaacggacggtccgttaacggaagggtaaccgttagggtaacgttaccgtttaaagttttaaccgtttaacgttccgtaaccccttaaacgttaccccgttaagttaccggaaaccctaacccggtaccgtacgggtttaacggtttcgggtttttacgttacgggtttacggtttttccgggacccgggtaccgggaacccgttagtaccgttaccgtaaccgttaaccgg

SEQ ID NO: 179678 - DNA, 755 bp, Homo sapiens
  misc_feature: GYAE6OF01BFECF.26.5.A05.1.454.CMB.1.raw
  modified_base (235)..(235): a, c, t, g, unknown or other
  misc_feature (235)..(235): n is a, c, g, or t
  modified_base (366)..(366): a, c, t, g, unknown or other
  misc_feature (366)..(366): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgagggtcctgggcccagtctgtgctgacgcacgcccgcctcagtcgtcgtcggggccccaggacagacggtcacatctctgcacgtgggancagcctaccaacacggtccgggggactagggtacgtaattcgtaacctacgtacggtaaccaacgtacttcccgttaccgaacggaaccacccgacccccgaaaactccgtacactcctactaaacaaacncgtctaacgttccgggccctacggtaccgggttcccctaggtaacccgtacgttttccgtcggttacggacccttaccgaacggttccgttaccgggtaccctacccgttccgaacccgttccccgttccccgtacggtaccctaacgttccccgtaacggtttaccggaaccgtaccggtacggtacccgtagggtacgggtaacgtagggtaacgttacgtttaacgttacgtttaacgccgttaaccgtaacttaccgttaacgtaccgaacccgtaaccggttccgttagggtacgtttttagggtttttacgggtcgttttacggggttccgggacccggttacccgggaaccgtaacgtccgttaaacgccggtttaacccgg

SEQ ID NO: 179679 - DNA, 590 bp, Homo sapiens
  misc_feature: GYAE6OF01AKV1I.26.5.A05.1.454.CMB.1.raw
  modified_base (458)..(458): a, c, t, g, unknown or other
  misc_feature (458)..(458): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagccgtggggcctcagtgaaggtctcctgtcaggcttctggttacaactttcgtgaccatggtatcagctgggtgcgacgaggccccgtggacaagggtcttggagtgggtggatgggtactcgacgtcccttagaggtggtgacacagactatcatccagagtaacgttcgagggtccggtcaccgtagtcgtcagtcggaactacgttcaacgaacacgagtctaacagtcggagtctagacgtagtctgaccgttcncgaacgtacgacgggtcgtacgttattacgtgtcgacgtagaccgtacccttagttcgtttagtttcggacgttacggtacggggacccgtaacggggtacccttcgggtacctacccggttcgttacccgg

SEQ ID NO: 179680 - DNA, 899 bp, Homo sapiens
  misc_feature: GYAE6OF01BWI6G.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgagggtcctgggcccagtctgtgctgacgcagccgccctcaggtcgtcgtcggggccccaggacaggagggtcaccatctcctgcactgggagcacggctaccaacgacgtccggggcacgggtcgttaattcggtaaccgacgttacgggtaaccaaacgtacttcccgttaccgaaggaacccaccggtaccccccaaaacgttccgtacctaacgttcctacctaaacaaaccgacgtacctacgtttcccggggacccttaccggaaccgggggttcccctacggtaacccggtacgtttccgtacgttcgggtacccttaccgtaaacggttccgtacgggtaccctaacccgttaccgtaccggtcccccgtttacccccgtacgggtacccctaacgtttacccgtaaccggttaccggggtaaacccgttaaccgggtaacggggtaccgttaacggggtaaacggggtaacgggtaacgggttaacgggtttaaccctttttaaggttttaaacgtttaacccgtttaccggtaaaccccgttaaactttaccccgttaacggtttaaccggtaaaccccgttaaaccccggtccggttttaacggggttaaccgggttttttacgggtttttacggttacgggttttaccgggtttttaacccccgggggacccggggttaaaccccggggttaaacccttaaaacgggttcccccgtttaaaccgaaccccggtttaacccggg

SEQ ID NO: 179681 - DNA, 833 bp, Homo sapiens
  misc_feature: GYAE6OF01CM1P9.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgaggtcctggcccagtctgtgctgacgcacgccgcctcgagtcgtcgtcggggcccaggacgaggacgggtccaaccgactcctccgtgccacggtgggacgcgacgtacctaccgaacgacggtccggggacgtagggttactaaacgtcgtaaccgtacgtacggtaaaccaacctacttacccgttaccggaacgtaaaccgacccgaaccccctaaacgttccgtacctaacttacctaacctaaaccgaaaaccgacgtaccgtaacggttcccggggtacccttacgggtaccggggttacccttaaccggtaccgttaacgttcccgttcggtccggtaacccttaccgtaacggttccgtaccggacccttacccgtccgtaccccggtccccttccccggtacggacccctaacgtacccgtaaccgttacggtaaccttaacccggtacgggtcgttaaagggtacgggttaacgtacgggttaaccgtttaaccttttaaacgtttacgttaaccgtaccgttaaccctaagtttaccctaacgtaccgaacccgtacccgttcggtaacgggtttacgttttagggttttacggtacggttttaccgggtttcccggggacggttaccccgggtaaacccgtacggttaccggttaaccgaaccggtttaacccggg

SEQ ID NO: 179682 - DNA, 840 bp, Homo sapiens
  misc_feature: GYAE6OF01EB56T.26.5.A05.1.454.CMB.1.raw
  modified_base (267)..(267): a, c, t, g, unknown or other
  misc_feature (267)..(267): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgagggtcctgggcccagtctgtcgctgacgcacgccccgcccccagtcgtcgtcggggaccccagggacgaggacgggtccaccattcctcctgaccacggtgggacgcacgcctaccgaacncggtcggggctagggtcgttaagtcgtacacgttacggtaaccaacgtacttccgttaccgaacgggaacctacccgaacccccctaaacgttccggtacctaacttacctaccgtaaaccaaaaccgtacggtacctaacggtttcccgggggacccttaccggtacccggggggtttcccctacgggtaacccgttacgttttcccgtacggttccgggtacccttaccccggtaacgtttccggtacgggtacccctacccttccgaacccgtccccgttaccccgttcgggaacccctacgttcccaaccggttacgggtaacccgtaaccggtcgggtaccgtagggtaacgggtacggttaggtaacgggtttaccttttaagtttacgtttacccgtacggtaaccccttaacgtttacctaacgttccgtaaaccccgtaacccgggttccggttagggtttaggtttttcgggtttttacggttcgggtttaccggtttccgggggtacccgggtacccgggtaccgtaacggttccgtaaccgtccgtaacggtttaacccgg

SEQ ID NO: 179683 - DNA, 783 bp, Homo sapiens
  misc_feature: GYAE6OF01DT8KW.26.5.A05.1.454.CMB.1.raw
  modified_base (191)..(191): a, c, t, g, unknown or other
  misc_feature (191)..(191): n is a, c, g, or t
tcagagactatactcacgaccggtgctcgatttagatagatagacagggacccaaaaaccacgacccctccttgggagaatcccctagactcacagctcctcacccatggactggacctggagccacttccttttcttggtggcagcagcaacaggtgcccactcccaggttcagttgctgcagtctgganctgagatgaagaaggccgtggggccctacgagtgaaggtcctccgtgtcacggtcttcgtggttacaacgttttcgtacgaacctagtcggtaactcgaagtaccgttaggggtcgaccgaccgtaccgggtcccccgtagggaaccgtaacggggtctttagggagggttgggggtagggagtcgggacttccgacggtacccccgtttagaggttcggtacaccgtaacgaacggtacttaacgtcgtaacgtaccgaaggtaacggtaacggttcccgaagggggtcccggttaccaccgtagtccggtaccctagttccggaaccgtaaccgtttaccgaaacgtaaaccgtaccgtaacgtccttaaaccgtagttcggtaacgtcgtacggtaacgtcggttacgtacggtaccgttcgtaacggaaccggtaacccgtaccgggttccgttagttaacttaccgttaggtccggagggtaaccgtaccgtacccgtttaggttaccgtttaacgtttcgggtaaacccttcgggttacggggaccgtaacgggttaacccgtggttacccctacgttcgttaccg

SEQ ID NO: 179684 - DNA, 599 bp, Homo sapiens
  misc_feature: GYAE6OF01AUVMO.26.5.A05.1.454.CMB.1.raw
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccaggacagagggtcaccatctcctgcacgtgggagcagctccaacgatccggggcaggtcgtaatgtacactggtaccaacatcttaccaggaaccacgccccaaatcgacatctactaacaacngcattccggcctcgacgggtccctggacccgtattccncgtgctaccgaagtctggccacctcgacgtcccctcccgtcggccaactccacgttggacgttacgaggctaggaggagttcggagttaccgttaattaacttacgtactacccgtaatcccttaagtacgaaccgtaaccgtcccgtagggttacgttagggtttttcggtaggttacggttttcccgggacgggtacccgggtaacccgtaaaggtccgttaccgacggtaaccgg

SEQ ID NO: 179685 - DNA, 606 bp, Homo sapiens
  misc_feature: GYAE6OF01A94D2.26.5.A05.1.454.CMB.1.raw
tcagagactatactcacgaccggtgctcgatttagatagatagacaggggctctgcttcagctggtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactggggagcagctccaacagtcggggcaggtcgtaatcgtacacgtggtaaccaacatcttaccaggaacacgcccccaaaactcgtcactctactaacaaacacgcacgttcgggcctcgacggggttcccctagacccgtacttcctcgtcggcctaccgaacgtctcgggacctaccctctacgccctcccgtcggacctatccaaccgttggaaccctacgacggtctaggaaggtagtggaggtactttacgttatttaccgtacgtacctaacttcctaatcgaacccgtaaccgtccgtaggtacgtttgggtttgtcggttggttttaccggggaccggtaccgggaacctaaggccgtacgacgttaaccgg

SEQ ID NO: 179686 - DNA, 986 bp, Homo sapiens
  misc_feature: GYAE6OF01CJW6R.26.5.A05.1.454.CMB.1.raw
  modified_base (254)..(254): a, c, t, g, unknown or other
  misc_feature (254)..(254): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgagggtcctgggcccagtctgtgctggacgcacgcccgccctcagtgtccgtcggggccccaggactaggacggtccaccagttcctccgtcgccgtacggtcggggaanccgacgtccgttaacccgaacgtaaccggggtcgggggaccgtaacgggttacggttaactacggtaccgtaacgttaccgggtaaaccctaacctacgtttccgttaacccggaaacggtaaaccccgaacccggtaaacccccctaaaacgtttccggtaacccttacttaccccgttaacgttaaaacccaaaaaccgtaccggtaaccgttaaccgggtttacccgggggtaccccgttaccggggtaaccccgggggttttaccccgttaaacccgggtaacccgggtttaaccttttcccggtacccggtttaccggggttaccccgttaccccggttaaaccggttcccggttaccgggtaccccttaaaccccggttaccgtacccccgggttccccttaacccccgggtacggttacccctaaacgttccccgttaaaccgttaccgggttaacccgtaaacccggtcgggttaacccggtagggtaacggggtaaggtaccgggttaaggtttaaccttttaacgtttaaccttacggttaccgtaaaccgtaacctttccggttaaacttacccgggaaacccgttaccgggtaaccggtttgggtttaacgtttttcggggttttacgggtttaccgggttttacgggttttacccgggggccgggttaaacccggggtaacccttggttaaccccgtacggttaacggttaaccccggg

SEQ ID NO: 179687 - DNA, 670 bp, Homo sapiens
  misc_feature: GYAE6OF01B3K8Z.26.5.A05.1.454.CMB.1.raw
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagagccgtgggcctcagtgaaggtctctgtcaggcttctggttactactttcgtcgacctagtggtatcgagtctgggtcgcgacncggccctggacgagggcttggaggtgggtggatggatcacgtcccttagngtggcaacgcaagctatcaagtccgaagagtaacgttccgacgggtcccggtacaccgtagtacgtccagtcggactacgttacaacggaacacgtaacgtactaacgagttacgggacgtcgtcggtacggtacgttcgtacgtaaccggttctaacgggaacccgtaccggtacccgggtcggttacgttaaccgtttcggtggtcggtaacggaggttacccgtaaccccttagtttaccggtttagtttaccggtaaccgttaccggtacccgggggaaccttaaccggggggtaccccccttagggtacccccttacccggttccgtacccggg

SEQ ID NO: 179688 - DNA, 650 bp, Homo sapiens
  misc_feature: GYAE6OF01CXS38.26.5.A05.1.454.CMB.1.raw
  modified_base (292)..(292): a, c, t, g, unknown or other
  misc_feature (292)..(292): n is a, c, g, or t
  modified_base (354)..(354): a, c, t, g, unknown or other
  misc_feature (354)..(354): n is a, c, g, or t
  modified_base (545)..(545): a, c, t, g, unknown or other
  misc_feature (545)..(545): n is a, c, g, or t
tcagagactatactcacgaccggtgctcgatttagatagatagacaggggacccaaaaccacacccctccttgggagaactcccctagatcacagctcctcaccatggactggacctggagcattccttttctggtggcagcagcaacgaggtcgcccactcccaggttcagttgctgcagtcgtggagctgagataggaagacgccgtgggcacgagtgaacggtctccgtgtcgcggtcttcgttacggttactacgtttcgagacctagtggtatcgagtcgtgggtcncgacgacggcccgtaggacggaggtgttggaggtggggtgagtgatccgtacgtccgttagnggttacggacacgaacgtacgtactactactacgtaccgaaggtacggtacggtcggacgggggtaccgtacactagtcgacgaggtcgaacgtactacgacaacgtacacgtactaacgagtaggactggtacgactaggtccgttggacgtcgacggaaccgcggtacccgtgttaactagtttaccgnggtcgaacgttgaacccgtacgtttagttcgttaaggttcgtaccgttaccgggtacgggaaccccgttacgggacccggtttaccgcgtacccgttccggaccg

SEQ ID NO: 179689 - DNA, 675 bp, Homo sapiens
  misc_feature: GYAE6OF01AMGM6.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagccgtggggcctcgagtgaaggtctccgtgtcaggcttcgtggttactactttcgtagtaccagtggtatcgagcgttggggtcgcgacgacggccccgtggaacgtaaggggtcttaggacggtggggtggagtggactcgacgtcccttagacggtggtacgacacgacgtaactatcataccgaggtaacgtacggttccgacggggaccgtacaaccgtagtcgtaccaggtcggtaacctacggttaccaacgaaccacgtacggtacctaacgtagtacgggactcgtacggacgtacggtctacggaccgttcgaggaacccgtacggtaccgggtaccgttagttaacttacgtacggtcggacgacgtaaccgtaccccgttagtttaccggttagttttacggaccgttacggtaccggggtaccgtaaccgggtacccttagggtaccctcccggttcgtacccg

SEQ ID NO: 179690 - DNA, 557 bp, Homo sapiens
  misc_feature: GYAE6OF01EUYKP.26.5.A05.1.454.CMB.1.raw
  modified_base (319)..(319): a, c, t, g, unknown or other
  misc_feature (319)..(319): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccaggacagagggtcaccatctctgcacgtgggagcagcctccaacatcggggcaggtcgtaatgtacactggtaccaacatcttccaggacacgcccccaaactcgtcatctctacaaacngcagttcgggcctcaggggtccctgacccgattcctctaggcctccaagtctaggcctacctcacgccctccctcggccctatcactcggactacaggctgacggatcggagtacttattacttactcgtaccaacttacctaatcgaacctaacccggacccttaggtaagtttgggtttttgtcggtacgtttttcgggccgggtaccgggtaccaaggtctcccgacgtaaccgg

SEQ ID NO: 179691 - DNA, 792 bp, Homo sapiens
  misc_feature: GYAE6OF01CR1VI.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcattccttttcttggtggcagcagcaacaggtgcccactcccaggttcagttgctgcagtctggagctggagagtgaagacggccgtcggggcctgagtggaaggtctcctgtcgagtcttctggttactacgtttcgtcgacctagttggtactcagtcgtgggtcgcgacgacggccccgtagggacgtaacgggtcgtttaggacggttgggggtagggtagtgggtacgttacgacggtaccccgttaggtacggtcggtacgaacgacgaacgtacttactcaacgtaccgaaggaaggtaaccggtccggacggggtcccggtacaaccgtgtacgtaccgtagtacggaccttacgttaaccgaacgtaaacctacgtacttaaccgtacgaggtggaaccggtacgtacggtaacgtccggttacgtcggtaaccggtcgtaaaccgggaccggtaacccgtacccgggggttacgtttaagtttaacgttttaccgggcggtttacccggaaccgggttaaaccgttaccccggttacccgttttaaaggttttacggttaactttttacgggaaacccggttaccggggttcccggggtaaacccgtaaacccgggggtacccctttggggtaaaccccgttcccggttacgggtaccccg

SEQ ID NO: 179692 - DNA, 783 bp, Homo sapiens
  misc_feature: GYAE6OF01EWMS8.26.5.A05.1.454.CMB.1.raw
  modified_base (236)..(236): a, c, t, g, unknown or other
  misc_feature (236)..(236): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcgggccccaggacaggagggtcaccatctcctgacacgtggggancagcctaccaacagtcggggcaggtacgtaatcgtacacgttacggtaaccaactattccgttaccgaacggaaccacccgaccccctaaacgtccgtaccattcctacctaaccaaaccgagacctaacgtttccgggacccttcggacggggtccctacggtaccgtactttcctaccgtacggaccttacccgaaggtttccgtacggacccttaccctacgaacccggttccccgttacccccgtacgggtacccctacgttacccgtaaccggttaccggggaaacccttaaccggacggggtaccgttaacggggaaccgggttagttacggaacgggtttacttttaaacgtttaacgtttaaccgttaccggtaacccttaaaccgttaccccgttaagtaccgtaaaccccgtaaacccggttacccgggttaacggttacggttttagggtttttacggttacgggtttaccgggttttccggggacccggggtaccgggtaccgttaaaccggtcccttaccgaccgttaaccggg

SEQ ID NO: 179693 - DNA, 721 bp, Homo sapiens
  misc_feature: GYAE6OF01AEQOU.26.5.A05.1.454.CMB.1.raw
tcagagactatactcacgaccggtgctcgatttagatagatagacaggggacccaaaacccacacccctccttgggagaatcccctagatcacgagcctcctcaccatggactggacctggagcactccttttcgttggtggcagcagacaacgaggtcgcccactcccaggttccagttgcctgctagtcgtggatcgtgagagtgaagacggccgtgggcctgacggtaggaaggtctccgtagtcaggtcttcgttacggttacctaacgttttcgacgtaccgtagttcggtactcgacgtcggtcgggtcgaccgacgtaccgggtcccctagggaaccgaacggggttcttagggtagggtgggggtacggtaggtacggtacctcgaccggttaccccgttaaggtacggtttacggtacggaacaacgtaacgactttaacgactacgtaccgaaggtaacggtacgttccggaacggggtcccgtacacgtgtacgtccagtcgacgtaccgtacaacgaactacgtacgtacgtacgtaggtagaccgtacgtacggacgtacgtcgtacggtcctacggacggaaccgtaccggacgggttacgtacgttacgttacgtcgtacgtacgacgtaccgtaccgttacgtttcgttactttacgccgttacggtacggtacccgaccggttaccgtcgccgtccgtcgtccg

SEQ ID NO: 179694 - DNA, 668 bp, Homo sapiens
  misc_feature: GYAE6OF01DEWR4.26.5.A05.1.454.CMB.1.raw
  modified_base (188)..(188): a, c, t, g, unknown or other
  misc_feature (188)..(188): n is a, c, g, or t
tcagagactatactcacgaccggtgctcgatttagatagatagacaggggacccaaaaaccacacccctccttgggagaatcccctagatcacagctcctcaccatggactggacctggagcattccttttcttggtggcagcagcaacaggtcgcccactcccaggttcagttgctgcagtctgganctgagatgaagagccgtgggcctcgagtgaaggtcctcctgtcaggtcttcgtggttactaactttcgtgacctagtggtatcaggtcgtgggtcgcgacgaccggccctggaacgtagggtctttaggagggttggggtagggatggactcgacgtaccccttagaggtggtacgaacagaacgtactatacatccgaagtagtaacgttccgacggggtccgtacactagtcgactagtacgactaccgttacaacgaactacgtactactacagtagacgtcgtacggacgtacgttcgtacgtaccgttcgtacgaaccgtaaccggtaccgggtcgtttacgttaacgttcggtacgtacggtaccgacggtaacccgttacccgtttagtttaccgtttagttttacggtaccggttacccgggtcgggacccgtacgggtaaccccttcggtaccgtaccgttccgtacccgg

SEQ ID NO: 179695 - DNA, 808 bp, Homo sapiens
  misc_feature: GYAE6OF01B885M.26.5.A05.1.454.CMB.1.raw
  modified_base (153)..(153): a, c, t, g, unknown or other
  misc_feature (153)..(153): n is a, c, g, or t
  modified_base (450)..(450): a, c, t, g, unknown or other
  misc_feature (450)..(450): n is a, c, g, or t
  modified_base (523)..(523): a, c, t, g, unknown or other
  misc_feature (523)..(523): n is a, c, g, or t
tcagagactatactcacgaccggtgctcgatttagatagatagacaggggacccaaaaaccacacccctccttgggagaactcccctagatcacagctcctcaccatggactggacctggagcattccttttcttgggtggcagcagcaacgnggtcgcccactcccgtaggttctagttcgctgcgtagtcgtggacgtcgtaggaagtagtaggaaacggaacggtcccggtcgggggcccttacgacggttacgggtaacgttccgtccgtggtacgtacggttccgtttacggttacggtttaacctaccgtttcgtaccgaccttaggttcggtactcgtaggtacggttgggtcgaccgtacggaccggtccccggtaggaacggtacgggtggttcgggtagggttggggtaggagtcggtacgtacgtaccgtccgttaggnggttacggacaacgtacgaacgtacttacacacgtacgaagtacggtacgtccgggacgggccgtacacggtntcgtacgtacgtaccggacttaccgtacgaaccgtactaacgtcgtaacgttaagaccggtggaccgtgtacgggaacgtcgtacggtccggtacctaggcccggaaacgttacccgggtaccgtggtttaacgttacgttcggtacggggaccgtaccggtaacccgtccgtttaaacgttacgttttcgggtttaaacgtttaccggccggtttaccggggaacccgggtaaccggttacccggggtacccttcggggttaccccgtcccggttgtaccccgg

SEQ ID NO: 179696 - DNA, 696 bp, Homo sapiens
  misc_feature: GYAE6OF01CIPLW.26.5.A05.1.454.CMB.1.raw
  modified_base (152)..(152): a, c, t, g, unknown or other
  misc_feature (152)..(152): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
  modified_base (524)..(524): a, c, t, g, unknown or other
  misc_feature (524)..(524): n is a, c, g, or t
  modified_base (552)..(552): a, c, t, g, unknown or other
  misc_feature (552)..(552): n is a, c, g, or t
  modified_base (677)..(677): a, c, t, g, unknown or other
  misc_feature (677)..(677): n is a, c, g, or t
tcagagactatactcacgaccggtgctcgatttagatagatagacaggggacccaaaaaccacacccctccttgggagaactcccctagatcacagctcctcaccatggactggacctggagcattccttttcttggtggcagcagcaacgnggtcgcccactacccgaggttcagttgctgctagtcgtgggagcgtgagagtaggaaagacggtccggtcggggcctgagtaggaacgtctccgtagtcgacggtcttcgtacgttacctacgtttcgtacgacctagttggtatcgaggtggtgggtcgacgaccggacggtcccgtagggaacgtacggggtcttaggggtacgggtggggtgggataggtacgtacgtaccgttaccgtagggnggttaggacaaccgagtacgtactancaacgtacgaaggtacgtaccggtcgggacggggtaccgtacctaacggcgttacgtaccctagggtacccgaccgttaccgtaaccggaaacgtaacnccgtaactacgaacgtgtacggacggtntacggtagtagtcgtacgacgttcgacggaaccgacggtcggtgttagttactacggagtcgacggttaccgtaaccgttcttagtttactgttacgccggttcgggaccggaccgtacggtacncgttacccgcgttcgtccg

SEQ ID NO: 179697 - DNA, 715 bp, Homo sapiens
  misc_feature: GYAE6OF01EO201.26.5.A05.1.454.CMB.1.raw
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (224)..(224): a, c, t, g, unknown or other
  misc_feature (224)..(224): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcactagggtcctgggcccagtctgtgctgacgcacgcccncctcngtcgtcgtcgggcccaggacagacggtcactatcctcngcacgtggactcgacgcctaccaacgacggtccgggactacgggtacgtaatcggtaccacgttacggtaaccactacttccgtacgacggtaaccaccgaccccctaaagttccgtaacacttaccgtacctaaaccaacgtaccgaccgttaacgtcccgggtacctacgggccgggttaccctacggaacctacttccgtacgtccggtacttacccggtaagttccggtaccggacctacccgtacgtaccgtcccgtacccggtacgtacccgtataccgtacgttacgggacctaccggtcgtaccgtcggtaacgtagtacggtaagttacctttagttaacgtacctacgtaaccctacgtaccctagtacccgaaccgtaacccgtcgttacggttcgttttaggtttacggtaccgtttacggttccgggaaccgggtcccgtaaaccgaacgggtacccttaggtaaccttaacccgggg

SEQ ID NO: 179698 - DNA, 810 bp, Homo sapiens
  misc_feature: GYAE6OF01EPUA8.26.5.A05.1.454.CMB.1.raw
  modified_base (155)..(155): a, c, t, g, unknown or other
  misc_feature (155)..(155): n is a, c, g, or t
  modified_base (195)..(195): a, c, t, g, unknown or other
  misc_feature (195)..(195): n is a, c, g, or t
tcagagactatactcacgaccggtgctcgatttagatagatagacaggggacccaaaaaccacacccctccttgggagaatcccctagatcacagctcctcaccatggactggacctggagcattccttttcttggtggcagcagcaacaggtcncccactcccaggttcagttgctgcagtcgtggagctgagntaggaagacgccggtggggcctcgaggtagtaacggtcctccgtgtcgaggtctttcgtaggttactaacgttttcgagtacctagtacggtactccgtaggtcggtggggtcgaccgacggtaccggtccccgtaggaacggtacgggtcgttaggggacgggttggggggacgtaggtacgggacgtacccggtaccgttacccgttagacggttcggtacgaacgtaacgacggtaaacctactcgtaaccgaccgaaggtacggttaaaccgggttccggaacgggtcccgggtaccaacgtcgtaccgtccgtaagtccggtaacctacgttaaccgaacctaaccgtacgtacgttacctaacgacggtcggtaacgtccgtagtacggcgtacggttacgaccggttacgaccgggtaacccggtacccggtacgggttaccgttaaggttaaccgttgggtaaccgtgggtaaccgtacccggttacccggtttaaaccgttcgtttttaaaccggttacgttttacgggaacccgtttccggggtacgggtaactttaccgggtacccggttaacccggtttccggtacccgttccggttacccgg

SEQ ID NO: 179699 - DNA, 934 bp, Homo sapiens
  misc_feature: GYAE6OF01B2Y88.26.5.A05.1.454.CMB.1.raw
  modified_base (186)..(186): a, c, t, g, unknown or other
  misc_feature (186)..(186): n is a, c, g, or t
  modified_base (241)..(241): a, c, t, g, unknown or other
  misc_feature (241)..(241): n is a, c, g, or t
  modified_base (805)..(805): a, c, t, g, unknown or other
  misc_feature (805)..(805): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgacgggtcctgggcccagtctgtgctgacgcacgcccgcctnagtcgtcgtcggggcccaggacaggacggtcacctatcctcctgcacgtgggacncacgcctaaccaacgtacggtccgggggactaacggggttacgttaacgtcggttaacctaaccggttaccgggtaaacccctaaacgttaccgtttccgtttaaccccggaaacgggaaaaccctaaccccggtaacccccccgttaaaaacgtttccccggtacctaaccgtttaccctaacccgttaaaacccgaaaaccgtacgtacccgttaaccgggtttccccggggtaccccttaccggggtaacccgggggtttacccccgtaacgggtaaaccccggtttctttacccgtttaccggtaccgggttaccccttaacccggtaaggttcccgttaccggaccccttaacccgtccgtaaccccgttcccccgtttaccccggcgtaaccccgtactacccggttaaccgtacgggtaaccctaacggtcgggtaccgttacgggtaaggtacgggtacgggtacgttttaaccttttaacgtttaaccgttaccgttaccgttaaacccttaacgtttacccgttaacgtaacccggtaaccgttaaaccccggngggttttaccgggttacggtttttacggggttttacggttaccggtttaaccggggttttacccggggacccgggttaaaccgggtacccgtaacggttccccttaaacgtaaccggtttaccccgggg

SEQ ID NO: 179700 - DNA, 700 bp, Homo sapiens
  misc_feature: GYAE6OF01AXR3O.26.5.A05.1.454.CMB.1.raw
  modified_base (184)..(184): a, c, t, g, unknown or other
  misc_feature (184)..(184): n is a, c, g, or t
  modified_base (582)..(582): a, c, t, g, unknown or other
  misc_feature (582)..(582): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgccctnagtgtcgtcggggccccaggacgaggacgggtcaccgatccgtcctgcctacggtggggacgccgtacggaccttacccgaacgacggtccgggggacctaacgggttaccgtaaattcgtaactaccgttacggtaacccaaacgtacttacccgttaccgaacgggaacccaccgaccccctaaaacttccgtactaacctcctacctaacaaaccgacgactacgttccgggccctacggtacgtacggtcctacggtaccgtacttccgtcgtcgtcctacgtaacgtccgtacggtccaccgtccgaccgtcccctccgtcggaccactactacgtacggactacggacgtcgtaggacgtatcggaacgttacttaacgtttacttaccgtntaacccgtaactacgttacgtacgaaccggtaaccccgtcgttacggtagttttcgggtttacgttcgttacgggtttccgggacggtaccgggaacttaccgtccgtcgtaacccgg

SEQ ID NO: 179701 - DNA, 185 bp, Homo sapiens
  misc_feature: GYAE6OF01DSQS4.26.5.A05.1.454.CMB.1.raw
  modified_base (180)..(185): a, c, t, g, unknown or other
  misc_feature (180)..(185): n is a, c, g, or t
tcagagactatactcacgaccggtgctcgatttagatagatagacagggcaccaagggcccatcggtcttccccctggcaccctcctccaagagcacctctggggcacagcggccctgggctgcctggtcaaggactacttccagtatagtctctgagcgggctggcaaggcgtcatagnnnnnn

SEQ ID NO: 179702 - DNA, 754 bp, Homo sapiens
  misc_feature: GYAE6OF01CYJRV.26.5.A05.1.454.CMB.1.raw
  modified_base (186)..(186): a, c, t, g, unknown or other
  misc_feature (186)..(186): n is a, c, g, or t
  modified_base (740)..(740): a, c, t, g, unknown or other
  misc_feature (740)..(740): n is a, c, g, or t
tcagagactatactcacgaccggtgctcgatttagatagatagacaggggacccaaaaaccacacccctccttgggagaatcccctagatcacagctcctcaccatggactggacctggagcattccttttcttggtggcagcagcaacaggtgcccactcccaggttcagttgctgcagtctggngctgagatgaagaagcctggggcctcagtgaaggtctcctagtcaggtcttcgtggttactaacgtttcgtcgacctagttggtatcgagcgtgggtgcgtacacggccccgtacggacgaagggtccgtttaggacggtggggtggagtcggatcgacgtaccctttagaggtcggtacgacgtacgaacgtactaatctaacgtcctaaggaacgttaacgtttccggaaacggggtcccgggtactaacccgtagttaccgtacccgtaagtacggtacccgtaacggtttaccgaaaccggtaaaccgaaaccgtacggttaaccgtaaaccgtaggttacgggacggttaccgtacgggtaaccgtaccgggttaccgtacggttaaccgggttcgtaaaccggaaccggtaacccgtaacccggggtacgtttacgtttaaacgttaccggttcggtacgacggttaacggtaccgtacccgtttagttaccgtttagtttacgaccgttacgtacgggacctaacgggttaacccctgggttacccnccgttccgtaccgg

SEQ ID NO: 179703 - DNA, 743 bp, Homo sapiens
  misc_feature: GYAE6OF01ES4GZ.26.5.A05.1.454.CMB.1.raw
  modified_base (286)..(286): a, c, t, g, unknown or other
  misc_feature (286)..(286): n is a, c, g, or t
tcagagactatactcacgaccggtgctcgattttagatagatagacaggggctctgcttcagctggtgggcacaagaggcagcactcagacaatctccagcatggcctggtctcctctcctcctcacgttctcctcgacttcacttggacacgacggggttcctcgggacccacgtcctggtctcgtcgaccggcacgcccgccctacgtagttcgtcggtaccggggccccgaaggaccgaggtacggtaccaactactcctccgtggccgtacggtcgggaacnccgtaacgtaccgtaaccgaacggtacgggtccgggacgtacggttacgtaacgtcgtaacctacggttaccgaacctaactcgttaccgtaccgaaaccggtaacccacccgtaaccctacgttcgaccttactaccgtaacctaacgaacgcgtcgtacggtccggcgtacggtaccggttccacgtacctcttccgtcgtacgtcctacgtacgtcgacgacctaccgtaccgtcgtaccctcgaccgtctacgtaccgtacgtacgtactacggacgtcgtagtacggtagtacgtacgttaattacgttacgtacgtaccgtaccttaacgtacgtaacgtaccggtaccgtaccggttaccggttagggtttacgttttgggtttacggtacggtttaccgggtccgggaacccggttacggtaactaccgtaccgttacgtacggtaccg

SEQ ID NO: 179704 - DNA, 538 bp, Homo sapiens
  misc_feature: GYAE6OF02ITZ32.26.5.A05.1.454.CMB.1.raw
  modified_base (431)..(431): a, c, t, g, unknown or other
  misc_feature (431)..(431): n is a, c, g, or t
  modified_base (481)..(481): a, c, t, g, unknown or other
  misc_feature (481)..(481): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggagcagcctccaacatcggggcaggtcgtaatgtacactggtaccaacatcttccaggaacacgcccccaaatcgtcatctactaacaaacagcattcgggccctcgaggggtcccctgaccgtattctctggcttccaagtctggcacctcacgccctcctggcctatcactggactacaggctgaggatgagtctttaatnttaacctgacctaatcctatagaccaaccgcgttggaatttggttttagngttacggtttttccgggacgggtaccggggtaaccaacgggtcctaccacgttaacg

SEQ ID NO: 179705 - DNA, 714 bp, Homo sapiens
  misc_feature: GYAE6OF02FZIO9.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacaggaggtccaccatcctcctgccacgtgggagcagcctaccaacacgtcggggctagggtacgtaagtcgtaaccacgtacggtaacccaacgtacttccttaccgaaggaacacccgaccccctaaacgtccgtactactcctactaaaccaaacacgactaacggttccgggacctcggaccggggttcccctacggaaccgtactttccgtcgtcggacccttaccgtaacgttcgtcggacctacctcgaccgtcccctcccgtcggacctactccacgtacggaaccgtacgacggtctaggacggtagtaggtacggttactttacgtttaacgttacgtaccgtaacctaacgtttaccctaagttaccgaacccgtaacccgtaccggttagggttaacgttttggggtttttacggttacggttttacgggtttttcccggggtaccggggttacccggggtaaacccgtaacggtacccgttaccgaccggttaacccggg

SEQ ID NO: 179706 - DNA, 586 bp, Homo sapiens
  misc_feature: GYAE6OF02JA4A1.26.5.A05.1.454.CMB.1.raw
  modified_base (247)..(247): a, c, t, g, unknown or other
  misc_feature (247)..(247): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagcccgccctcaggtgtcgtcggggccccaggacaggagggtcaccatctcctgcacgtgggagcagctccaanagtcggggcaggtcgtaatgtacacgtgtaccaacatctaccaggaacacgcccccaaatcgtacatctactaacaacagcattccgggcctcgacgggtccctgaccgtattcctctggcctaccaagtctggcctacctcacgccctccgtcggccctatcctacgtcggtaacctacgacggtcctaggaaggagtgaacggttacttagttacgttaccgtcgtacctaacttacctaacgtcgaacctacccgtacgtaggtacgtttggtttacgtcgttacggttttcgggaccgggtaccggtaccgtaacggtcctaccggtacgtacgg

SEQ ID NO: 179707 - DNA, 179 bp, Homo sapiens
  misc_feature: GYAE6OF02G33EF.26.5.A05.1.454.CMB.1.raw
  modified_base (178)..(179): a, c, t, g, unknown or other
  misc_feature (178)..(179): n is a, c, g, or t
tcagagactatactcacgaccggtgctcgatttagatagatagacagggcaccaagggcccatcggtcttcccctggcaccctcctccaagagcacctctggggcacagcggccctgggctgcctggtcaaggactacttccagtatagtctctgagcgggctggcaaggcgcatagnn

SEQ ID NO: 179708 - DNA, 773 bp, Homo sapiens
  misc_feature: GYAE6OF02JM2G1.26.5.A05.1.454.CMB.1.raw
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
tcagagactatactcacgaccggtgctcgatttagatagatagacagggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacagagggtcaccatctcctgcactggacgcagctccaacagtcggggcaggtcgtaatcgtacactggaaccaanacttcctccgaacggaacacgacccccaaatccgacatctactaaccaaacncgctaacgttccgggacctacgaacggggtccctacggaccgtacgttcctcgtacgggcccttaccgtaagttccgtacgggtaccctaacccgttccgaaccggtcccccttcccgtacgggtacccctaacgttcccgtaaccgttacgggtaaacccttaccggaaccgggtccgtaacggtacgggaagttccgggaaacggtttaccccgttttaaagtttaacccgttttaaccgttacggttaacccctaaaccgttttacccgttaaacgttaccgtaaacccgtaaccccggttaccggtttaccgggtaacgtttttacgggtttttttacgggtaacggttttaccggttttttaccgggggacccgggttaacccgggggtaaccccttaacgggttaccccgttaaccgtacccgggtttaaacccggg

SEQ ID NO: 179709 - DNA, 537 bp, Homo sapiens
  misc_feature: GYAE6OF02HH9OE.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttacaactttcgtgaccatggtatcagctgggtgcgacaggcccctggacaagggcttggagtggggtgggatggatcgagcccttagagtggtgacacagactatcatccagagaagttccaggggccggtcaccagtcgtccatggactacgttcacgaacacagtctacatggagctgacgtagtctagacgtctagacgacgacggccgttagtacttacgtgtcgacgagacgtaccctagttcgtatttggacttacgtgggaccacgggtacctcggtacgtaccgtcgtcg

SEQ ID NO: 179710 - DNA, 759 bp, Homo sapiens
  misc_feature: GYAE6OF02HA55U.26.5.A05.1.454.CMB.1.raw
  modified_base (257)..(257): a, c, t, g, unknown or other
  misc_feature (257)..(257): n is a, c, g, or t
tcagagactatactcacgaccggtgctcgatttagatagatagacagggcgtctgctttcagtctgtgggcacaagtaggcagcactcagggacaatctccaagcatggccgtggtctccgtctcctctcgactctcctcgctcactgcacaggtcctcgggccacgtctgttcgcgtgacgccgacgtcccgccctcacgtcgtccgtacggggccccaggaccaggacgggtccaccatctcctagcgactgganctagctccgaactagtcgggacacggtcgtaagtcgtactacttcggtaaccaacgtacttaccgttaccgaggtaacctacggttacccccgtaaaattccggtaccgtaaccgttcccggtaccttaaccgaaaacctacggtaccgtaacgttcccggggacccttacggtaacgggggttcccctacggaacccggtatttacccgtacgtacgggttacctacccgtaaagttaccgtacggaaccctaccgtacgtacggcccgttaccgtcggtaccgtaacgttccgttaaccggttacgtaaccgtacgtacggcttacggacgtagtacggtaacggtactttaacttaccgttaacgtacgtaccgtaacgttaccgtaacgtacgaaccgtaccgtaccgtacggtaacgtttacgggttttggtcgtttaacgttttccgggaaccggttaccgggtaacctacggttaccttaccgtagttaacccgg

SEQ ID NO: 179711 - DNA, 637 bp, Homo sapiens
  misc_feature: GYAE6OF02G5L7W.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctccgtgtcaggtcttctggttacaactttcgtgaccattggtatcgagtcgtgggtgccgacgacggccccctaggaacgaagggtcttggaggttggggtgggagtgggactcgacgtcccttacgaggtcggtagacgacagactatcatccagagaacgttccgagggcccgggtacaccgtagtcgtaccgtagtacggacctacgttaccaacgaactacacgtactacagtggagcgtagacgtagtctagtaccgtcgacgaaccgacgtaccggcgttacgttacgttacgtcggtacgccgaacggtaccgtacccgtttaggttaccgttaacgttttacggaaccgttacggtcggggacccgtaaccgggtacccgttcgggtaccgtacccggttctacccgg

SEQ ID NO: 179712 - DNA, 554 bp, Homo sapiens
  misc_feature: GYAE6OF02F82GT.26.5.A05.1.454.CMB.1.raw
  modified_base (325)..(325): a, c, t, g, unknown or other
  misc_feature (325)..(325): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttacaactttcgtgaccatggtatcagctgggtgcgacaggcccctggacaagggcttggaggtgggtgggatggatcagcccttanagtggtgacacagactatcatcagagagttccgagggtccggtcaccgatcgtaccagtcggactacgttacacgaacacagtctacgagtggagctaggacgtagtctagcgtctcgacgacgcggtccgttagttacttacgtgtagacgagaccgtacccttagttcgttatttcgaacttcgtcggggaccctagggtacccctggtaccgtaccgtgtacccgg

SEQ ID NO: 179713 - DNA, 511 bp, Homo sapiens
  misc_feature: GYAE6OF02HV9K6.26.5.A05.1.454.CMB.1.raw
  modified_base (317)..(317): a, c, t, g, unknown or other
  misc_feature (317)..(317): n is a, c, g, or t
  modified_base (434)..(434): a, c, t, g, unknown or other
  misc_feature (434)..(434): n is a, c, g, or t
  modified_base (473)..(473): a, c, t, g, unknown or other
  misc_feature (473)..(473): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggacagagggtcaccatctcctgcactgggagcagctccaacatcggggcaggtcgtaatgtacactggtaccaacatctccaggaacacgcccccaaatcgtcatctctacaaacngcattcggcctcgagggtccctgaccgattctctggctccaagtctcggcacctcacgccctcctggcccagtcactcggaacctacaggctagaggatgaggtacttattattacngacctaatcctatgaccaaccgcctaggatttggtttgngttacgtttcggcggcggtaccaaggcctcgataccgg

SEQ ID NO: 179714 - DNA, 720 bp, Homo sapiens
  misc_feature: GYAE6OF02GMTFV.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttactaactttcgtgaccatggtatcagcgtgggtgcgacgacggcccctggaacgaagggtcttggacgggtggggtagggtagtgggactcgacgtacccgtttacgaagggttggtacgaacgacgtacggtaacttagtaccagtacccgaaggtaacgtaacggttccggaacgggggtccggtaccaacctagtccgtaccgtagtcgggtaacctaaccgttacgaacggtaaccacgtacgtactaacagtacggagtctaggtaccgtagtccgtagtaccgtcgtcggaacgaccgacgggttaccgttagtttaaccgttacgtaggttcgaaccggtacgtaacccggtaccccgtttaagttttaccggtttaacgtttttacggaaccgtttaacccggttacgggggtaacccgtaaccggggtttaacccggttcgggttaccccgttaccggtcccgttacccgg

SEQ ID NO: 179715 - DNA, 711 bp, Homo sapiens
  misc_feature: GYAE6OF02F7VCA.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggagcagctccaacagtcggggcaggttatgatgtacactggtaaccaacagttccaggactcacgtaccccaaactccctacacttctcgtacgggaaccaccgtaacgtcccggacccctcgaccgggggttcccctacggtacccgtactttccgtccgtcgggtaccttacccgtaacgttccgtcgggtaccctaaccccggttcccgggtccccctttccccgttcgggttacctacgttacccgtaccgttcggggcccttaacccgaaaggtacgttacgggaacgggtacgttacgggacggtcgttaaggttaacttttaacgttaccgtcggacccttaaggttaccgttaataccggtaaccgtaaccgtttaccgttaacgtttggttaacgtttcgggttaccgggaacgggtacgggtacccggtacggggttaccgtacccggttcccgttaccggtccgtaacccgg

SEQ ID NO: 179716 - DNA, 648 bp, Homo sapiens
  misc_feature: GYAE6OF02IQE3O.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaaagaagccgtggggcctcgagtgaaggtctcctgtcaggcttcgtggttactaactttcgtgaccatggtatcagctgggtgcgacgaggccccctgggaaccgtaagggtcttaggaggttggggtgggagtggtatcgacgtcccgttagagtgggtacgacgaacagtactatacatccagaagtaacggtccgacgggccggtacacctagtcgccgtagtcggacctacggttcaacgaacgactacgtactacagtaggacgtcgtagacgacgttcgtaggaccgttcgacgaaccgacgtacccgggacgttacgttacttacggtgacggtacgaacgtaccgtaccctttagtttaccgtttagttttacggtaaccgttacgggtccggggtaccgtaaaccgggtacccgttcggttaacccgttcccggttccgtcccgg

SEQ ID NO: 179717 - DNA, 652 bp, Homo sapiens
  misc_feature: GYAE6OF02I4CW2.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtctcgggcccaggacaggaggtcaccatcctcctgcacgtgggagcagctccaacacgtcgggcaggtctaagtgtacactcggtaccaactactctaccaagaacacgaccccaaactcgtacactctactaacaacagcacgtcggcctcgacgggtccctcgaccgtacttccgtcgtcggccttacctaacggttccgttcggaccctaccgttccgtaaccgtcccgttcccgtacggccctaacttacccgtaaccgtcggtaacctaccgtacggtaccgttagggaacggtacgtacggtacggttacctttaacgttaacgtttaaccgtacgtacctacgttaaaaccttcgtacgaacccgtaccgtcgtacggttacgtttcggtttacgtacggttaccgttttcgggacccgggttaccggaccgtaacggtctaccgtaacgttaccgg

SEQ ID NO: 179718 - DNA, 615 bp, Homo sapiens
  misc_feature: GYAE6OF02ID386.26.5.A05.1.454.CMB.1.raw
tcagagactatactcacgaccggtgctcgatttagatagatagacagggacccaaaaaccacacccctccttggagaatccctagatcacagctcctcaccatggactggacctggagcatccttttcttggtgcagcagcaacaggtgcccactcccaggtcagttgctgcagtctggagctgagatgaagaagccgtgggcctcgagtgaaggtctcctgtcaggcttcgtggttactactttcgtgtaccagttggtatcgagtcgtgggtgcgacacggccctggaactagggtcttggaggtcgggtggatggatcgacgtcccgttagacggttggagaacacgagactatcatccgagacgtaagtccgaaggggtccgtacaccgagtcgtccgtagtacggtactaccgttacgaaacccgtaacacgtacgtactaacgtagtacggacgtacgtgacgtagcgtgacgtcgtacgacgacgaccggtcttaggtacttacgtgtcgtacgacgtacgtacccttacgttcgtttacgtttacgtaccgttacggtcgggtacccgtacgggtaacccgtcgggttacctcccggttacgtccgg

SEQ ID NO: 179719 - DNA, 724 bp, Homo sapiens
  misc_feature: GYAE6OF02GDLLD.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtggggccccaggacagagggtcaccatctcctgcagtgggagcagcctaccaacagtcggggcaggtcgtaatgtacacgtcggtaaccaacgatccgttaccgaaggaaccacgacccccaaacttcgtacatcctactaacaaacacgactagttccgggcctacggtacgggggtacccctcggaacccgtatttaccgttacgtccgggaccttacccgaaacggttccgtaccgggtacctaacccgttaccgaccgtccccgttccccggttacggaccccttaacgttacccgaaccgttaccggtaacccgtaaccggacggtaccgttagggaacggtacgtacgggacggtaccttagttaacgttttaacttaccgtcggtaccctaggttaaccgtagttacggtaacctaaaccgtttccgttaacggtttagtttaacggtttcggttaccggggtaaccgggtaacggggtacccggtaggggtaaccgtaccccgggttaccgtaaccgggtaacccgg

SEQ ID NO: 179720 - DNA, 704 bp, Homo sapiens
  misc_feature: GYAE6OF02JP10S.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacaggagggtcaccatctcctgcacgtgggagcagcctccaacagtcggggcaggtcgtaatcgtacacgtagtaaccacatccttaccgaacggaacaccgaccccctaaacgtccgtactaactcctaccgtaacaaaacacgactacgttccgggcccttacggaccggggttccctacggacccgtacgtttcctcgtacgggtccctaccgtaagttccgcgggtaccctacccgtccgaccgtccccgtaccccgtcggaccctaacgtacccgtaccgttacggaacccttaacggacggttctaacgggtaacgggtacttagggtaacggttactttacgtttaacgttaccgtacgtacccgtagtttacgtaacgtaccgtaacctaccgttccgttaacgtttcggtttacgtttcgggtaccgggtacgggaacggtacccggtcggtaccggtttccggtaaccccggttacggttaccggtaccgg

SEQ ID NO: 179721 - DNA, 599 bp, Homo sapiens
  misc_feature: GYAE6OF02GPN6Z.26.5.A05.1.454.CMB.1.raw
  modified_base (507)..(507): a, c, t, g, unknown or other
  misc_feature (507)..(507): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccaggacaggacgggtcaccatcctcctgcacgtgggagcagctccaacagtcggggcaggtcgtaatgtacactggtaaccaacatcttaccgaaggaacacgacccccaaactcgcatctctaacaaacagcattccgggcctcgacgggtccctggaccgtacttcgtctcgggccttaccgaagttccgtcggaccacccgtcacggccccttcccgtacggccctatccacgtcggaacctacgaggtcctagggaggtagtcggaggttacttatttaacttacgtcgtacctaacgttcctancgaaccaccgtcctagggtaagtttggttttagtacgtttacgttttcgggaccgggtaccgggtaaccacggtcctaccaaggttacccgg

SEQ ID NO: 179722 - DNA, 189 bp, Homo sapiens
  misc_feature: GYAE6OF02IBG76.26.5.A05.1.454.CMB.1.raw
  modified_base (178)..(189): a, c, t, g, unknown or other
  misc_feature (178)..(189): n is a, c, g, or t
tcagagactatactcacgaccggtgctcgatttagatagatagacaggcaccaaggcccatcggtcttcccctggcaccctcctccaagagcacctctcggggcacagcggcctcgggctgcctggtcaaggactacttccagtatagtctctgagcgggctggcaaggcgcagtagnnnnnnnnnnnn

SEQ ID NO: 179723 - DNA, 745 bp, Homo sapiens
  misc_feature: GYAE6OF02JZ76R.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccaggacagagggtcaccatcctcctgcacgtgggagcagctccaacgagtccgggcaggtcgtaatgtacactggtaccaacattcttaccaggaaccacgacccccaaaacgtccgtacactaccgtactaacgaaacacgactacgttccgggcctcgaacggggttcccctaggacccgtacttccgtcgttacggtcctaccgtaacgttccgtcggtacctacccgtcgaaccgtccccgttcccgtcggtaccctaactaccgtaccgtacggtaacccttaaccgaacgggccgttacgggtaacgggaacgttacggtaacgggttacccttttaagtttaaccgttttaaccggttaccggtaaccctaaaccgtttaccccgtttaaacgtacgtaaccccgtaaacccggttccggtttacgggtaaacggttttcgggtttttaacggttacgggtttacggtttttacccgggggacccgggttacccggggtaaacccgtaacggtcccgttacccgaacggttaacccggg

SEQ ID NO: 179724 - DNA, 575 bp, Homo sapiens
  misc_feature: GYAE6OF02GS4D5.26.5.A05.1.454.CMB.1.raw
tcagagactatactcacgaccggtgctcgatttagatagatagacaggggacccaaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttacaactttcgtgaccatggtatcagctgggtgcgacaggcccctggacaagggtcttgagtgggtgggatggatcacgtcccttacgagtggtgacacagactatcatcagagaacgttcgagggccggtcaccgatcgtaccagtggactacgtttacgaaccgaactacgagtacctaacgagtaggacgcgtagacgtagtcgtggtaccgtcgtgacgaccgacggccgttagtacgttctggtgcgagacgtacccttagttcgttaattttcggtaccttacggtcgggaccgtacgggaacccgttggtaccgtaccgtcgtaccgg

SEQ ID NO: 179725 - DNA, 780 bp, Homo sapiens
  misc_feature: GYAE6OF02GRF7J.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcagtcgcgacgtcttcgttagttaaccttacgtttcgtacgaacctagttaggttactacgacgtcggttgggtcgaccggacggacccggtccccggtaggaaccggaacggggtcttaggagggttgggggtagggtaggtaggatacgaccgttacccgttaacgtagggttcgggtacaaccgacgaacgtaacttactactacgtaccgaaggaaggttaaccgtcgggaaccgggggtccggtacccaacgtacgttcgacgtaggtacggactaccgttaccgaaacgtaaccacgtaccgttacaactaggtaggtacgtacgacggaacgtacgttacgtcggtacgttccgaggtacccgacggtaccggtccggttaagtttaaccttacggtaggtacccgaaggtaccggtacccgttaaacccgttttggtttaaccggttttacgtttaaccggtaacccggtttcgggggaccggggttaaccgggttaaacccggggtaccccgggtttaccggttacccggttacccggtttaccccggg

SEQ ID NO: 179726 - DNA, 684 bp, Homo sapiens
  misc_feature: GYAE6OF02IMF3O.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgacgggtcctcgggcccagtctgtgctgacgcagcccgtcctcagtcgtcgcggggacccagggacagacgggtcaccatcctcctgacacgtgggacgcacgctcccaacgacgtcgggggacagggttacgtaacgtagtaccaacgtacggtaccaaacgtattcccttacgaaggaaccaccgaacccccaaacgtccgtactactacctacaacaaaacgacgactacgttccggcctcgaacggggtccctcgtaccgactttccgacttcggactaccgaagttccgtcggactaacccgtcacggtccctacccgtgacccaatcgtaacgtcgtaactaccgaggtctaggaacggtatcgggtaacgtacctttagtttaactccgttacgaacttaaaccgtcttaaccggtagaacccgtacccgttacggtaggttaacgttttggggttttacctagggttttaaccgtccggggtaaccggggttacccgggaactaaacccggtcgtaccgtaccgttaccggg

SEQ ID NO: 179727 - DNA, 584 bp, Homo sapiens
  misc_feature: GYAE6OF02HE5EC.26.5.A05.1.454.CMB.1.raw
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccaggacaggagggtccaccatctcctgccacgtggggacgcgacgctaccaacgagtcggggcaggtcgtaatgtacacgtcggtaaccaacattccttaccgaggaaccacgacccccaaactcgacactcctactaacaaacngctacgtccgggcctcggacgggtcccngaccgtattcgtctcgcctcgtaacgtcncggtccacctcacgccctcccgtcggcccactccacgtcggacctacgacgtcgtggaggtatggaggttactttaagtttacgttactacgtacctaactcctatacgaacctaccgtcgtaggtagtttggtttcgtgttacgtttcggcgggtaccggactacggtctacgtacgtacg

SEQ ID NO: 179728 - DNA, 543 bp, Homo sapiens
  misc_feature: GYAE6OF02F4PDS.26.5.A05.1.454.CMB.1.raw
  modified_base (231)..(231): a, c, t, g, unknown or other
  misc_feature (231)..(231): n is a, c, g, or t
  modified_base (451)..(451): a, c, t, g, unknown or other
  misc_feature (451)..(451): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggancagctccaacatcggggcaggtcgtaatgtacactggtaaccaacatcttccgaggaacacgacccccaaactcgtcatctactaacaaacagcagttcgggcctcgacggggtccctggaccgattctctggcctaccgaagtctcggccaccgtcacgccctcccgtggccctatccacgtggacctacgaggctgagtatgaggtcttattattacngtacctaatcctatcgaccaccgtccaggtattggttttgtgttagttttccgggacggtcgggtaacctaaggtcctaccgacgtaaccgg

SEQ ID NO: 179729 - DNA, 783 bp, Homo sapiens
  misc_feature: GYAE6OF02G3R54.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgacgggtcctgggcccagtctgtgctgacgcgacgccgccctcgagtcgtcgtcgggccccaggacaggacggtcaccgatcctcctgcacgtgggacgcacggcctaccgaacgtacggtccgggggactacgggttacgttaacgttcggtaacctacggttacggtaacccaacgtacttacccgttaccgaacggtaaaccacccgtaaccccccgtaaacgtccgtacattaccgtactaaccaaaacgcgactacgttccgggtaccgtacggtaccggggttccctacgggtaccgtactttccgtacgtaccggtacctaccgtaacgttcggtacggtaccctaccgttaccgaccggtcccctccggtaccggtacctaacgtacccgtaccggttaccggtaaccgttacggaccggtacgttacgggaacggttacgtaccgggtaaggttaccttttaaacgtttacgttaaccgtaccgttaacctaaaccgtttacgtaacgttaaccgtaacccgtacccggttacgttacggggtttcgtttaacgggttttcggtaacggttttacgggtttcccgggacggggtaccggtaccgtaggtccgtaccgtacggttacccgg

SEQ ID NO: 179730 - DNA, 748 bp, Homo sapiens
  misc_feature: GYAE6OF02JJRDS.26.5.A05.1.454.CMB.1.raw
  modified_base (176)..(176): a, c, t, g, unknown or other
  misc_feature (176)..(176): n is a, c, g, or t
  modified_base (186)..(186): a, c, t, g, unknown or other
  misc_feature (186)..(186): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
tcagagactatactcacgaccggtgctcgatttagatagatagacaggggcgtctgcttcagctgtgggcacaagaggcagcactcaggacaatctccagcatggcctggtctcctctcctcctcactctcctcgctcactgcacgaggtcctgggcccagtcctgtgctgacgcncgccgccctnagtcgtctcggggcccaggacaggacggtcaccgactctcctgcacgttggggancgnggcctaccaacgtaggtcgggcacggtacgtaagttacgtacgtacgtcggtaaccgaactaacgttccttaccgaaggtaaccaccggacccctaaactccggtacacttacctacctaaaccgaaacctagaccgtacgttaccggggtaccctaccgggtaaccgggggtttccctaacgggacccgttaacttcccgttacggttacggcccttaccgaacgtttcggacggtccctaacccgttcaacccgtccccgttaccgttcgggaccctacgtccgaccgtttacgggaacctacggtaacggtcgtaacgtaacggtgtaccggtaacgttcttaaagttttacttacgtaccgtaactaacgtttactaacgttaccgaaccgttaccctaggtacgtttggtttacggttttacgggtacgtttacgggtttccgggaacccgggttccgggtaaaccgttaacggtaccgttaccgtaacgttaacccgg

SEQ ID NO: 179731 - DNA, 657 bp, Homo sapiens
  misc_feature: GYAE6OF02I8IK1.26.5.A05.1.454.CMB.1.raw
tcagagactatactcacgaccggtgctcgatttagatagatagacaggggacccaaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttcgtggttactaactttcgtgacctatggtatcagcgtgggtgcgacgacggccccgtggacgaagggtcttggaggtggggtagggagtgggtaatccgacgtaccccttagtaggtcgggtagaccgacgagactaactctaactaccgaagtaacgtaacggttcccggaacggggtcccgggtacaaccgtagttccgtacgtagtacggacctacggttaccaaccgaacaccgtacgtactaacgtatacgggactacgtacggacgttagtcgtacgtcggttgagaccggaccgtacgggccttagttattcgtgtcgacggtacgaccgtaccgttagtttcgttagttttcggaacgttccggtacgggtacctaacggggtacccttaggtacccgttacccgtcgtcccgg

SEQ ID NO: 179732 - DNA, 719 bp, Homo sapiens
  misc_feature: GYAE6OF02IU2DV.26.5.A05.1.454.CMB.1.raw
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (359)..(359): a, c, t, g, unknown or other
  misc_feature (359)..(359): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtcgtcgtcgggcccaggacaggacggtcaccatctcctgacacgtgggacncngcctaccgaacaggtcggggacaggtacgtaatcgtacacgtacggtaaccaactacttccttaccgaacggaaccaccgaacccccctaaactcgtactaactcctaacgtaacaaacncgtactacgttacgggcccctacggtaccggggttccctaacggtaccgtaactttccgtacgtcggtacctacccgtaagttcccgtacgggtaccctacccgttaccgtaacccgtccccgttaccccggtcggtaccctaactacccgtaaccgttacggtaaccgtacgtacgggtacgttaggaacggtacgtacggtacggttactttaacgttacgttacgtaccgtaactaacgtacctagtacgtaacccgacccgtacgttaggtaacgttttacggtttggttacggttacggttttccgggaccgggttacgggtaacccgtacggtaccgttccggaccgtaaccgg

SEQ ID NO: 179733 - DNA, 763 bp, Homo sapiens
  misc_feature: GYAE6OF02JUNYP.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcacctctcctcgctcactgcacgacggtcctcgggcccagtcctgtgcgtgaccgcacgcccgcctcacgtcgtccgtcggggcccagggcacggtaggtcaccgtatcctccgtgaccacgtgggacgctaacggcctacccaacgaacggtccgggacgtacgggttacgttaaacgtcggttaacgacgttaaccggaaccctaagtccttaccgttaccgaacggaaccaaccccgaccccctaaacgtccgacttaccgtctaacccgtaacaaacgtctacgtaacggttccggacctcggtaccgggtccctaaccgtccttagttacctccggtcgccttacgacgttccgcggtacctacccgtacgtacccgtccgtcccgtcgaccctagtcccgtacgcgttaaccgaggtacgtccgtacgggtacgtaagttccgggtaacgttacgtttacgtttaacgtttaccgtaccgttacccgttaacacccggttaaagtccggtaaacccgtaccgacccggtttaggtaacggtttttacggtttcgggttacgttttaccgggtttacggggccgggttaacccgggtacctaaacccggttttccgtaacggtaccgttacccgg

SEQ ID NO: 179734 - DNA, 656 bp, Homo sapiens
  misc_feature: GYAE6OF02FSAW1.26.5.A05.1.454.CMB.1.raw
  modified_base (238)..(238): a, c, t, g, unknown or other
  misc_feature (238)..(238): n is a, c, g, or t
  modified_base (381)..(381): a, c, t, g, unknown or other
  misc_feature (381)..(381): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccaggacaggagggtccaccatcctcctgcacgtgggancagcctaccaacagtccggggcaggtcgtaatgtacacgtggtacccaactattccttaccaacggaaccaccggacccccaaactccgtacactcctactaacaaacagactagttcggcctcgacgggtccctggaccgtntttccgtcgtcggtcctaccgaacgttcgtcggaccacccttcaccgtccctcccgtcggaccctactccgacgttccggtaacctacgcggtcgtacgggaggtagtcggacggttacgtttactttacgttaactcgtaaccctaaacttccgtaaagtccgtaacccgacccggttaccgtagggttacgttttagggttttacggtcggttttacggtttccggggccgggtaccgggtaaccgtaggtcccttaccgtaacgttacccgg

SEQ ID NO: 179735 - DNA, 755 bp, Homo sapiens
  misc_feature: GYAE6OF02HI6U0.26.5.A05.1.454.CMB.1.raw
  modified_base (244)..(244): a, c, t, g, unknown or other
  misc_feature (244)..(244): n is a, c, g, or t
  modified_base (372)..(372): a, c, t, g, unknown or other
  misc_feature (372)..(372): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtccgtcggggccccaggaccgagagggtccacctatcctcctgacacgtgggancaacgctaccaacgcgtccggggacagggttcgtaaagtcgtaccacttcggtaacccaacgtacttccttaccgaaggtaacctaccgaccccctaaaagttccgacacgtactacctaaacaaacngacctacgttccgggcctacggacggggtcccagaccgtactttccgtcgtcggaccctaccgtaacgtccgtcggaccctacctaccgaaccggtcccttcccgtacgggtaccctacgttacccgtaaccgttacgggtaacctaaccggtacgggtccgttaagggaaccggtaattccgggtaacgggttaccttttaaaggttacctttaccgtacgtaaccctaaacgtttacccgtaagtaacccggaaccctaaccccggtttcggtaacgggtttaccgtttagggtttttacgtacgggtttaaccggttttcccgggacggggttacccggtaaaccgtaccggtaccgtttaccgaccggtttaacccggg

SEQ ID NO: 179736 - DNA, 613 bp, Homo sapiens
  misc_feature: GYAE6OF02G21PN.26.5.A05.1.454.CMB.1.raw
  modified_base (237)..(237): a, c, t, g, unknown or other
  misc_feature (237)..(237): n is a, c, g, or t
  modified_base (321)..(321): a, c, t, g, unknown or other
  misc_feature (321)..(321): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggcccccaggacaggagggtcaccatctcctgcacgtgggancagctaccaacagtcgggcaggtctaatgtacactgtaccacatcttccgaggacacgccccaatcgtcatctactaacaaacngcagttccgggcctcggacggggtccctaggaccgtacttcctacgtggccctaccgaagtccgtcggcctacccgtccgaccgtcccgttcccgtcggtacccactacccgacgttacggtacctaaccgtaggtccgtaggaccggaagtcgtacggtactttaagtttaactttacgacgacctaacttccgtaatacgaaccaccgtccgtaggtacgtttgggttttacgtacgttacgttttcgggaccgggtaccggaaccgtaagtccctacgtacgtaaccgg

SEQ ID NO: 179737 - DNA, 771 bp, Homo sapiens
  misc_feature: GYAE6OF02HWT73.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgagggtcctgggcccagtctgtgctgacgcacgcccgccctcagtcgtcgtcggggccccaggacaggagggtccaaccactcctcctcgacacgtgggagcacgctaccaacacgtcggggcacgggtcgtaatgtacacgtacggtaaccaacatccttaccgaaggaacaccgacccccaaactccgtcatcctactaaccaaacagacctacggttccggggacccttccggtacgggggttcccctcggtaacccggtaactttccgtccggttcggtaccccgtaccgtaacggttccgtcggtaccctacccgttccgtaaccgtccccttccccgtccgggtaccctacgttaccgtaccgtacggtaaccgttaccgacgggtccttaggggacggtaacggtaggtaacggggtccgttacggtacttttaaacgtttaccgtccggttacccgtaaaggttaccgttaagttaccgtaccgtttaacccgttaccctttaacggtttcggtttacggttttaccgggttccggggtacccgggggttacggggtaacccggttaacgggggttcccggtttaaccccgggttcccgttaacccgggttaaccccgg

SEQ ID NO: 179738 - DNA, 919 bp, Homo sapiens
  misc_feature: GYAE6OF02I10E7.26.5.A05.1.454.CMB.1.raw
  modified_base (188)..(188): a, c, t, g, unknown or other
  misc_feature (188)..(188): n is a, c, g, or t
tcagagactatactcacgaccggtgctcgatttagatagatagacaggggacccaaaaaccacacccctccttgggagaatcccctagatcacagctcctcaccatggactggacctggagcattccttttcttggtgcagcagcaacaggtcgcccactcccaggttcagttgctgctagtcgtggngctgagatgaagagccgtgggcctgagtggaaggtctccgtgtcgaggtcttcgttgttactacgtttcgtagtaccgtagttggttaactcgtacggtcggttgggtcgaccggtaaccggtaccggacccccggtagggaaccggtaacggggtcggttttaggggacggggttggggggttagggaagttacgggtaacgtccggtaacggtttccccgttaaggtaggttacgggttacgaaccgtaacgtaacgtaacttaacgtaccgtaaacgtacccggtaaggtaaaccggttacggtaaccgggaaccggggtcccgggtaaactacccgtacgttaccggtacgtacggttaacggacccgttaccgttaaccgaaaccggtaaaaccgtacgtaacgttaaccgtaacgtaaccgggtaacgggtaccgttacggttacggacccgggtttacgtaccgggttaccgtaaccggtacggttaacccggaaaccggttaaccccgggtaccggttaccgtttacgggtttaaaccgttcggggtaccggtaaccgggtaacgtaacccgggtaaccccgttaaccctttttacggtttaccggttttaaccggtttaacggttaacccggttaccggggttaacccggggtaaccccggttaacccggggttaccccgttaacgggtaccccgggttacccggttaccggttaccccggg

SEQ ID NO: 179739 - DNA, 690 bp, Homo sapiens
  misc_feature: GYAE6OF02IYR46.26.5.A05.1.454.CMB.1.raw
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (475)..(475): a, c, t, g, unknown or other
  misc_feature (475)..(475): n is a, c, g, or t
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctgggcctcgagtgaaggtctcctgtcaggcttcgtggttaactaacgtttcgtgaccatggtatcagtctgggtgcgacgacggcccctggactaagggcttggaggtggggtgggagtggatcgacgtcccttaagnggtggtgaccanaggacttagtacacgtccgaggaagtaacggttccggaacggggtcccggtacaaccgtagttcgtaccgtagtcggaactaccgttacgaaccgaacacgtagtacctaacgagtacgggancgtaggacgtacgttcgtggtaaccgttgtaacggaaccgtaccggaaccggtccggttagttaacgtttcgtcgtacgggacgttaacggacccgttaacccgttttcgttaacggttttacttttacggaacccgtttacggggtacggggtaccccggtaacggggtttaaccccggttcggttaaccccgtccccggttaccgttacccgg

SEQ ID NO: 179740 - DNA, 639 bp, Homo sapiens
  misc_feature: GYAE6OF02GTB3T.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcagcccgcctcagtcgtcgtcggggccccaggacaggacgggtcaccatcctcctgacacgtgggacgcagcctccaacagtcgggcaggtcgtaatgtacactggtaccaacatccttaccgagggtaaaccaccggaccccccaaaacgttccgtaccagtcctacgtaaccaaacagacctaacgttccgggcctacggacggggtccctacggacccgtattccgtctcggacctaccgaagttccgtcggaccacccgtcgacgtcccttcccgcggtcctactccacgttacggaactacgcggtacgtgaggtatcggaggttacctttagttaactttacgtcgtaacccgttaactcctaaagtccgtaaccgtacccgtcgtaggtacgtttcggtttgtacggtttacgtttaccgggccggtaccgggtacctacggtcctaccgacgttaccgg

SEQ ID NO: 179741 - DNA, 744 bp, Homo sapiens
  misc_feature: GYAE6OF02GNTHR.26.5.A05.1.454.CMB.1.raw
  modified_base (138)..(138): a, c, t, g, unknown or other
  misc_feature (138)..(138): n is a, c, g, or t
  modified_base (240)..(240): a, c, t, g, unknown or other
  misc_feature (240)..(240): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcnctgcacgaggtcctgggcccaggtctgtgctgacgcacgccgccctcagtgtcgtcgggccccaggacagaggtccacctatcctcctgcctacgtgggacncagcctccaacacggtcgggctaggtcgtaagtacgtaccacgttacggtaaccaacgtacttccgttacccgaaggaacctaaccgacccccgtaaaactccgttacacgtcctactaaaccaaacacgactaagttccgggcctcggtaaccggggttccctacgaccgtacttctcgtcggtcctaccgtaacgtcgtcgtacctacctcaccgtcccgtcccgtcgtaccctaacttccctacgtaccggttaacctaacggtacgggtcaacgggtacggtagccggggtaagttacctttttaacgtttaacctttaaccggtaccgaaacccgtttaacgtacccgttaacggttaacctaacccgggttaaccctccggttaacggggttaacggtttttcgggtttttacgggttaccgtttacgttttaccggggggaccgggttaacccggggtaaccctacggttaccccgttacgtaaaccgggttcccgg

SEQ ID NO: 179742 - DNA, 636 bp, Homo sapiens
  misc_feature: GYAE6OF02HOT79.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatagaagaagccgtggggcctcgagtgaaggtctcctgtcgaggtcttcgtggttactaacgtttcgtacgtactatggtatcgagtcgtgggtgcgacgcggacccgtggaacgagggcttaggaggtggggtagggatggtactcgacgtacccgttagaggttggacaacgacgagacttagtaccaacgtaccgaaggtaacgtaacggttaccggacggggtacccgggtaccaacgtactacgtaccagtacggactacgtacaacgaacacgtagtactagagtacggagtacgtagacgtacgtacgtcgaccgtgacgacgtaccgacgtcgtacgttattacgtgacgcgacgaccgtaccgttagtttcgttagtttacggaccgttacggacgggtaccgtaacgggtaccttcgggtacctccgtcgtaccg

SEQ ID NO: 179743 - DNA, 665 bp, Homo sapiens
  misc_feature: GYAE6OF02JXIR4.26.5.A05.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
  modified_base (457)..(457): a, c, t, g, unknown or other
  misc_feature (457)..(457): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgacgggtcctgggcccagtctgtgctgacgcacgccgccctcagttcgcgtccggggcccagggacaggtacgggtccaccattccgtccctgcgacgtgggagacncgtcnccgaagcgtccggggctagggtaccgttaatcggttacaccggttacggtaacccaacctacgttccttacgacggaaaccgaccgtaaccccaaaactccgtaactactacctacgttaaccaaacncgacctagtccggcctacgacggggtcccnggaactgttcctcgcggacctcaacgtcgtacggcctccgtcnccggtcctcccggtacgtacccaattcgaccgtaacgtcgtaacgtacgcgtagtaaggtacctaggtacgttacgttatttaaccggttactcgtaacttaaccgtcgtaacgtcgtaccgaccgtacgtacggttaagtttccgtttaggtacgtttagtttccgggacggtccggtaaacgtccgaacgttccctgttaacccgg

SEQ ID NO: 179744 - DNA, 939 bp, Homo sapiens
  misc_feature: GYAE6OF02G7GBK.26.5.A05.1.454.CMB.1.raw
tcagagactatactcacgaccggtgctcgatttagatagatagacgagggggctctgcttcagctgtgggcacaagaggcagcactcaggacaatctccagcatggcctggtctcctctcctcctcactctcctcgctcactgacacgagggtcctcgggcccagtctgtgtctgacgcacgcccgcctcagtcgtcggtccggggacccaaggacgtaggacgggtaccaaccattcctccgtagacctacgtaggggacacgtacgacctaccaacgtacggtcggggactaggtacgtaagtacgtacgtacgttacgtaaccaacctgttaccttaccggaagaaccctaccccgaacccccgtaaactccgtacctacgttcctaacctaaacaaccgtacgaccgttacgttacccgggtaccgtaccgggacccgggtttaccctaccggaccgttacttacgttaccgtacgggttacccttaccggtaacggttccggtaccgggtaccctaacccgtttaaccgggtacccgttacccccgttacccggtaccggtaaccctaaccgttacccggtaaccgttaacccgggttaacccgttaaccgggaccggtttacgtaacgggggttaacggtaaccgggttacggggtaaacggtttaaacccggtttttaacgtttaaaccggttttacccggtaaccggtaaaccgttttaaacccggttaccggttaacccgtttaacccggggaacccccggttaaccctttccgggtttaaacgggtttaacggttttttttccggggtttacgggtttttaccggggtttaaaccccgggtttttccgggggaacccgggggtttaaccccccgggttaacggttaaacccggtccccgttttaaccccggaaccggttttaacccggg

SEQ ID NO: 179745 - DNA, 779 bp, Homo sapiens
  misc_feature: GYAE6OF02HSP8V.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagccgtggggcctcagtgaacggtctcctgtcaggtcttcgtggttactaacgtttcgtacgacctagttggtatcaggtcgttggggtcgcggaacgaccgggcccccgtagggaaccgtaaggggtccgttgggagggttggggtaggggtagtgggaactcgaacgtccccgtttaacgagggttggtacgaccaacgaaggtaccttacgtactaacgtacccaagggtaaacgtaaccggtttacccggaacgggggtaccccgggttacccaaaccgtacgttagttacccgaagttaccgggtaaccctttaccggtttaaccgaaaacccgtaaacctaccgtaaacgtttaccgtaacgtaggttacgggacgtaccgttacggacggttaacgtccgtacggtaccgttcgtacggaccggaccgtaccgggtccgttacgttacgtttcggtgtccgacggacgtaccggtaccctttaagttccggtttacttttacggaaccgttaccgggtcggggacccttaacggggtaacccgttccgggttaccgtacccggtccgttaccgg

SEQ ID NO: 179746 - DNA, 748 bp, Homo sapiens
  misc_feature: GYAE6OF02FVCEB.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaacgccgtgggggcctacgagtgaaggtctcctgtcgaggcttcgtggttactaacgtttcggtacgacctatggtactcgtagccgtgggtcgacgacgacgggtcccgtggacgaagggtcgttaggacgggttggggtagggagttggggatacggacgtaccccgtttacggtaggttggggtacggtaaccaaccgtacggtaaacttacgaccgtaacttcccgaagggtaacggttaaaaccgggttttccgggaaacccggggggtcccgggggttaccctaacccggtaacggtttcccggtaccgtaacggttacgggtaacccgtaccgggtttaaccaaccggtaaaccgacgtaacggttacctacgtaagtcgggtacgtcgtacggacggtacgtcgttacggtaccgttcggtacggaaccgtaccgtacgggtccgtacgtttataccgtggtcgcgtaacgcgtaccttagttcggtttattcggtacgtacgtcgggacgtaccggtaccgtggtccgtaccgtcgtaccgg

SEQ ID NO: 179747 - DNA, 654 bp, Homo sapiens
  misc_feature: GYAE6OF02F0F61.26.5.A05.1.454.CMB.1.raw
  modified_base (387)..(387): a, c, t, g, unknown or other
  misc_feature (387)..(387): n is a, c, g, or t
tcagagactatactcacgaccggtgctcgatttagatagatagacaggggacccaaaaaaccacacccctccttgggagaatcccctagatcacagctcctcaccatggactggacctggagcattccttttcttggtggcagcagcaacaggtgcccactcccaggttcagttgctgcagtctggagctgagatgaagaagccgtggggcctcgagtgaaggtctctgtcagtcttcgtgttactaactttcgcgaccagttggtatcgagtcgtggggtgccgacgacggccccgtagggaccgaaggggtcttagggagggttggggtacgggagtgggataccgacgtcccgttaacgaggttggtacgaccacacgtactanctatccgaaggacgtaacggttaccggacggggtccggtacaccgtatccgtacagtcggactcgtacgaacgactacacgttacaagtcgtaggcgtacgtagacggtacgtctacggacttcgaggaccgacgaccggtcgttagtaacttccgtgaccggtacgtacgacccgttaccgttagtttggttaactttccggaacgttacgggtccgggtaacccgtacggggttaacccgttggtcccgttaccgtcgtacccgg

SEQ ID NO: 179748 - DNA, 684 bp, Homo sapiens
  misc_feature: GYAE6OF02GJ49X.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttacaactttcgtcgacctatggtatcgagcgtgggtgcgacacggcccctggacgaagggcttggaggtgggtgggatggatcgacgtcccttacgagtggtcgacacgagtactagtcaatccgaagaacgtaacgtaccggacggggtcccgggtcaacctagtcgtaccgaagttacggactaccgttaccgaacgtaaccacgtacgtactaacgtagtcgggaacgttcgacggacgtacgttctacggtaccggttacgtacggtaaccgtaccgaccgggttaccgttacgttaacgtttacggtcggtacgaccgtaacgacccggttacccctttagttttaccgtttagttttaccggaaccgttaccgggttaccggggtacccgtaaccgggggttacccccttaggggtacccttacccggtccttacccgg

SEQ ID NO: 179749 - DNA, 894 bp, Homo sapiens
  misc_feature: GYAE6OF02FKXNH.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccaggacaggagggtccaccatcctcctgacctacgtggggacgcgacgcctaccaaacgtacggtccgggggcacgggttacgtaagtacgtacctacgtacggtaacccaactacttaccgttacccgaacggaaccaacccggacccccctaaacgtccgtacctacgttccttactaacaaaacacgtacctaacggttccgggccttaccggaccgggggttccccttacggaacccgtactttccgttaccgttcggtacccttaacccgtaaggttcccgtacgggtaccctaacccgtaccgaccgtcccccgttccccggtaccggtaccctacgttacccgtaaccggttaccggtaacccgttaccggaaacgggttacccgtaacgggtaaacggggtacggtttaccggggttaaaccgggtttaccgttttttaaacggttttaacccgttttaaaccggttacccggtaaacccgtttaaaccgtttacccttaacggttaacccggaaaccccgttaaccccgggtaccgggtttaacggggtttaaccggtttttacgggggttttttaccggttacgggttttaaccgggtttttcccggggggtaacccggggttaacccgggggtaaacccggttaccggttacccggtttacccgtaaaccggttaccccgggg

SEQ ID NO: 179750 - DNA, 712 bp, Homo sapiens
  misc_feature: GYAE6OF02I8RWK.26.5.A05.1.454.CMB.1.raw
tcagagactatactcacgaccggtgctcgatttagatagatagacaggggacccaaaaaccacacccctccttgggagaatcccctagatcacagctcctcaccatggactggacctggagcattccttttcttggtggcagcagcaacaggtgcccactcccaggttcagttgctgcagtctggagctgagatgaagaagccgtgggcctcgagtgaaggtctcctgtcaggtcttcgtaggttactaactttcgtgaccagttggtatcgagtcgtgggtgaccgacgtacggcccccgtaggaaccgtaaggggtctttgggagggttggggtgggtagtgggtataccgacggtccccttaagaggtaggtcgaacacgagactatcaatccaaggaagtaacgttccggacggggtacccggttacaccgtagtccgtacagtcgggtacctacgttaccaacgtaacccgacgtacgtaccgtacgtagttagggactcgtacggtaacgtcgttacgtacggtaacggttccgtaaggacccggaacgtccgggttccgttaggtttaacttaccggtagtacgggaccgtaacgtacccgttacccgttaggtttaccgtttagtttaccgtaccgtttaaccgggtacggggtaacccgaacggggttaaccctcgggtaacccttacccgggttactcccgg

SEQ ID NO: 179751 - DNA, 764 bp, Homo sapiens
  misc_feature: GYAE6OF02IHC6C.26.5.A05.1.454.CMB.1.raw
  modified_base (126)..(126): a, c, t, g, unknown or other
  misc_feature (126)..(126): n is a, c, g, or t
  modified_base (195)..(195): a, c, t, g, unknown or other
  misc_feature (195)..(195): n is a, c, g, or t
  modified_base (267)..(267): a, c, t, g, unknown or other
  misc_feature (267)..(267): n is a, c, g, or t
tcagagactatactcacgaccggtgctcgatttagatagatagacaggggctctgcttcagctgtgggcacaagaggcagcactcaggacaatctccagcatcggcctggtctcctctcctcctcnctctcctcgctcactgctacgacgggtccgtcgggccctagtctgtcgcgtagacgcacggcccgcctntaggtcgtccggtccggggaccccagggacgacggcggtaccaccgtctcctccgtgtacacggtggggacnccgcgccttaccgaacgacggtcggggctagggtactagtacgtactacgtacgtaactactcgttacctacggaacgaccacccgtaccctaactcgtacacttcctacgtaacaactcgacgtacggtccggacctacggtaccgggtccctagtacccgttagtttcctcggtacgtcccttacgacggttcctacgaccgtccctccgtaccgccccgttcgcccgtctaacgtacccggtacgttaccggtaaccgtacgtcggtaaccgttagggtacggtacggttacgggtacgtttaaccgttacgtttaacgttcccgacgttaaccgtaacgttaccgtaaccggttccgtaaacccgtcgggttaccgtttagggtttaacgtttaccgggttttcggttaccggtttaaccgggtttcccggggtaacccgggttaccgggtaaccgttaacccggtacgttacccggtaaacggttccccggg

SEQ ID NO: 179752 - DNA, 763 bp, Homo sapiens
  misc_feature: GYAE6OF02HE5II.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgacgggtcctcgggcccaggtctgtgctagacgcacgcccgcctcagtcggtcgtcggggccccaggacgaggacggtccaccactcctcctgaccgacgtcgggagccgacgccttaccaacgtaccggtcggggtaccgtacggtacgtaacgttcggtaaccgtaacgtacgggtaaccctaaacgtaaacgtttacccggaacggtaccgtaccgtaaccggttacccccaaacccgtttacccgtacctaacgttcccgttacggttaccgggaaacccaaccgtaaccgtacccgggtccccgtacgggtacccgggtcccgtacgtaaccgttactttccgtggttccgtaccgttacgtaacggttccgtacggccgtacccgtcccggtacccgttcccggtacgtccgtacgtacctaccggtccggaccgttaccgtagggtacgtacggtaggtaccgtgggacggttactacggttacgttacgtttacgtacgtacgtacgttacgtacgtctaacgtaccggttactcgttaggtacgtttacggtacggtacgggtacggacggttaggaccggttcccgtcgtacccgttgacccgtaccgg

SEQ ID NO: 179753 - DNA, 725 bp, Homo sapiens
  misc_feature: GYAE6OF02GRUKJ.26.5.A05.1.454.CMB.1.raw
  modified_base (186)..(186): a, c, t, g, unknown or other
  misc_feature (186)..(186): n is a, c, g, or t
  modified_base (521)..(521): a, c, t, g, unknown or other
  misc_feature (521)..(521): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacgagggtcctgggcccagtctgtgctgacgcgacgcccgcctnagtcgtcggtccggggcccaggacaggacggtccaccacttcctcctgccagtgggacgcgacgcctaccaaacacggtcgggactagggtacgtatacgtacacgtcggtaaccaactctaccttaccgaacgaaccgaccgaacccccgtaaacgttccgtacctaacgtcctaacctaacaaacgagtacctacgtccgggcctaccggacgggtccctacgaccgtacttccgtcgtcgtacctaccgtacgtccgtacggtcctaccgtctaccgtccccgtacccgtacgacctactaccgtaacgtacggtaaccgtacgtacgggtntaagggacgtagtacggtaacgttacgtttaattaacgtttaccgacgttaaccgttaaacgtaccgttaagaaccggtacccgtaccggtcgttaaccgggttttcggtttaacgggtttttcgggttacgtttaacccgggttttcggggacccggggttacccggtaaaccggtacgtacccgttacggacgttaacccgg

SEQ ID NO: 179754 - DNA, 739 bp, Homo sapiens
  misc_feature: GYAE6OF02IS2UB.26.5.A05.1.454.CMB.1.raw
  modified_base (214)..(214): a, c, t, g, unknown or other
  misc_feature (214)..(214): n is a, c, g, or t
tcagagactatactcacgaccggtgctcgatttagatagatagacagggacccaaaaaccacacccctccttgggagaatcccctagatcacagctcctcaccatggactggacctggagcattcctttttcttggtggcagcagcaacaggtgcccactcccgaggttcagttgctgcagtcgtggagctgagagtgaagagccgtgggcctnagtgacgtctctgtcgaggtcttcgttacggttaactaaccgttttcgacgtaaccgtagttaggttacttacgacggtccggtggggtccgaccggtacgtaccggggcccccttaggggaaccggtaacggggttcgtttacgggtaagggttcgggggtaggggaacgtttggggacttaccctaccgggttacccctttaggtacgggtaggttacaacgtaaccgaagttacctatccgtaactcgaaggtaacgtacggttaccggacgggtcccgtcaccgattcgtacagtacgactaccgtacgaacgtaacgattacgactacgagtgtacgtgtaccgacgtattccgtaggtaccgtagtcggtaccgacggaccgttcggttacgttacgttacggtcgtacgtaccggtacgtacccgttaccgtttaggtttctttacgttttacggaacgttaccggtacgggtacccggtacgggacccgttcggtacccgtacggtcccttacccgg

SEQ ID NO: 179755 - DNA, 706 bp, Homo sapiens
  misc_feature: GYAE6OF02G6D6Q.26.5.A05.1.454.CMB.1.raw
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
  modified_base (643)..(643): a, c, t, g, unknown or other
  misc_feature (643)..(643): n is a, c, g, or t
tcagagactatactcacgaccggtgctcgatttagatagatagacaggggacccaaaaaaccacacccctccttgggagaatcccctagatcacagctcctcaccatggactggacctggagcattcctttttcttgggtggcagcagacaacaggtgccccactcccaggttcagttgcgtgcagtcgtggagcgtgagtataggaagaacggccggttggggccctagtaggtaggtaaacgggttccttaccgttcggtcgaacggtcctttacggttacggtttaactaaccgttttcgtacgtacctagttacgtagtacgaggtcggtaggtcgaccgtacgccggcccgtacgggaacgtaagggtcgtaggtgggtgggtaggngtggactcgacggtcctagngtgacgacacgacgtactagtacactacgaggtacgtaacgtccgggacggggacccgtagaccgtaggtcgaccgtaggtaccgaccgtacgtacgaacgtaccaaggtacacttacgaggtcgacgtacgtacgacggttgttacgtcgtacctggtacgacgttaccgggacgttaccgttattacgtacggtgtaccgagaccggacttaccctttaggtaacgttnttacggacgttaccgggtaccggacggtacccggtaactccgggtactccggtacctaccggg

SEQ ID NO: 179756 - DNA, 725 bp, Homo sapiens
  misc_feature: GYAE6OF02IHIDW.26.5.A05.1.454.CMB.1.raw
  modified_base (274)..(274): a, c, t, g, unknown or other
  misc_feature (274)..(274): n is a, c, g, or t
tcagagactatactcacgaccggtgctcgatttagatagatagacagggggctctgcttcagctgtgggcacaagaggcagcactcaggacaatctccagcatcggcctggtctcctctcctcctcactctcctcgctcactgcacgacgggtcctcgggcccagtctgtcgctgacgcacgcccgcctcgagtggtccgtcgggcccaggacgaggtacgggtaccaacctactcgtcctcgactacggtgggacgcgacgacctaccaacgnggtccggggacgtacgggtacgttaacgtacgtaaccgtaacgttacggaaccctaaacgtacgttaccttaccgaacgtaaccaccgaaccccaaacgtctaccaattccgtactaaacaaacgacggactacggttacccggcgttaccgaccgggtactacgtaaccgttcttacggtcgtccgtaccgttaacgacgttcggtacggtcccacccgtccgtaccgtacccgttccgccgtacctacgttaccgacgtacggtaactacgggtacgacgtagggagtacgtagggtacgtttaactttacggttaacttaacgccgttaacttaacgtaccttaacgaccgttaacgacccgtacggttggtacggttttagggttattaccgggtttacggttcgggtaccgggaccggttaacgacgtacgtaccgtaactccggg

SEQ ID NO: 179757 - DNA, 823 bp, Homo sapiens
  misc_feature: GYAE6OF02GCTEF.26.5.A05.1.454.CMB.1.raw
  modified_base (150)..(150): a, c, t, g, unknown or other
  misc_feature (150)..(150): n is a, c, g, or t
  modified_base (187)..(187): a, c, t, g, unknown or other
  misc_feature (187)..(187): n is a, c, g, or t
tcagagactatactcacgaccggtgctcgatttagatagatagacaggggacccaaaaaccacacccctccttgggagaatcccctagatcacagctcctcaccatggactggacctggagcattccttttcttggtggcagcagcaacnggtgcccactcccaggttcagttgctgctagtctggngctgagatgaagaacgccgtaggggcctacgtagtaggtaacggttcctccgtggtgaacggtcgtttctacgggttaacctaacgttttcgtacggaaccctagttcggtactacggtacggtacgttcgggtacgaccggaaccgtaccgggtcccccgtaagggaccgaaacggggttccgttagggacggggttacgggggttacgggtcgtacgggggtacttaaccgccggttaccccgttaaggtacggttaccgggttacggtaaccgacgaaacgggtaaccgttactaccgtaacgtaccgaaagggtaacgtaccggtttaaccgggacgggtacccggttacccgaaccgtacgttaacgacccgtagtccggtaacccgttacgtaaccgaaccggtaaacgacccgttaacgtaaccgtaacggtaacggacgggtaagtccgaacggtaccggtaacttcggtacgttaacggtcggtaacgtaccgaacgtacgttacccgtaggtttaactaccgttggtacgacgtaaccgtacctaaccgttagttcggtttaacttccgggtaacgtccggtaccggtacggtaccggtaaccgtcggtaccctaccgtagtcccg

SEQ ID NO: 179758 - DNA, 940 bp, Homo sapiens
  misc_feature: GYAE6OF02JI1R8.26.5.A05.1.454.CMB.1.raw
  modified_base (173)..(173): a, c, t, g, unknown or other
  misc_feature (173)..(173): n is a, c, g, or t
tcagagactatactcacgaccggtgctcgatttagatagatagacaggggctctgcttcagctgtgggcacaagaggcagcactcaggacaatctccagcatggcctggtctcctctcctcctcactctcctcgctcactgcacacgggtcctggcccagtctgtgctagacncagcccgccctcgagtcgttccggtcggggccccaagggaccgacggtacgggtccaacctacgttcctccgttggccaacggttgggggactaccgtaacggccctacccgaaaaccgtacgggtccggggggacctacgggggttacccgttaaagttcggtaaaccgtaccggttaccgggtaaaccctaaaccgtacctttaccgttacccgaaacgggtaaaccaacccggtaccccccgtaaaacgttccggtaccctaagttaccccttaaccgtaaaaccgaaaaacctacgtaaccgttaacggtttccccggggtaaccccgttacggggtaacccgggggttaccccctttaacgggaaaccccggtttaacttttcccggttaccgttaccggggtacccttaaccccgtaaaggtttcccgtcgggtaacccctaaaccccgttgtaaccccggtccccctttaacccggtacgggacccttaaacgttacccgtaccggttaaggaacccgttacggtacgggtaccgtaacgggtaacgtaacggttccgtaacgggttaaccttttaacgtttaagttaacccgtcccgtttaaactaacccggtttacctaacggtacccggaaaccgttacccccgtcgggttaagggttacgtttttacgggtttacgttaacggggtttaccgggttttccgggggacccgggttaaccggtaaccgaacggtttccgaccgtaacgggttacccgg

SEQ ID NO: 179759 - DNA, 685 bp, Homo sapiens
  misc_feature: GYAE6OF02IX6LB.26.5.A05.1.454.CMB.1.raw
tcagagactatactcacgaccggtgctcgatttagatagatagacaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggcccaggacaggacggtcaccatcctcctgccacgtgggacgcacgcctaccgaactacggtccggggacgtacgggtacgttaagtacgtaactacgttacggtaacccaaactacttaccgttaccgacgggaaaccacccgaacccccctaaaacgttccgtacctaactacctacctaaccaaacgacgtactacgttccgggcctacggaccggggtaccctacggaccgtacttccgtcgtcgcctaccgtaacgtcgtacggtcctaccgtcaccgtccctcccgtcgacctactccgtacgtacggtactacgacgtcgtaggacgtagtacggtacgttactttagttacgttacgtacgtacctaactaccttaagacgaacccgtaccgtcgttagggtaacgttttggtttacgttaggtttacgggtttccgggaccgggtaccgggtaaccgtacggaccttaccgacgtaccgg

SEQ ID NO: 179760 - DNA, 778 bp, Homo sapiens
  misc_feature: GYAE6OF02FJL86.26.5.A05.1.454.CMB.1.raw
tcagagactatactcacgaccggtgctcgatttagatagatagacaggggaacccgaaaaaaccgaccaccccgtccttggagaatcccctagatcacacgctcctcaccatcggactcggacctcggagcatcctttctggtggcagcagcaacagtcgcccactcccaggttcagttcgctcgctagtctggagctgagatacgaagaacgccgtcggggcctacgagtcggtaacggtcctcgtcgtacgacggtccttcgtacggttaacgtaacttttcgtacgacctacgtacggtaactcgacggtcgtcgggtcgaccgaccggtaccggtcccggtacggaacgtaacgggtcgttaggtacggttaggggtaggtacgtacggtacgtacgtacccgttaccgtaacggtacggtacggtacgtaaccgaaccgtaacgtaccgttacgtaccgtaacgtaccgtaacggtaacgtaacggtcccgggacggggtacccggtaccgtaaccggtacgttaccgtaacgtacgtaccgtaacgtacgttaaccgaacgaacgtacgtaacgtacgtaacgtaacggacggacgtacggtacgtacggtacgttacgtacggtactacgtacggtaaccgacgtaccgtacgttacgttacgtacgtggtacgtacgtacgaccgtaccgttacgttacgttacttacggtaccgttacggtacggtaccggacgggtaccgttaccggtaccgttaccgttccggtacg

SEQ ID NO: 179761 - DNA, 910 bp, Homo sapiens
  misc_feature: GYAE6OF02I3EZ0.26.5.A05.1.454.CMB.1.raw
  modified_base (188)..(188): a, c, t, g, unknown or other
  misc_feature (188)..(188): n is a, c, g, or t
tcagagactatactcacgaccggtgctcgatttagatagatagacaggggctctgcttcagctgtggcacaagaggcagtcactcaggacaatctccagcatggcctggtctcctctcctcctcactctcctcgctcactgcacgacggtcctgggcccagtcgtgtcgctagacgcacgccgtcccngagtcgtccgtcggggtcccaaggacaggtacggtaccaacctactcctcctacgcctacggtcgggacacctacggaccttacccgaaacgtacggtaccccgggggacgtaacgggttacgttaaagttaccggtaaccgtaaccggttaccgttaaaccccgtaaaccgttaaccgttcccggtttaacccgaaaccggggtaaaccctaaccccggtaaaccccccctaaacgttacccggtacctaaccgtttcccgttaaacccgttaaaacccgaaaacggtccggtaaccttaccggggttaccccgggttacccctaccggggtaacccgggttacccccgttaaccggaacccggtttacctttccccgtaccggttaccgggtaccccttaacccggtaacggttccgtaccgggtacccctaaccgttccgtaaccccggttccccgttacccggtccggtaaccctacgtaccgtaaccgtacggtaaccgtacgaccggttacgtacggtaaggtacggtacgggtacgttaactttaagtacgttacgtaaccgtaccttaactacctacgtaaccgtacccgtaccggttaccgttacggttaaggttttccggtttacggttaccggtttaccgggtttaccgggtaccggggtacccgggtaacccgttaacggttcccggtaacccgttcggtttaaacccgg

SEQ ID NO: 179762 - DNA, 837 bp, Homo sapiens
  misc_feature: GYAE6OF02G6P96.26.5.A05.1.454.CMB.1.raw
tcagagactatactcacgaccggtgctcgatttagatagatagacagggggacccaaaaacccacacccctccttgggagaatcccctagatcacaggctcctcaccatggactggacctgggagcatccttttcttgggtggcagcagcaacaggtcgcccactccccaggttcagttgctgcagtctggagctggagataggaagaagccgtcggggcctcaggtgaaggttcctcctgtacacggtcttcgttacgggttacctaacgttttcggtacgaccgtagttgggtactcgtacggtcggttgggggtacgaccggtaccgtaccgggtccccgtaggggaaccggtaacggggtcgttagggtacggggttggggtacggggagttcgggaacttccgtacggttaccccgttaacgtagggttacgggtactaacccgacgtaacggtacctacgttaccgtaaccgtaccggaacgggtacgtaacgggttcccgggacgggggtaccccgggttacaccgtacgttccggtacctagggtaccgggtaaccctacggttaaccaacgtaacccaacgtcgttaactaggacgtacgggacttccgaggtaaccgtcggtcccgtaggtacccgtttcggaacggtaacccggtacccggaccggggttcccttaggttaaccctttgggccgtaacggccgttaacggccccgttaaccctttgtttaacgggtttattttccgggaacccgttacggggttaccgggtaaccggttacccgggttacccggttaccggtcccttaacccgggtcgtaacccgg

SEQ ID NO: 179763 - DNA, 709 bp, Homo sapiens
  misc_feature: GYAE6OF02FX91I.26.5.A05.1.454.CMB.1.raw
tcagagactatactcacgaccggtgctcgatttagatagatagacaggggctctgcttcagctgtgggcacaagaggcagcactcaggacaatctccagcatggctggtctcctctcctcctcactctcctcgctcactgcacgaggtcctgggcccagtctgtgctgacgcacgcccgcctgagtgtccgtcgggccccaggacaggacggtccaccagttcctccgtgaccgtacggtcggggactccgacgtccctaccgaacgtacgggtaccggggacctagggtacgttaagtcgtaacctacgtaccggtaaccaacgttactaccgttaaccgaacggtaaacccacccggtaaccccctaaacgttcgactactacctaacctaacaacgtcgactacgtccgggccttacggaccggggttccctacggacgttacttccgtcgtccgtacctaaccgtagttccgtagtaccctacgtccgaccgtcccgtcccgtcgaccctacgtacccgacggttaccgtaacgtaccgacggtaccgtaggacgtagtacggtagttacgtttatttacgtacgtacgtaacgtacttacgaacgtaccgaccgttaccgacggttggttacgtttacggttagttacggttacgggtttaccggacggtccggtaacctaccggtccgtacgtaccgttccgg

SEQ ID NO: 179764 - DNA, 753 bp, Homo sapiens
  misc_feature: GYAE6OF02GADQ3.26.5.A05.1.454.CMB.1.raw
  modified_base (467)..(467): a, c, t, g, unknown or other
  misc_feature (467)..(467): n is a, c, g, or t
tcagagactatactcacgaccggtgctcgatttagatagatagacagggggacccaaaaaaccacacccctccttgggagaatcccctagatcacagctcctcaccatggactggacctggagcatccttttctggtggcagcagcaacaggtgtcccactcccaggttccagttgctgcagtcgtggagctgagatagaagagccgtcggggcctcgagtagtaacggtctaccgtgtcgacggtcttcgttcggttaactacgtttcgtacgtacctagtcggtagtcaggtcggtgggtcgacggacgaccggcccgtaggacgtaagggtcgttagggacggttggggtgggacggttacgggataccgtaccgtacccgttacggtggtacgggtaacgtaccgaacgacgtacgtactacctacgtacgaggtaagtacgtaccggacgggtaccggaacncgtacgtcgtaccacggtacgacctacggttaaccaacgactaaccgtgttaaccgtaagtacggacggacgtacgtacggtaacgtcgtacgtccggttactcggacggtaacgacccgggttaccgtcgtttaacgttacgttaccgtagggtccgtaacggtacggtacccgttaaaccggttttagtttaaccggtttagtttaaccggggtacttaccggggtaccgggtaacggtacccgggttaaccgttaccgggccccttaccggttccgttaccgg

SEQ ID NO: 179765 - DNA, 784 bp, Homo sapiens
  misc_feature: GYAE6OF02G6RHJ.26.5.A05.1.454.CMB.1.raw
  modified_base (193)..(193): a, c, t, g, unknown or other
  misc_feature (193)..(193): n is a, c, g, or t
tcagagactatactcacgaccggtgctcgatttagatagatagacagggggacccaaaaaaccacacccctccttgggagaatcccctagatcacagctcctcaccatggactggacctggagcattccttttcttggtggcagcagcaacaggtcgcccactcccgaggttcagttgctgctagtcgtggancgtgagagtacggaagaacgccgtcggggacccttagaggttagaacggttccctaccgttcggttacgacgggttacctttcgtacggtttaaccttaacgtttcggtacgtacctaggtggttaactcggtagttcgggtgggtacggaccgtaaccggccggttacccggttagggaaaccggtaagggttcgttagggaggggtttgggggtagggaacggtcggtactacggtacgtacccgtttagacgggtggtacgacgtacgactaacgtctactaactaccgaaggtaacggtacgttaccgggaacgggtccggtaccgaccgttagtacccgttaacgacgtaccggaaccgttaccggtaaacaacccggtaacttacgtacgtctaaacgtaggcggtaagttccgagaccggtactgtacgacgttacgacgacgttacgacggtcgttacgttaacgttcggcgtcgggacgaccttacccgttaccgtttagtttaccggttcgttaaaccgtggtttacccgggacggtaaccgggttaccggtaccggttcggaccttacccgtggttcccg

SEQ ID NO: 179766 - DNA, 504 bp, Homo sapiens
  misc_feature: GYAE6OF01C7GE7.25.20.B09.1.454.CMB.1.raw
  modified_base (424)..(424): a, c, t, g, unknown or other
  misc_feature (424)..(424): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
tcagactgtacagtcacgaccggtgctcgatttagtgtagtgtgaaggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacaccaggccaaagcccccaaacttatcatttatgaggccactaagcggccctcaggagtttctaatcgcttctctggctccaagtctggcagcacggcctccctgacaatctctgggctccgaggctgaggacgaggctgatttattactgctactcatangacacatcacaaatcccgtcttcggactgggaccagggtcaccgtctgggtcacgcccaaggcccaacccntcgtcnctc

SEQ ID NO: 179767 - DNA, 532 bp, Homo sapiens
  misc_feature: GYAE6OF01EE0CZ.25.20.B09.1.454.CMB.1.raw
  modified_base (207)..(207): a, c, t, g, unknown or other
  misc_feature (207)..(207): n is a, c, g, or t
tcagactgtacagtcacgaccggtgctcgatttagtgtagtgtgaaggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttacttactttgtctcctggtaccaacaacaccaggcaaaagccccaaaacttatcatttatgaggccactaagcggaccctcaggtagtttctaaatcgcttctctggctccaagtctggcagcacggcctccctgacaatctctgggctccaggctgaggacgaggctgattattactgctaactcatatggacacatcaacaaactcccgtcttccggacctgggaccagggtccaccgttcctgggtccacggtcccaaacgggccccaaaccccactcgtccaacgttcccg

SEQ ID NO: 179768 - DNA, 364 bp, Homo sapiens
  misc_feature: GYAE6OF01BYWR6.25.20.B09.1.454.CMB.1.raw
  modified_base (359)..(364): a, c, t, g, unknown or other
  misc_feature (359)..(364): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttccccctggcgccctgctccaggagcacctctgggggcacagcggccctgggctgcctggtcaaggactactccactgtacagtctgagcgggctggcaaggcgcatagnnnnnn

SEQ ID NO: 179769 - DNA, 364 bp, Homo sapiens
  misc_feature: GYAE6OF01EN3LJ.25.20.B09.1.454.CMB.1.raw
  modified_base (360)..(364): a, c, t, g, unknown or other
  misc_feature (360)..(364): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttccccctggcgccctgctccaggagcacctctgggggcacagcggccctgggctgcctggtcaaggactacttccactgtacagtctgagcgggctggcaaggcgcatagnnnnn

SEQ ID NO: 179770 - DNA, 530 bp, Homo sapiens
  misc_feature: GYAE6OF01DZ2CK.25.20.B09.1.454.CMB.1.raw
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaacgcccccaaaacttatcatttatgaggccaactaagcggccctcaggagtttcaatcgcttctctggctccaagtctggcagcacggcctccctgacaatctctgggctccaggctgaggacgaggctaggatttattactgctactcatatggaacacatcacaaactcccgtcttcgactcgggaccgagggtcaccgtcctgggtcacgcccaacggcccaaccccactcgtccacttccttcgttccccgccctcctcactgtacacgtctgacgcgggctggcaaggcgacg

SEQ ID NO: 179771 - DNA, 361 bp, Homo sapiens
  misc_feature: GYAE6OF01DCMP5.25.20.B09.1.454.CMB.1.raw
  modified_base (356)..(361): a, c, t, g, unknown or other
  misc_feature (356)..(361): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttcccctggcgccctgctccaggagcacctctggggcacagcggccctgggctgcctggtcaaggctacttccactgtacagtctgagcggctggcaaggcgcatagnnnnnn

SEQ ID NO: 179772 - DNA, 246 bp, Homo sapiens
  misc_feature: GYAE6OF01EH1LO.25.20.B09.1.454.CMB.1.raw
  modified_base (243)..(246): a, c, t, g, unknown or other
  misc_feature (243)..(246): n is a, c, g, or t
tcagactgtacagtcacgaccggtgctcgatttagtgtagtgtgaagggcgacagcagatggtggagcaagtgactggggccagggaaccctggtaaccgtctcctcaccttccaccaagggcccatcggtcttcccctggcgccctgctccaggagcacctctgggggcacagcggccctgggctgcctggtcaaggactacttccactgtacagtctgagcgggctggcaaggcgcatagnnnn

SEQ ID NO: 179773 - DNA, 521 bp, Homo sapiens
  misc_feature: GYAE6OF01BXFTF.25.20.B09.1.454.CMB.1.raw
  modified_base (495)..(495): a, c, t, g, unknown or other
  misc_feature (495)..(495): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagcggccctcaggagtttctaatcgcttctctggctccaagtctggcagcacggcctccctgacaatctctgggctccaggctgaggacgaggctgattattactgctatcatatggacacatcacaaactcccgtcttcggacctgggaccagggtccaccgtctcgggtcacgcccaaggcccaaccccactcgtacacctctcgttccccacccttcctcactgtacngtctgacgcgggctggcaaggcgacg

SEQ ID NO: 179774 - DNA, 519 bp, Homo sapiens
  misc_feature: GYAE6OF01DYJ2M.25.20.B09.1.454.CMB.1.raw
  modified_base (512)..(512): a, c, t, g, unknown or other
  misc_feature (512)..(512): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacaccaggcaaagcccccaaacttatcatttatgaggccactaagcggccctcaggagtttctaatcgcttctctggctccaagtctggcagcacggcctccctgacaatctctgggctccaggctgagacgagctgattatactgctactcatatggacacattcaactaaactcccgtcttccggaccgttgggacctagggtccaccgttcgtgggtcacgcccgaacggcccaaaccccatcgtnccttccg

SEQ ID NO: 179775 - DNA, 520 bp, Homo sapiens
  misc_feature: GYAE6OF01CZSB1.25.20.B09.1.454.CMB.1.raw
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaaacttatcatttatgaggccactaagcggccctcaggagtttctaatcgcttctctggctccaagtctggcagcacggcctccctgacaatctctgggctccaggctgaggacgaggctgatttattactgctactcatatggacacatcacaaatcccgtcttcggacctgggaccagggtcaccgtcctgggtcagcccaaggccaaccccactcgtccactcctcgttccccgcccttcctcactgtacagtctgacgcgggctggcaaggcgacg

SEQ ID NO: 179776 - DNA, 537 bp, Homo sapiens
  misc_feature: GYAE6OF01C54NI.25.20.B09.1.454.CMB.1.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccattttcctgcactggactcagcactgatgttgcaggttattactttgtctcctggtaccaacaacaccaggcaaagcccccaaacttatcatttangaggccactaagcggccctnaggagtttctaatcgcttctctggctccaagtctggcagcacggcctcctgacaatctctgggctccgaggctgaaggacgaggctgattattactgctactcatatggacacatcaactaaactcccgtcttcggacctgggacccagggtccaccggttcctggggtaccacggtaccccaaacgggaccccaaacccccacttcgtcccacttcccg

SEQ ID NO: 179777 - DNA, 852 bp, Homo sapiens
  misc_feature: GYAE6OF01C2MW4.25.20.B09.1.454.CMB.1.raw
  modified_base (208)..(208): a, c, t, g, unknown or other
  misc_feature (208)..(208): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgctaggttattactttgtctcctggtaaccaacaacaccaggacaaacgcccccaaattactctatttatacgacggacctaactaacggccggtaccctagtaaggtacgttttactaaacgttccgtacctttctacgtcgggtaccttaccgtaaacggttccgtacgggtaccaacggtacccgtaacccgggtccccttaccccggttaggaaacctaaacgttcccgttcggtcgggggtaccttaccccggtaaggggtacccttagggaaacgggtaaccgggtaacggggtacctttaagggttaaacttttaacgtttaaaccgtacgggttaacccctttaaaccgttacgttaaacgttaaacggttccgggtaaacctaccgtaaaccttaacccgaaaaccgttaaaaccgtttccccccgggttaacgtttaccccggggtaaacccgttaccgggggtaaaccccgttaagggggttacccccgtaaccccgggtttacccgggtacggggtttaccccaaacccgggtaccccccggtaaaaccggtaccccccgtaaaaccccccgtaacggtttacccggtacccgtaacccgtttccccgg

SEQ ID NO: 179778 - DNA, 580 bp, Homo sapiens
  misc_feature: GYAE6OF01CSJSY.25.20.B09.1.454.CMB.1.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttccngcactggactcagcactgatgttgctaggttattactttgtctctggtaccaacaacaccaggacaaacgccccaaattanctatttangacgcactaagccgcctnaggtagtttctaatcgtnttctctggctacaagtctggcagcacggccctcctgaacatcctcgtcgggcctccgaggctaggacggacgaggtctagtatttagtactgtaccttactacaatagtacggaacacgtactaccaaacctaacttccccgtacgttaccggaccgttcgggaacccgtagggttacccgacccggttcgtcgggtaccaccgacccggaacgtaccccaacccgtagtccgcctacgttccccg

SEQ ID NO: 179779 - DNA, 612 bp, Homo sapiens
  misc_feature: GYAE6OF01DZ7PB.25.20.B09.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (588)..(588): a, c, t, g, unknown or other
  misc_feature (588)..(588): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgattgttgctaggttattactttgtctcctgtaccaacaacaccaggacaaacgccccaaattatcatttangacggccaactaagccggccctgaggtagtttctaatcgtcttctctggctcaagtctggcagccacggccctcctagactaactctcgtcggcctccgaggtctaggacggacgaggctagtatttacttacgtgtaccttaactctaatacgtagaacctactacttaccaaaccttaaaccgttccccggttacgttacccgggaaccgtcggggaaccctacggggtaccctacccggttccggtacggtaccaccggacccccgaacgggacccccaaaccccgnttaccgtcccgtacccgttacccg

SEQ ID NO: 179780 - DNA, 522 bp, Homo sapiens
  misc_feature: GYAE6OF01BKU15.25.20.B09.1.454.CMB.1.raw
  modified_base (318)..(318): a, c, t, g, unknown or other
  misc_feature (318)..(318): n is a, c, g, or t
  modified_base (448)..(448): a, c, t, g, unknown or other
  misc_feature (448)..(448): n is a, c, g, or t
tcagactgtacagtcacgaccggtgctcgatttagtgtagtgtgaagggggggtcacaagaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcatcggcccccaaactcatcatttatgatgtcagtcatcggccctntggtagtttctggtcgtcttctctggctcaagtctggcaactcgcctcctgaccatccgtcgggctccgaggtctggacggacgaggtcttaacttattattgctatttcattacagtagaccaccaacngtctggtgtcggcggaaggacaagttgaccgtcgtcggtcacgccaagctcgcccctgtccactcgtcgtcccc

SEQ ID NO: 179781 - DNA, 537 bp, Homo sapiens
  misc_feature: GYAE6OF01C8ZGV.25.20.B09.1.454.CMB.1.raw
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (393)..(393): a, c, t, g, unknown or other
  misc_feature (393)..(393): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccattttcctgcactggactcagcactgatgttgcaggttattactttgtctctgtaccaacacaccagcaaacgccccaatatcattangagccactaagcgcctnaggtagtttcaatcgcttctctgctcagtctgcngcacgcctcctgacatctgcggctccgagcagaggacgagctatattatacngtctactcaatgtagacacataccaactaacttcccgtacgttaccggaccgttcgggaccctagggtacccgtacccgtcggtacgggtccaccggaccccgaaccgggacccctaaccccgtacgtctcccgtcttaccccg

SEQ ID NO: 179782 - DNA, 718 bp, Homo sapiens
  misc_feature: GYAE6OF01AQEB3.25.20.B09.1.454.CMB.1.raw
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgctaggttattactttgtctcctggtaccaacaacaccaggcaaacgcccccaaacttatcatttatgacggaccacgtaagccggccctacgaggtagtttactaatcgtcttcctcgtcgtcctaccgaagtcgtcggcaacgccgaccgggtccctcccgtacgaaccaacgtccttcgtacgggtcctaccgacggtcgtacggaacgggacggtacgggaccttaggtaacttttaacgtttacgttaccggtccctttaacgttacctaacgtttaagtacgggtaaacctacccgtaattaacccaaacctaaaaccggtttcccccgttacgtttacccggtacccggttacggggtaaacccgtaccggggttcccgtaacccgggtttcccggtacggggttacccaccggtaaccccgaaacccgggtaacccccaaacccccgttacgtccgttacccgtaacccgtttccccgg

SEQ ID NO: 179783 - DNA, 364 bp, Homo sapiens
  misc_feature: GYAE6OF01A2ZLU.25.20.B09.1.454.CMB.1.raw
  modified_base (359)..(364): a, c, t, g, unknown or other
  misc_feature (359)..(364): n is a, c, g, or t
tcagactgtacagtcacgaccggtgctcgatttagtgtagtgtgaagggccgattcgccgtctccagagacaactccaagaacacggtgtttcttcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttccccctggcgccctgctccaggagcacctctgggggcacagcggccctgggctgcctggtcaaggctacttccactgtacagtctgagcgggctggcaaggcgcatagnnnnnn

SEQ ID NO: 179784 - DNA, 371 bp, Homo sapiens
  misc_feature: GYAE6OF01CACXJ.25.20.B09.1.454.CMB.1.raw
  modified_base (359)..(371): a, c, t, g, unknown or other
  misc_feature (359)..(371): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttcccctggcgccctgctccaggagccacctctgggggcacagcggccctgggctgcctggtcaaggctacttccactgtacagtctgagcgggctggcaaggcgcatagnnnnnnnnnnnnn

SEQ ID NO: 179785 - DNA, 543 bp, Homo sapiens
  misc_feature: GYAE6OF01AOA93.25.20.B09.1.454.CMB.1.raw
  modified_base (528)..(528): a, c, t, g, unknown or other
  misc_feature (528)..(528): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggtttattactttgtctcctggtaccaacaacacccaggcaaaacgcccccaaaacttatcatttatgagtccactaagcggccctcaggagtttctaatcgcttctctggctcaagtctggcagcacggcctcctgacatctctggctccaggctgagacgagctgtattatactgctactcatatggacacatcaactaaacttcccgtacttaccggacctcgggacccgtaggggtcctaccggttcccgtgggtcccacggaccccaacgggaccccaaacccccgtancgttccgacttcccg

SEQ ID NO: 179786 - DNA, 535 bp, Homo sapiens
  misc_feature: GYAE6OF01CMMTN.25.20.B09.1.454.CMB.1.raw
  modified_base (320)..(320): a, c, t, g, unknown or other
  misc_feature (320)..(320): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgctaggttattactttgtctcctggtaccaacaacacccaggcaaacgcccccaaacttatcatttatgaggccactaagcggccctnaggtagtttctaatcgcttctctggctcaagtctggcagcacggcctcctgacaatctcgtgggctcgaggctgaggacgaggctgtattattactgctactcatatggacacatacactaaactcccgtcttacggaccgtgggaccgacgggtccacccggtcgtcgggtcaccgcccgaacggtaccccaaccccacgtcgtcctcttcccg

SEQ ID NO: 179787 - DNA, 363 bp, Homo sapiens
  misc_feature: GYAE6OF01BWPTJ.25.20.B09.1.454.CMB.1.raw
  modified_base (359)..(363): a, c, t, g, unknown or other
  misc_feature (359)..(363): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttcccctggcgccctgctccaggagcacctctgggggcacagcggccctgggctgcctggtcaaggactacttccactgtacagtctgagcgggctggcaaggcgcatagnnnnn

SEQ ID NO: 179788 - DNA, 527 bp, Homo sapiens
  misc_feature: GYAE6OF01DEDK1.25.20.B09.1.454.CMB.1.raw
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (501)..(501): a, c, t, g, unknown or other
  misc_feature (501)..(501): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaaattatcatttatgaggccaactaagcggccctcaggagttttctaatcgcttctctggctcaagtctggcaatacggcctccctgacatctctggtctccaggctgaggacgaggctgattattactgctttcncanatgtcggctagtagctacgtttggggttgttcggcgaggacgggaccaaaggtcgtaccgtcgtgggtcacgcccaaggcctcgccccgtcgtcnctctcgttcccncctcctcactgtacngtctgacggcggactggcaggcgacg

SEQ ID NO: 179789 - DNA, 605 bp, Homo sapiens
  misc_feature: GYAE6OF01AML41.25.20.B09.1.454.CMB.1.raw
  modified_base (292)..(292): a, c, t, g, unknown or other
  misc_feature (292)..(292): n is a, c, g, or t
  modified_base (507)..(507): a, c, t, g, unknown or other
  misc_feature (507)..(507): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgctaggtttattacttgtctctggtaccaacaacaccaggacaaacgccccctaaattntctatttatgacgaccactaagccggcctgaggtagtttactaatcgctttctcgtggcctacgaagtctggcagccacggtcctacctgaactacttctcgtcggctaccgacggtctaggacggacgtaggtctgtaactttacgttacgtcgtccttctacgatacgtcggtacggctaaggtacgtacgttacggtttcgggtagtccggngaaggtacgggaaaccctaaggtcggtaacccggttcgtcggggtactacccgggacccgtaacgggtcctacccggcccccggttggtccctacccg

SEQ ID NO: 179790 - DNA, 541 bp, Homo sapiens
  misc_feature: GYAE6OF01B3KGR.25.20.B09.1.454.CMB.1.raw
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgtcgtgactcaacctgcctccgtgtctgggtctcctggacagtcgatcaccatttcctgcactggactcagcactgatgttgcaggttattactttgtctcctggtaccaacaacacccaggcaaacgcccccaaattatcatttatgaggccactaagcggccctcaggtagtttctaatcgtcttctctggctcaagtctggcagcacggcctcctgacaatctctggcctccgagctgaggacgagctagtattatactgactatctatagtgaacacactacaacaactcccgtacttacggacctgggacctagggtccaccggttccgtacgggtaccaacccgacgacccgacccacttacgactacctccgtccgttcccccg

SEQ ID NO: 179791 - DNA, 653 bp, Homo sapiens
  misc_feature: GYAE6OF01CC98B.25.20.B09.1.454.CMB.1.raw
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctggcctgactcaacctgcctccgtgtctgggtctcgtggacgtcaatcacctatttcctgcactggactcagcactgattgttgctaggtttatttactttgtctccgtacgtaccaacaacaccgagacaacgacccctaattactctatttagcgacgaccaacgtaacgccgacctacgaggtacgtttactaacttcgtcttctcgtcggtactacgagttcgtcgacacgccgaccggtcctcccgtagactatccgtacgtcgggccttccgaggtcgtaggacggacgtacgtcttagtaactttacgtacgtcgttacctactactaagttacgtacgaactactaactacgaaacccgttaacgttccccgttacgttacccggacgtacgggacccgtacggtaccctaccggtaccgtcggggtaccaccggtaccccgaaccggacccctaaccccgtgtacccgtacctaccgttcccgttccgtaccccc

SEQ ID NO: 179792 - DNA, 543 bp, Homo sapiens
  misc_feature: GYAE6OF01AC2I0.25.20.B09.1.454.CMB.1.raw
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
  modified_base (514)..(514): a, c, t, g, unknown or other
  misc_feature (514)..(514): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaaacttatcatttatgaggccactaagcggccctnaggatttcaatcgcttcnctggctccaagtctggcagcacggcctccctgacaatctcgtgggctccgaggctggaggacgngctgattattactgctactcatatggacacatcaacaactcccgtcttcggacctgggacctagggtcctaccggtcgtcgggtcaccgacccgaacggcccaaccccactcgtacctacctccgttcgtccccgtccctccctcctacgttctacncgtctggacggcgggctaggcgaggcgac

SEQ ID NO: 179793 - DNA, 605 bp, Homo sapiens
  misc_feature: GYAE6OF01A3SU9.25.20.B09.1.454.CMB.1.raw
  modified_base (296)..(296): a, c, t, g, unknown or other
  misc_feature (296)..(296): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgctaggttattactttgtctcctgtaccaacaacaccaggcaaagcccccaaattatcatttangacggccacgtaagccggccctcgaggtacgtttactaatccgtcttctactggcctcaagtctggctagcacggcctcctgacatctcgtgggctcgagtctgacggacgaggctagtatttatacgtcgctactctaattagtacggaacaacgtactaccaaactaaaccttccccgtacgttaccggacccgtacgggaccgtaacgggtcccgtaacccggttcccgtacggggtaccgaacccggaccccgtaaaccggccccctaaaccccgtaccgttacggtaccctacccgtttacccg

SEQ ID NO: 179794 - DNA, 649 bp, Homo sapiens
  misc_feature: GYAE6OF01CF0TG.25.20.B09.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (493)..(493): a, c, t, g, unknown or other
  misc_feature (493)..(493): n is a, c, g, or t
tcagactgtacagtcacgaccggtgctcgatttagtgtagtgtgaagggggggtcgacaagaggcagcgctctcgggacgtctccaccactggcctgggcctctgctgctcctcactctcctcactcaggacacgaggggtcctgggcccaggtctgccgtgactcagcctgcctccgtgtctgggtctccgtggacnggtcatcacctntttccngcactggactcagcactgattcgtgctaggttatttactttgtcttcctggtaaccaacaaccaccaggaccaaacgaccccctaaatactactatttancgacggcctacgtaaggccgtccctnaagggtatttactaagtccgtctttctccgtggcctacgaacgttctggcctaacggcctaccggccctccgtagaactactcgtcgtcggcctaccgagtcgtaggaaggccgaagggtctagtatttattacagtcctactcgagttanacggtacacaacgtactaacctaacttcccgtacgttaccgggtacctacggggtaccgtacgggttaccgaccccggttcggtacgggttcccgaaccggtacccccgaaacgggtcccccaaacccgtacgttaccgtccctaaccgttccccg

SEQ ID NO: 179795 - DNA, 539 bp, Homo sapiens
  misc_feature: GYAE6OF01EUNTR.25.20.B09.1.454.CMB.1.raw
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacaccaggacaaacgcccccaaacttatcatttatgacggccactaagcggccctcaggtagtttctaatcgtcttctactggctcaagtctgcagcacggcctcctgacaatctcgtggcctccgaggctgaggacgaggctgattatactgctactctatatggaacacgatacaactaaactcccgtacttccggaccgtcgggaccagggtccaccgttccgtcgggtccacggaccccaaggccccaaaccccacgtcgtccacttcccg

SEQ ID NO: 179796 - DNA, 481 bp, Homo sapiens
  misc_feature: GYAE6OF01DYH7G.25.20.B09.1.454.CMB.1.raw
  modified_base (457)..(481): a, c, t, g, unknown or other
  misc_feature (457)..(481): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgattttctctccctcgctcgcccactctacaactgtctcatctgacgtcgtggggccagggacgcccgtggtccaccgtcctcctcagtccttaccaaccgaacgggtccctacgtccggttcccttcccccgtgggcccgtcccctcgcctaccgaggacgcctacccgttcggcgggggaccaccgagggcccggtcccggttgggcctcggtccgtaggtacgaaccggtaccttaccttcccaacgttcgtaacgtacgttcggtacggacgggccgggtcgtcggggaaccaggggtcccataagtgnnnnnnnnnnnnnnnnnnnnnnnnn

SEQ ID NO: 179797 - DNA, 561 bp, Homo sapiens
  misc_feature: GYAE6OF01BMKP4.25.20.B09.1.454.CMB.1.raw
  modified_base (300)..(300): a, c, t, g, unknown or other
  misc_feature (300)..(300): n is a, c, g, or t
  modified_base (328)..(328): a, c, t, g, unknown or other
  misc_feature (328)..(328): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgctaggttattactttgtctcctggtaccaacaaccaccaggacaaacgaccccaaatcatgactttangaggacactaacgcgcctgagggtttcngctcgcttctctgctcagtctggcatacgcctcctgactatctntcggtctcgaggtctaggaggacgaggtctacgtatttacttacgtntcctttacncgtactagtcgtacgctagtcgacttacggttgggtcgttcggacgtaggacgggtaacctaaagggtccgtacccgtcggtgggtaccaaccggacccgtaacggcctcccggccccttcgggtcctacccg

SEQ ID NO: 179798 - DNA, 569 bp, Homo sapiens
  misc_feature: GYAE6OF01DUU8W.25.20.B09.1.454.CMB.1.raw
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattacttgtctctgtaccaacaacaccaggcaaagccccaaattatcatttatgaggccaactaagcggccctcaggatttcaatcgcttctctggctccaagtctggcagcacggcctcctgacaatctctgggctcgaggctgaggacgaggctagatttattactgtactacttcaatagtggacaacagtacaacaaactcccgtacttccggaccgtgggaccgacgggtccaccggtccgtcgggtcctaacgacccaacggacccaacccctactcgtacaccttccgttccgttccccacccttaccgtcctaaccttgtacctacgttccgtggacggccgggtacgcggcaacgggcgtaaccg

SEQ ID NO: 179799 - DNA, 755 bp, Homo sapiens
  misc_feature: GYAE6OF01BD9QB.25.20.B09.1.454.CMB.1.raw
  modified_base (210)..(210): a, c, t, g, unknown or other
  misc_feature (210)..(210): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttccngcactggactcagcactgatgttgctaggtttattactttgtctctcggtaccaacaaccacccaggaccaaacgccccctaaacttactactatttactacgacggaccctaacgtaacggccggtaccctacgtaagggttacgttttacgtaaacttcggtacctttccgttcgttacgggtacccttaccgtaaacggttccgtacgggaccgtacggcccgtaacccgggtcccttaccccgttaggaaccctaacgttccgttaccgtcgggtaccgttcccgaagggtccgttagggaacgggacggtaacggtcgttagtaactttacgttaccgttgtaccttactacgtattacggtacggtaactaacgtacctaacgaaccttaaacgttccccggttacgttacccgggtaacccgttacggggaacccgtacgggttaccccgtacccggttccggtagggtacccaccggaaccccggtaaaccggtacccctaaccccgaacgtttccgtaacctcccgtttaaccccg

SEQ ID NO: 179800 - DNA, 603 bp, Homo sapiens
  misc_feature: GYAE6OF01EGTDI.25.20.B09.1.454.CMB.1.raw
  modified_base (257)..(257): a, c, t, g, unknown or other
  misc_feature (257)..(257): n is a, c, g, or t
  modified_base (318)..(318): a, c, t, g, unknown or other
  misc_feature (318)..(318): n is a, c, g, or t
  modified_base (504)..(504): a, c, t, g, unknown or other
  misc_feature (504)..(504): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgctaggttattactttgtctcctggtaccaacaacacccaggacaaacgccccaaaattatctatttangacggccaactaacgccggccctcgaggtattttctaatcgtcttctctggcctcaagtcnggcagcacggcctcctgactatctcgtcgggcctccgaggctggaggacgaggtctagtatttattactgtctactcattagtgaacactatacaactaacttcccgtacgttccggaccgttacgggacccgtagggtcccaccggttccgtgggtccacgacccgaacggacccctaacccgtnttcgtacctacccgttctcccgttaccccgcccttccttccgtaccttcgtacctgtaccgtggaccggtcggggactacggggacgtaacggcgtacg

SEQ ID NO: 179801 - DNA, 539 bp, Homo sapiens
  misc_feature: GYAE6OF01DV6NK.25.20.B09.1.454.CMB.1.raw
  modified_base (533)..(533): a, c, t, g, unknown or other
  misc_feature (533)..(533): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgctaggttattactttgtctcctaggtaccaacaacaccagacaaacgcccccaaacttatcatttatgacggccactaacgcggccctcaggtagtttctaatcgcttctctggctcaacgtcgtgcacgcaccggccctccctgactaactctcgtgggcctccgacggctggaggacggaggactgtattattactcgtactactcatataggacactactacactaacttcccgtctcggacctgggaccagggtccaccgtcgtcggtcacgcccgaacgcccaaccccatctccnctcccg

SEQ ID NO: 179802 - DNA, 736 bp, Homo sapiens
  misc_feature: GYAE6OF01CTZ1C.25.20.B09.1.454.CMB.1.raw
  modified_base (227)..(227): a, c, t, g, unknown or other
  misc_feature (227)..(227): n is a, c, g, or t
tcagactgtacagtcacgaccggtgctcgatttagtgtagtgtgaagggggggtctacgaagaggcagcgctctcgggacgttctccaccatggcctgggctcgtgcgtgctcctcactctcctcgactcaggacacgacgggtcctgggcccagtcctgccgtgactcacgcctgccctcgtgtctcgggtctcctcggacacgtcgatccaaccctattttccgnggcacgtggacctcagcacgtgattgtagctaggtttacttactttcgtacttccgtggtaaccaaacgtaaccgaacccgacgggaccaaaaccggccccctaaaaccttatactactttactgacggaccacgtaacgccgccctcaggtagtttctaatccgtcttcctctcggtctcctaacgtctcggcacgtccaccggtccctacccgtacgactaacttcgtaccgtcgggcccttaccgacggtaccgtaggaacggacggtacggccgttaggtactttacgtttaaccggtcgttaaccgttactccgtaaactttacgtacggtaacctaaaccgtaactaaccctaacgttaaacccgttccccggtttaccgttacccgggtaacccggtcggggaaaacccgtcgggtaaccccttcccgggtaacgttccggggtccgaccgtaacccgaccggaaccccctaaccctccgtacgtccctaccgtttaccccg

SEQ ID NO: 179803 - DNA, 644 bp, Homo sapiens
  misc_feature: GYAE6OF01BOT20.25.20.B09.1.454.CMB.1.raw
  modified_base (244)..(244): a, c, t, g, unknown or other
  misc_feature (244)..(244): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgctaggttattactttgtctcctggtaccaacaacaccagcaaacgccccaattancattatgagccactaagcgcctgagtagtttctaatcgcttctctggctccaagtcgtggcacgcacggcctccctgactatctcgtggctcgacgctaggacggacggacggctaggtatttaacgttactcgtacttactactaacgttagtacggaaccactattacccctaaactaaaccgttcccccggttccgttacccgggtaacccgttcggggaacccgtaggggttcccaacccgggttccggtcggggtaccaaccggacccggaaccgcccccaaaccccgtcgttcgttacccacgttcctcccgtttccccgccccgttcctccaaccgtttcgtaaccggtcgttaccgtggaccggtcggggtctagggcaaccgggcgtaccg

SEQ ID NO: 179804 - DNA, 510 bp, Homo sapiens
  misc_feature: GYAE6OF01ACV2J.25.20.B09.1.454.CMB.1.raw
  modified_base (210)..(210): a, c, t, g, unknown or other
  misc_feature (210)..(210): n is a, c, g, or t
  modified_base (286)..(286): a, c, t, g, unknown or other
  misc_feature (286)..(286): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (466)..(510): a, c, t, g, unknown or other
  misc_feature (466)..(510): n is a, c, g, or t
tcagactgtacagtcacgaccggtgctcgatttagtgtagtgtgaagggccggattcgccgtctccagagacaactccaagaacacggtgtttctgcaactgaacggcctgagaaatgtggacacggctgtatatttactgtgcgcgtattttctctccctcgcttagcccactctacaactgtctcatctgacgtctggggccaggganccctggtccaccgtctccgtcgacgtccttacccaaccgtaacggggcccctagttccgggtccctttccccccgngggcccgtcccccttgcccttacccgacgggacgaccctaacccgttcggtacggggggccacggacgggcccggcccgttggggcctgccgtgggtacgaacgggtccttacttcccagttcgtacgtagtccgtgaacggcggtctgggaccaaggccganacgtaaggnagctancnnnnnnnnnnnnnnnnnnnnnnnnnnnnnnnnnnnnnnnnnnnnn

SEQ ID NO: 179805 - DNA, 685 bp, Homo sapiens
  misc_feature: GYAE6OF01CDAW9.25.20.B09.1.454.CMB.1.raw
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
tcagactgtacagtcacgaccggtgctcgatttagtgtagtgtgaagggctggatgacttgggatggggagagacgaccccctcccctgggatcctgcagctccaggctcccgtgactcagcctgcctccgtgtctgggtctcctggacagtcgatcaccatttcctgcactggactcagcactgatgttcgctaggtttattactttgtctcctggtaaccaacaaccaccaggaccaaacgcccctaaaattntacattttangacggaccaacgtaacgccggccctagaggtacgtttctaatcgtctttctcgtggccttaccgaagtctcgggcaggccaccggcccttccgtagactactctcggtcggacctcgaggtcgtaggacggacgaggtctagtatttaacttactacgcttactcagtactacggaactacagtacaactaacctcccgttcgtaccggtaccgtacgggaccgtacgggtccctacccggtcgtaccgggtacaccggacccaaaccgggaccccctaaccccgtactaccgttaccctaccgttaccgttcccggttccccctcccccgttacctacccgtaccgttaccggtaccgttaaccggtccgttacgggacggtcccggggtacgtacgggacccgaagggtcccgtaacg

SEQ ID NO: 179806 - DNA, 359 bp, Homo sapiens
  misc_feature: GYAE6OF01DDU1F.25.20.B09.1.454.CMB.1.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (354)..(359): a, c, t, g, unknown or other
  misc_feature (354)..(359): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctgggccagggagccctggtcaccgtctcctcagcttccaccaaggccatcgtctccccnggcnccctgctccaggagcacctcgtggggcacagccggccctgggctgcctggtcaaggctacttccatgtacagtctgacgcggctggcaaggcgacatagnnnnnn

SEQ ID NO: 179807 - DNA, 703 bp, Homo sapiens
  misc_feature: GYAE6OF01CKW4Y.25.20.B09.1.454.CMB.1.raw
  modified_base (165)..(165): a, c, t, g, unknown or other
  misc_feature (165)..(165): n is a, c, g, or t
  modified_base (676)..(676): a, c, t, g, unknown or other
  misc_feature (676)..(676): n is a, c, g, or t
  modified_base (691)..(691): a, c, t, g, unknown or other
  misc_feature (691)..(691): n is a, c, g, or t
tcagactgtacagtcacgaccggtgctcgatttagtgtagtgtgaagggctgggatgacttgggatggggagagagacccctccctgggatcctgcagctccaggctcccgtgactcagcctgcctccgtgtctgggtctcctggacagtcgatcactatttccngcactggactcagcactgatgttgactaggtttattactttgtcttccgtaggtaaccaacaaccaccgaggaccaaaccgtacccctaaattctactaattttacgacggacggtacctaacgttaacggccggtaccctaggacggttaacgtttacctaagtccgtcttacgtcgtcggaccttacgtaagtcgtgacgtacggacctaccggtccctaccgtagaacctagttcctacggttcggaccttacgcggtcgtacggaacggacgtagtctagttagttactagtcgaccttactacgagttgacgtaaccagtactacgaaacgtaaccgttcccgtaggtacccgtaggtaccgggtaccgtacggtccaaccgttcggtaggactaccggaacccgtacgacccctaaccgtgtcgtaccctacgttcccgtccgttaccccgtacctgtaccgtacggttacaaacccggtgttccgacggtaccggtaccgggtntacccggggtaaacncgggttctaacg

SEQ ID NO: 179808 - DNA, 729 bp, Homo sapiens
  misc_feature: GYAE6OF01D5PDL.25.20.B09.1.454.CMB.1.raw
  modified_base (157)..(157): a, c, t, g, unknown or other
  misc_feature (157)..(157): n is a, c, g, or t
  modified_base (178)..(178): a, c, t, g, unknown or other
  misc_feature (178)..(178): n is a, c, g, or t
  modified_base (277)..(277): a, c, t, g, unknown or other
  misc_feature (277)..(277): n is a, c, g, or t
  modified_base (722)..(722): a, c, t, g, unknown or other
  misc_feature (722)..(722): n is a, c, g, or t
tcagactgtacagtcacgaccggtgctcgatttagtgtagtgtgaagggctggatgacttgggatggggagagagacccctccctgggatcctgcagctccaggctcccgtgactcagcctgcctcgtgtcgtggactcgtggacagtcgtcacctntctctgacacgtacggaaccncgtccgtagactagttggtgtacttaataacttgtcgtcctccgtcgtaacccaaacaaccaccgacggaccgaaccgaaccccaatcatactatttangtatgtcacgtcacgtccgtccctgtggttacgttcgtcggtcttccttacgtcgtcgtctaccgacgttcgacgtacgtaccgtcgtcccctcgtacgtaacctcggtccggacggtcctacgtacggtacgtacggaacggtacgtacgttaccgttaatttacttacgtacgtaccttactttaacgactaacgtaacggaactaaacctaccgtaacgtgttaccgggtagggttaccgggtaccgggacgggtaaacggtaccgtaacgggttacccgttacccggtaccggtaccgggtaccgaaccggtaccggaaccgtcccgtccccgtaacccgttccgtcctacccgttcgtccccgttcccgtacccttccgtaccttacgtacgtaccgtacggttccgcggaccgtcggtacgtcgggaaacgcgtaccgngtaacgg

SEQ ID NO: 179809 - DNA, 528 bp, Homo sapiens
  misc_feature: GYAE6OF01C99JE.25.20.B09.1.454.CMB.1.raw
  modified_base (255)..(255): a, c, t, g, unknown or other
  misc_feature (255)..(255): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (516)..(516): a, c, t, g, unknown or other
  misc_feature (516)..(516): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccagcaaaagcccccaaaattatcattttangagccactaagcgccctcagagtttctaatcgtcttctctggcctccaagtctggccagcacggcctccctgacaatctctggctccaggctgaggacgaggctgattattacngcttacanatangacactatacaacaaactccctctcggacgtcggacgacggtccacgtctacgggcacgacccaacgacccaacccactctcactaccttcgtcccgtccctcctccgactatacacgtctaggacggcggacgnggcgaagcgtac

SEQ ID NO: 179810 - DNA, 704 bp, Homo sapiens
  misc_feature: GYAE6OF01A0KD3.25.20.B09.1.454.CMB.1.raw
  modified_base (209)..(209): a, c, t, g, unknown or other
  misc_feature (209)..(209): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccaggtctgccgtgactcacgcctgcctccgtgtctgggtctcgtgacagtcgatcacctatttcngcactggactcacgcactgtatgtgcgtaagtttacttactttcgtcttacgtacgtaaccaaacaaccaacccgaaggaccaaaaccgtacccctaaattactactactttaagacgtaacgaccctacgtaaacgcccggtaccctagtaacggttacgttttacctaacgttcctacctttcgtcgttaaccggcttaacccgtaagttctcggacaacggcctaacccggtccctaccgtagaaccgttactccgttcgtacgggtccctacggacggtacgtaacggacggtacggtacgtctaacgttagtttaccgtacgtacgtaaccttacgttacaacgttacgtacgtaaacccatacctaccctaaagttaaccctcccggttagttacccgaccggttaacgggaccaccgggttaccgaccgggttcgacgggtacacccggaacccaaccgtaccccaacctctacgtctaaccttcccg

SEQ ID NO: 179811 - DNA, 745 bp, Homo sapiens
  misc_feature: GYAE6OF01DBAFE.25.20.B09.1.454.CMB.1.raw
tcagactgtacagtcacgaccggtgctcgatttagtgtagtgtgaaggggggggtcacaagaggcagcgctctcggggacgtctccaccatggcctgggctctgctgctcctcactctcctcactcaggacacacgggtcctgggcccagtctgccgtgactcagcctgcctccgtgtctgggtctcctggacagtcgatccacctagttttccctgccacgtggaacctcacgcactgattgtagctaggttatttactttgtctccgtaggtaaccaaacaaccaccgaggaccaaaaccgaccccctaaatttactacgtaattttaagcggaacggccaaacgtaacgccggtaccctacgtaaggttacgtttacctaaagtccgtctttcctcgtcggtaccttaccgaagttcgtacgggccacgtacccgaccggtcccctaccgtacggtaaactaacgtttccgtacggttccgggacccttaccggacggtcggtagggacggaacggtacggtcttaggttaactttagtttaccgcttaccgttactactaacgtacggtacgaactaactaacgtacctaaacctaaccgtttcccgttacggtcccggtaaccggtccggggtaacccgtcgggtaccctacccgggttaccgttcgggggtacccaaccccggacccgaaacccgtacccccgaaacccgttcgttacccggtcctaccgtttaccccg

SEQ ID NO: 179812 - DNA, 652 bp, Homo sapiens
  misc_feature: GYAE6OF01A4CSO.25.20.B09.1.454.CMB.1.raw
  modified_base (231)..(231): a, c, t, g, unknown or other
  misc_feature (231)..(231): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctcgtgtctggtctcctggacagtcgatcaccatttcctgcactggactcagcactgatgttgntaggtttattactttgtctcgtgtaaccaacaacaccagacaacgaccccaaattatactattatgacggaccactaacgccggccctagacgtagtttactaactcgtctttctacgtcgtctaccaagttcgtagggaccagcccgacggtccctccgtagacgtaactcgtaccgtggccttccgaacggtcgtacgacggacggaagtcgtacgtaatttaacgttacgtgtacctacttacgaacttacggtacgtaaccacgttaatacccgtaaacctaacgttaccccgttacgtaccggacccgtacgggaccctacggggtacccctaaccgggttcccggtacgggttccaaccgggtccccaaaccgggtcccctaaaccccctaggttccgtacctacccgttccccg

SEQ ID NO: 179813 - DNA, 484 bp, Homo sapiens
  misc_feature: GYAE6OF01BLG2J.25.20.B09.1.454.CMB.1.raw
  modified_base (206)..(206): a, c, t, g, unknown or other
  misc_feature (206)..(206): n is a, c, g, or t
  modified_base (265)..(265): a, c, t, g, unknown or other
  misc_feature (265)..(265): n is a, c, g, or t
  modified_base (433)..(433): a, c, t, g, unknown or other
  misc_feature (433)..(433): n is a, c, g, or t
  modified_base (437)..(484): a, c, t, g, unknown or other
  misc_feature (437)..(484): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgattttctctccctcgctgcccactctacaactgtctcatctgacgtctggggccagggacnccctggtcaccgtctcctcagccttccaccgaacgggccccatccggtccttcccccgnggccgccctgcctccgaggacgccaccgtcggtgggggcaacgcggccggtcccgtgggtcctcggtcccgtcggtaccgaacggtaccttaccgttccacgttcgtactacggttcgtgggtacggccggggtctacgggaccgtaacgggcccgacaagtaggcangcgnnnnnnnnnnnnnnnnnnnnnnnnnnnnnnnnnnnnnnnnnnnnnnnn

SEQ ID NO: 179814 - DNA, 819 bp, Homo sapiens
  misc_feature: GYAE6OF01E0KAT.25.20.B09.1.454.CMB.1.raw
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactggatggttgctaggtttattactttntctcctggtaaccaacaaccaccagacaaaccgacccctaaaacttntactatttagtacgacggtacccaacgtaacggccggtacccctacgtacgggttagttttacgttaattccggtacctttcttacgttcgggtacccttacccgtaaacggtttccgtcgggccgtaacggtcccgtaaacccgggtccccctttccccggtaagaaccctaacgtttccgttccggtacggggtcccttaaccccgggagggtacccggttaggggaaaccgggaccggtaacggtaccgtttaacggttaaccgtttttaaacgtttaaccgtcgttaacccgttactttaacccgaagtttaacggtacggtaaccctaacgttaactacccgtaaaacttaacccgttccccgttacgttaacccggtaaccgtaccggggttaacccgtaaccggggttacccgttaccccggttacccgggttgggaacccgaccggttacccccgaaacccgggtacccccctaaaccccgtacgttaccgtacccgtccccgttacccgg

SEQ ID NO: 179815 - DNA, 775 bp, Homo sapiens
  misc_feature: GYAE6OF01A8KR4.25.20.B09.1.454.CMB.1.raw
  modified_base (257)..(257): a, c, t, g, unknown or other
  misc_feature (257)..(257): n is a, c, g, or t
  modified_base (755)..(755): a, c, t, g, unknown or other
  misc_feature (755)..(755): n is a, c, g, or t
tcagactgtacagtcacgaccggtgctcgatttagtgtagtgtgaagggctggatgacttgggatggggagagagacccctccctgggatcctgcagctccaggctcccgtgactcagcctgcctccgtgtctgggtctcctggacagtcgatcaccatttcctgcactggactcagcactgatgttgctaggttattactttgtctcctggtaccaacaacaccgaggaccaaacgcccctaaatatctatttagngacggaccactaacggccggcctagacgtagtttactaactcgtcttcctcgtcggtacctacctaaggttcgtggacacggacctaccgggtcccctacccgttagaacctaacgttccgttccggtcggggtacccttacccggaacggggtacgtacgggaaacggggtaccggtaacggttccgttaaggtaaacttttacgtttaccggtgttaacccgttactacgtaagtaacggttacggaacaacgaacttaacccgtaaaccgtaaaacccgttccccggttacgttaccggggtaacccgtacgggggtaacccgtacggggtaaccctccccgggtaccggttcgggtaccgtacccgacccggaaaccggaccccctaaacccccgtacgttccggtacctacccgttccgtccccgtttacccccggccccttccgtaccgtacgttacgtaaaccgtcggttccggacgtacggcgggtacgnggtaacggacgtcggtaacg

SEQ ID NO: 179816 - DNA, 803 bp, Homo sapiens
  misc_feature: GYAE6OF01C00YG.25.20.B09.1.454.CMB.1.raw
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
tcagactgtacagtcacgaccggtgctcgatttagtgtagtgtgaagggctggatgacttggggatgggggagagacgacccccttccccgtgggatcctgcagcctccaggcctcccgtgacctcacgcctgccctcgtgtcgtcgggtctcctggacagtcgatcacctatttccngctagtggactnacgctatgatggttgacgttagtttacttccgtttgtaccttccgtacggtaaaccaaacctaacccgaccctaacggaacctaaaacccgtaaccccctaaaacttcgtattaagttttacgacggaacgtacccaagtaaccggcccggtacccttaggtaacgggttacttttacaacgtttcgtcccgtttcgtcgtcgggtaccttaaccggttacggtccggtacggaccgtaacgtccggtacccggtaccccttacccgtaacggacctacgttccgtacgggtcgcccgttaacggcgtacggacggtacggacgtcgggtcttaagtactttaactcggtactacgtacttaacgaagtacgtcgaacctacgtactaaccctacgttaaccgtcccgtttaccgaccgggtaccgtacggaaccggttcggtaccgtcccggtcgtaccggtccgtaaccggacccgtaaccggtaccctaccgtacgttcctaccgtccgttcctcccgggttacccctcccgttacctaccgtaccgtccgttacgaccggttcggtaccgggtccggaccgggtccgtaggaacccggtggtcctacgg

SEQ ID NO: 179817 - DNA, 720 bp, Homo sapiens
  misc_feature: GYAE6OF01BNEUK.25.20.B09.1.454.CMB.1.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
  modified_base (370)..(370): a, c, t, g, unknown or other
  misc_feature (370)..(370): n is a, c, g, or t
tcagactgtacagtcacgaccggtgctcgatttagtgtagtgtgaaggggggggtcacaagaggcagcgctctcgggacgtctccacatggcctgggctctgctgctcctcactctcctcactcaggacacagggtcctgggcccagtctgccgtgactcagcctgcctccgtgtctgggtctcctgacagtcgatccacctatttctgcacgtggactcacgcactgatgtgcgtagtttntttacgtttntcctcgtacggtaaccaaacaccaccgagaccaaaccgtaccccctaaattctacctattttagnggaaccggaccaacgtaacggccggccctagtaagggtactttactacgttcncttctacgtcggctaccgtagtcgtggactacgccgacccggtccttacccgtagaacctacgtcgttccggtgggtacccctcggtacggtcgtaagggccgggaacgggtacggtactttacgggttaaactttccggtttaacttcggtaccttacgtactaactaggtacccgaatactaactaccgaacttaaccgtccgttacgttacgggacccgtacggaccggtaacggttcccaacccggtttccgggtacggtcccaaacccggtaacccccggaaacccgtaccccccgttaaacccgaccggtttacccctaaccgttccccggtttaaccccccgg

SEQ ID NO: 179818 - DNA, 313 bp, Homo sapiens
  misc_feature: GYAE6OF01BCWE4.25.20.B09.1.454.CMB.1.raw
  modified_base (137)..(137): a, c, t, g, unknown or other
  misc_feature (137)..(137): n is a, c, g, or t
  modified_base (163)..(163): a, c, t, g, unknown or other
  misc_feature (163)..(163): n is a, c, g, or t
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (271)..(273): a, c, t, g, unknown or other
  misc_feature (271)..(273): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (282)..(283): a, c, t, g, unknown or other
  misc_feature (282)..(283): n is a, c, g, or t
  modified_base (288)..(313): a, c, t, g, unknown or other
  misc_feature (288)..(313): n is a, c, g, or t
tcagactgtacagtcacgaccggtgctcgatttagtgtagtgtgaagggctggatgacttgggatggggagagagacccctcccctgggatccgtgcagctccaggctgaggacgaggctgattattactgctactnatatggacacatcacaaactcccgtnttcggacctgggaccagggtcaccgtctgggtcagcccaaggcccaacccatgcactctgttccccgccctctcactgtacngtctgagcggctggcaaggcncatgnnnatgntnatnncaatnnnnnnnnnnnnnnnnnnnnnnnnnn

SEQ ID NO: 179819 - DNA, 731 bp, Homo sapiens
  misc_feature: GYAE6OF01BUUNS.25.20.B09.1.454.CMB.1.raw
  modified_base (162)..(162): a, c, t, g, unknown or other
  misc_feature (162)..(162): n is a, c, g, or t
  modified_base (168)..(168): a, c, t, g, unknown or other
  misc_feature (168)..(168): n is a, c, g, or t
  modified_base (693)..(693): a, c, t, g, unknown or other
  misc_feature (693)..(693): n is a, c, g, or t
tcagactgtacagtcacgaccggtgctcgatttagtgtagtgtgaagggctggatgacttgggatggggagagacgacccctccctgggatcctgcagctccaggctcccgtgactcagcctgcctccgtgtctgggtctccgtggacagtcgatcaacctntttcgngcacgtgactcagcactgatcgtgacgtagttacttacgttgtcctacgtgtaaccaaacaaccgaccaaggtaaccaaaccggtacccctaaattactacgtaagtttacgacggacgacctaacgttaacggacccgtcctagtacggtactttacgtaacgtccgtaccttcgtccgtccgggaaccttaccggtaaacggtcgtacggaccgtaccgggtacccgtaccgggtccccttaccggtaacttaaccggtaacttcccgttcgggtaccggggtcctaacggtaacgtaccggtacgggaacgggaaccggacggttacgtaggttaaactttaaccgtttcaaccgttacctaatacgtaactacgtacggaaccaagtacctacgtaaacgtaaccgtttcccgtacggtaccgtacgggtaacgtaccgtacggtacccaccggttcgaccggtcgaccgaacccgacgacctacccgctacgtccacgttcctaccgccctacgcgtacncgtgtaacctgactgggacgcgtacgcgagacgctacg

SEQ ID NO: 179820 - DNA, 891 bp, Homo sapiens
  misc_feature: GYAE6OF01B7FFC.25.20.B09.1.454.CMB.1.raw
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtcttctggacagtcgatcacctatttcctgcactggactcagcactgatgttgcgtaggttatttacgtttgtcttccgtacggtaacccaaacaaaccgaacccgaacggaccaaaaccgtaccccctaaaacttactacctaattttaacgtaggacggaccctaacgtaacggcccggtacccttacgaacgggttaacttttacgtaaacgttccggttcttttccgtaccgtacgggtacctttaaccgtaacggttccgttacggaccgaccggtaccggtaaccggtccccttacccgtaacgaaccttaacttccgtaccggtcgggtacctccggacggtcgtaggaacgggacggtacggtctagttaaatttacgttacgttacgacctttaccgtactacgtacgtacggaactactaactaacctaaaccgtaaccgttccccgttaccggttacccgggtaaccggtaccgggtaacccggtaacgggttcccgtaacccgggttccgtaccgggttacccgaacccggtaacccgtaaacccggtacccccgtaaaacccccgtacgttacccgttacccgtaacccgttttcccgttaccccgtttaccccccgtaaaccccttccccgttaacccgtaccgtttaacccggttaccgttaacccggttaccggtaccgggtaccgggtccgggtaccgggttaacccgggtaccggtaaaccgggaccggtaaccgg

SEQ ID NO: 179821 - DNA, 720 bp, Homo sapiens
  misc_feature: GYAE6OF01DZ5IH.25.20.B09.1.454.CMB.1.raw
  modified_base (519)..(519): a, c, t, g, unknown or other
  misc_feature (519)..(519): n is a, c, g, or t
tcagactgtacagtcacgaccggtgctcgatttagtgtagtgtgaagggtctgggagacgagcccagcactggaagtcgccggtgtttccagttcggtgatcatcaactgaacacagaggactcaccatggtagtttgggctgagtcttgggttttcctcgttgcttacttttaagagtatgtccagtgtactaagtcgccaccgtggtgagtcgtggggagcgtgtccaggccgtgggagtccctgacgaccttcctcgtgttacacgtcctcgttgggttcaagttcgttcgacgttccctactactagtacgtacgtcgggtccccgccgtaccggcccccggaggaacggggtcgtagggtacggtgggtcgtcttacgttactcacgtaatcgtagagtacggtaattacgttaaactaccgtacgaccgtaaccgtccggtagggaacggtccgtagtccgtccgtactcgaagtcaaccgaactacgaacgtaacgttcggttacgttacgngtaccgtaagttaccgaacggtaccttagggaaattaacgtcgggtaacgtaaccggaccgttacggttacgttaattaccgttaagttggtcccgtacggttaccgtttactttccccgtcccgttaaccgtccggtaaccttcgtaaccccgtacttacgtacctaaccgttcgttacttcgaagtttcgtaacccggg

SEQ ID NO: 179822 - DNA, 383 bp, Homo sapiens
  misc_feature: GYAE6OF01B4UPN.25.20.B09.1.454.CMB.1.raw
  modified_base (296)..(296): a, c, t, g, unknown or other
  misc_feature (296)..(296): n is a, c, g, or t
  modified_base (350)..(350): a, c, t, g, unknown or other
  misc_feature (350)..(350): n is a, c, g, or t
  modified_base (353)..(383): a, c, t, g, unknown or other
  misc_feature (353)..(383): n is a, c, g, or t
tcagactgtacagtcacgaccggtgctcgatttagtgtagtgtgaagggctggatgacttgggagtggggagagacgaccccctccccgtgggatcctgacaactccaggctggaggacgaggctgattatactgctactcatatggacacatacaacaaactcccgtcgttcggaccgtggaccgagggtccaccggtccgttgggaccacgccccgaaacggccccaaacccctactcgtacctaccttccgttccgttaccccctacccctccctacctaccgtacgtaaccnggttccgaggacggtccggggtctacgggccaaaagggggcccacgaagttagngcnnnnnnnnnnnnnnnnnnnnnnnnnnnnnnn

SEQ ID NO: 179823 - DNA, 671 bp, Homo sapiens
  misc_feature: GYAE6OF01DE1VG.25.20.B09.1.454.CMB.1.raw
  modified_base (213)..(213): a, c, t, g, unknown or other
  misc_feature (213)..(213): n is a, c, g, or t
  modified_base (435)..(435): a, c, t, g, unknown or other
  misc_feature (435)..(435): n is a, c, g, or t
  modified_base (521)..(521): a, c, t, g, unknown or other
  misc_feature (521)..(521): n is a, c, g, or t
  modified_base (531)..(531): a, c, t, g, unknown or other
  misc_feature (531)..(531): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacgagggtcctgggcccaggtctgccgtgactcacgcctgcctccgtgtcgtgggtctctggacagtcgatccacctatttccngcacgtggacctcacgctactgtacttggttacgacgttagttttactttactttcgttccttccgtaacggtaacccaaaacctaaaccgaacccgaaggaaccaaaaccgtaaccccctaaaattacttaactaatttagacggaccggaccaacgtaacggcccgtccgtagtaggttactttacaacgttcgtacttctacgtcgtactacgagtcgngcacgcgaccgtcctactacgaactacttcgtacgtccggctaccgaggccgtaggaacggtacgaggtaccgtatacttacttcncgtactactntaacgtagtacgaacactactaactaacgtaccgttacccgtcgttacggaccggtacggaccgtcgtacccgtaccggtcggtacggaccgacccgaaccggacccgacccctaaccgttctcgtaccctcgttacccg

SEQ ID NO: 179824 - DNA, 597 bp, Homo sapiens
  misc_feature: GYAE6OF01B63VL.25.20.B09.1.454.CMB.1.raw
  modified_base (298)..(298): a, c, t, g, unknown or other
  misc_feature (298)..(298): n is a, c, g, or t
  modified_base (393)..(393): a, c, t, g, unknown or other
  misc_feature (393)..(393): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgccacgtggactcgacgcactgtatgttgctagttattactttgtctcctcgtaccaacacaccagacaacgccccaactctctattngacgccactacgccggtcctcgagtactttctaatctacttctcgtcgtctacagtctcggcacgcaccgcctcctgactactctcgtgctccgngtcgtaggacggacgtaggtctagtactttaacgttaccgtgtaccttaacgtctagtactaccggaactacgtactacaactaaccgttcccgtacgttccggtaccgtacgggaccggtacggttaccgacccggttcggtaccggtaccgaccgaaccccgtaccgacccctaaccccacgttcctccgtcccgttccccg

SEQ ID NO: 179825 - DNA, 320 bp, Homo sapiens
  misc_feature: GYAE6OF01EUE82.25.20.B09.1.454.CMB.1.raw
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (285)..(320): a, c, t, g, unknown or other
  misc_feature (285)..(320): n is a, c, g, or t
tcagactgtacagtcacgaccggtgctcgatttagtgtagtgtgaagggctggatgacttgggatgggggagagacgaccccctcccctgggatcctgcagctccaggctgaggacgaggctgatttattactgctactcatatggacacatcaacaaactccgtcttcggacctgggaccagggcaccgtcctggcacgcccaaggcccaacccntgtacntctcgtaccccncctcctacactgtacagtctaggcggcgggtctggcgaagggcactaatgnnnnnnnnnnnnnnnnnnnnnnnnnnnnnnnnnnnn

SEQ ID NO: 179826 - DNA, 701 bp, Homo sapiens
  misc_feature: GYAE6OF01C8P49.25.20.B09.1.454.CMB.1.raw
  modified_base (639)..(639): a, c, t, g, unknown or other
  misc_feature (639)..(639): n is a, c, g, or t
  modified_base (692)..(692): a, c, t, g, unknown or other
  misc_feature (692)..(692): n is a, c, g, or t
tcagactgtacagtcacgaccggtgctcgatttagtgtagtgtgaagggctggatgacttgggatggggagagacgacccctcccctgggatcctgcagctccaggctcccgtgactcagcctgcctcgtgtctgggtctcctggacagtcgatcacctatttcctgcactggactcagcactgatgttgacgtaggtttattactttgtctccgtaggtaaccaaccaacaccgaggacctaaaccgaccccctaaattatactagtttagaggaacgaccaacgtaacggccggtacccctaggtaagggttacttttactaactcgtcctttcgttcgttacggcctaccgaaggtcgtacggacacgccgtaccggtccctaccgagaactaactcgtcgtacggggctaccgtaagggtcgtgggaacgggaaccgtagggtctttaagtaacttttacgtaaccgtgtactaacgttacaatttacgtcgaaactacgaattcctaaactaaccgtcccgttacgtaccggaccggtacggaaccgagggtacctccccggttagtccgggtacaacggacccgtaaccgacccgtaacccacgttcaccgtaccttccgttcccgtaccccncccttacgctaacgtacgacgtacgttacgcggacggtcggtaactccggaancggtcaacg

SEQ ID NO: 179827 - DNA, 273 bp, Homo sapiens
  misc_feature: GYAE6OF02HRBN1.25.20.B09.1.454.CMB.1.raw
  modified_base (271)..(273): a, c, t, g, unknown or other
  misc_feature (271)..(273): n is a, c, g, or t
tcagactgtacagtcacgaccggtgctcgatttagtgtagtgtgaagggctggatgacttgggatgggagagagacccctccctgggatcctgcagctccaggctgaggacgaggctgattattactgctactcatatggacacatcacaaatcccgtcttcggacctgggaccagggtcaccgtcctgggtcagcccaaggccaacccactgtcactctgttcccaccctcctcactgtacagtctgagcgggctggcaaggcgcatagnnn

SEQ ID NO: 179828 - DNA, 517 bp, Homo sapiens
  misc_feature: GYAE6OF02HIY9R.25.20.B09.1.454.CMB.1.raw
tcagactgtacagtcacgaccggtgctcgatttagtgtagtgtgaagggctggagtgacgttgggagtggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaattatcatttatgaggccactaagcggccctcaggagtttctaatcgcttctctggctccaagtctggcagcacggcctccctgacaatctctgggctccaggctgaggacgaggctgattattactgctactcatatggacacatcaacaaatcccgtcttcggacttgggaccagggtcaccgtctgggtcagcccaaggcccaaacccgctcgtccacttctcgttcccgccctcctcactgtacagtctgacgcgggctggcaggcacg

SEQ ID NO: 179829 - DNA, 274 bp, Homo sapiens
  misc_feature: GYAE6OF02FPKRC.25.20.B09.1.454.CMB.1.raw
  modified_base (271)..(274): a, c, t, g, unknown or other
  misc_feature (271)..(274): n is a, c, g, or t
tcagactgtacagtcacgaccggtgctcgatttagtgtagtgtgaagggctggatgacttgggatgggagagagacccctccctgggatcctgcagctccaggctgaggacgaggctgattattactgctactcatatggacacatcacaaatcccgtcttcggacctgggaccagggtcaccgtcctgggtcagcccaaggccaacccactgtcactctgttcccaccctcctcactgtacagtctgagcgggctggcaaggcgcatagnnnn

SEQ ID NO: 179830 - DNA, 508 bp, Homo sapiens
  misc_feature: GYAE6OF02HKBOW.25.20.B09.1.454.CMB.1.raw
  modified_base (490)..(490): a, c, t, g, unknown or other
  misc_feature (490)..(490): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaaattatcatttatgaggccactaagcggccctcaggagtttctaatcgcttctctggctccaagtctggcagcacggcctcctgacaatctctgggctccaggctgaggacgaggctgattatactgctactcatatggacacatcacaaatcccgtcttcggacctgggaccagggtcaccgtcctgggtcagcccaaggcccaacccactcgtcactctcgttcccacctcctcactcgtacagtcngacgcggctggcaggcac

SEQ ID NO: 179831 - DNA, 513 bp, Homo sapiens
  misc_feature: GYAE6OF02G2BHH.25.20.B09.1.454.CMB.1.raw
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacaccccaggcaaagcccccaaacttatcatttatgaggccactaagcggccctcaggagtttctaatcgcttctctggctccagtctggcagcacggcctccctgacatctctggctcagctgagacgnggctgattattactgctactcatanggacacatcaacaaactcccgtcttcggacctgggaccaggtccaccggtcctgggtccacgcccgaacggcccaaccccactcgtccacttccg

SEQ ID NO: 179832 - DNA, 501 bp, Homo sapiens
  misc_feature: GYAE6OF02FE3BG.25.20.B09.1.454.CMB.1.raw
  modified_base (295)..(295): a, c, t, g, unknown or other
  misc_feature (295)..(295): n is a, c, g, or t
  modified_base (439)..(439): a, c, t, g, unknown or other
  misc_feature (439)..(439): n is a, c, g, or t
  modified_base (492)..(492): a, c, t, g, unknown or other
  misc_feature (492)..(492): n is a, c, g, or t
tcagactgtacagtcacgaccggtgctcgatttagtgtagtgtgaaggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaagcccccaaattatcatttangaggccactaagcggccctcaggagtttctaatcgcttctctggctcaagtctggcagcacggcctccctgacaatctctgggctcaggctgaggacgaggctgattatactgctactcatatggacacatcacaaatcccgtnttcggacctgggaccagggtcaccgtcctgggtcagcccaaggcccaaccccntcgtcactc

SEQ ID NO: 179833 - DNA, 515 bp, Homo sapiens
  misc_feature: GYAE6OF02HNDI2.25.20.B09.1.454.CMB.1.raw
  modified_base (491)..(491): a, c, t, g, unknown or other
  misc_feature (491)..(491): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagccccaaatcatcatttatgatgtcagtcatcggccctctggagttttctggtcgcttctctggctccaagtctggcaactcggcctcctgaccatctcgggctccaggctgaggacgaggctaacttattattgctatttcattacagagacaccaacagtctggtgttcggcggagggaccaagttcgaccgtcgtcggtcacgcccaaggctcgcccctcggtccactcctcgttcccgccctctccactgtacngtctgcgcgggctggcaggcgacg

SEQ ID NO: 179834 - DNA, 538 bp, Homo sapiens
  misc_feature: GYAE6OF02JDS5I.25.20.B09.1.454.CMB.1.raw
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagccggccctcaggagtttcaatcgcttctctggctccaagtctggcagcacggcctccctgacatctctggctccgaggctgaggacgaggtctgattattactgctactcatatggacacatcaacaaactcccgtcttcggacctgggaccagggtccaccgtcctgggtcacgacccgaaggcccaacccacgtcgtcaccgttctcgttccccgcccttcctccacgttcgtactacgtcctaggacggcggcgtggcaacgggctacg

SEQ ID NO: 179835 - DNA, 510 bp, Homo sapiens
  misc_feature: GYAE6OF02GLKDN.25.20.B09.1.454.CMB.1.raw
  modified_base (438)..(438): a, c, t, g, unknown or other
  misc_feature (438)..(438): n is a, c, g, or t
  modified_base (496)..(496): a, c, t, g, unknown or other
  misc_feature (496)..(496): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgctcctggtaccaacaacacccaggcaaagcccccaaattatcatttatgaggccactaagcggccctcaggagtttcaatcgcttctctggctcaagtctggcagcacggcctccctgacaatctctggctcaggctgaggacgagctgattatactgctactcatatggacacatcaacaaactcccgtnttaccggacctgggaccagggtccaccgtcctgggtcacgcccgaaggcccaaccccnctcgtccacttccg

SEQ ID NO: 179836 - DNA, 521 bp, Homo sapiens
  misc_feature: GYAE6OF02GMA81.25.20.B09.1.454.CMB.1.raw
  modified_base (458)..(458): a, c, t, g, unknown or other
  misc_feature (458)..(458): n is a, c, g, or t
  modified_base (479)..(479): a, c, t, g, unknown or other
  misc_feature (479)..(479): n is a, c, g, or t
  modified_base (498)..(498): a, c, t, g, unknown or other
  misc_feature (498)..(498): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagcggccctcaggagtttctaatcgcttctctggctccaagtctggcagcacggcctccctgacaatctctgggctccaggctgaggacgaggctgattattactgctactcatatggacacatcaacaaactcccgtcttcggacctgggaccagggtccaccgtcctgggtcacggcccaaggcccaacccntcgtccactcctcgttccccnccctcctcacttcgtaccngtctgacgcgggctggcaggcac

SEQ ID NO: 179837 - DNA, 554 bp, Homo sapiens
  misc_feature: GYAE6OF02GY4D4.25.20.B09.1.454.CMB.1.raw
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (427)..(427): a, c, t, g, unknown or other
  misc_feature (427)..(427): n is a, c, g, or t
  modified_base (466)..(466): a, c, t, g, unknown or other
  misc_feature (466)..(466): n is a, c, g, or t
tcagactgtacagtcacgaccggtgctcgatttagtgtagtgtgaagggggggtcgacaagacgggcagcgcttctcgggacgtctccaccagtggcctgggctctgcttgctcctcactctcctctacttcaggacacagggtcctgggcccagtctgccctgactcagcctgcctccgtgtctgggtctcctggacagtcgatcaccatctcctgcactggaatcaccactgatgttgcatttcatgaccttgtctctggtaccaacaacaccccgacaaacgcccccaaatcatcgatttatgaggcactaagcggcctgagggtttctgctcgcttcnctgctcagtctggcaatacgcctcctgacaatctntcggtctccgaggctggacggacgagtctagtatttagttactgtcttcntacattgcgctagtacgcttacggtttggtcgtttcggngtacggacgggtaacccaaaggtcgtaacccggtcgttcgggtaccacggtacccgaagggtccctccggtacccccgttggtacccc

SEQ ID NO: 179838 - DNA, 509 bp, Homo sapiens
  misc_feature: GYAE6OF02FJ4KI.25.20.B09.1.454.CMB.1.raw
  modified_base (320)..(320): a, c, t, g, unknown or other
  misc_feature (320)..(320): n is a, c, g, or t
  modified_base (445)..(445): a, c, t, g, unknown or other
  misc_feature (445)..(445): n is a, c, g, or t
  modified_base (498)..(498): a, c, t, g, unknown or other
  misc_feature (498)..(498): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaagccccccaaaacttatcatttatgaggccactaagcggccctnaggagtttctaatcgcttctctggctccaagtctggcagcacggcctcctgacatctctggctcaggctgaggacgaggctgattattactgctactcattatgacacatcaactaaatcccgtnttcggacctgggaccagggtccaccgtctgggtcacgcccaaggcccaacccntcgtcactccg

SEQ ID NO: 179839 - DNA, 537 bp, Homo sapiens
  misc_feature: GYAE6OF02GDFUI.25.20.B09.1.454.CMB.1.raw
  modified_base (209)..(209): a, c, t, g, unknown or other
  misc_feature (209)..(209): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgctaggttattactttgtctcctggtaccaacaacacccaggcaaacgcccccaaacttatcatttatgaggccactaagcggccctcaggtagtttctaatcgcttctctgctcagtctggcagcacggcctcctgacaatctcgtcgggcctcgaggctggacggacgaggctgtattattactgactactcattatggacacatacaactaaactcccgtacgttcggacctgggacctagggtccaccggtccgtgggtaccacggcccaacggccccaaccccgctcgtacctacttccg

SEQ ID NO: 179840 - DNA, 509 bp, Homo sapiens
  misc_feature: GYAE6OF02JE3LY.25.20.B09.1.454.CMB.1.raw
  modified_base (207)..(207): a, c, t, g, unknown or other
  misc_feature (207)..(207): n is a, c, g, or t
  modified_base (447)..(447): a, c, t, g, unknown or other
  misc_feature (447)..(447): n is a, c, g, or t
  modified_base (497)..(497): a, c, t, g, unknown or other
  misc_feature (497)..(497): n is a, c, g, or t
tcagactgtacagtcacgaccggtgctcgatttagtgtagtgtgaaggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctcctggtaccaacaacaccccaggcaaagccccccaaaattatcaatttatgaggccactaagcggccctcaggagtttctaatcgcttctctggctccaagtctggcagcacggcctccctgacaatctctgggctccaggctgaggacgaggctgattattactgctactcatatggacacatcactaaatcccgtnttcggacctggaccaggtccaccgtctggtccagcccaaggcccaacccntcgtcacttccg

SEQ ID NO: 179841 - DNA, 499 bp, Homo sapiens
  misc_feature: GYAE6OF02J2IME.25.20.B09.1.454.CMB.1.raw
  modified_base (208)..(208): a, c, t, g, unknown or other
  misc_feature (208)..(208): n is a, c, g, or t
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagttgatcaccatttccngcactggactcagcactgatgttgcaggttattactttgtctcctggtaccaanaacacccaggcaaagcccccaaattatcatttatgagccactaagcggccctnaggagttctaatcgcttctctggctccaagtctggcagcacggctcctgacaatcnctggctcaggctgaggtacaggctgattattacngctacgtcatatgactacatcacaaactccgtctcggactggaccngggtcaccgttcnggtccagcccaaggcccaacccatcgtcacttccg

SEQ ID NO: 179842 - DNA, 507 bp, Homo sapiens
  misc_feature: GYAE6OF02FYD04.25.20.B09.1.454.CMB.1.raw
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaagccccccaaacttatcatttatgaggccactaagcggccctcaggagtttctaatcgcttctctggctccaagtctggcagcacggcctccctgacaatctctgggctccaggctgaggacgaggctgattatactgctactcatntggacacatcacaaatcccgtnttcggacctggaccagggtcaccgtcctgggtcagcccaaggcccaacccactcgtcactccg

SEQ ID NO: 179843 - DNA, 495 bp, Homo sapiens
  misc_feature: GYAE6OF02H6O5K.25.20.B09.1.454.CMB.1.raw
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
  modified_base (487)..(487): a, c, t, g, unknown or other
  misc_feature (487)..(487): n is a, c, g, or t
tcagactgtacagtcacgaccggtgctcgatttagtgtagtgtgaaggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacaccccaggcaaagcccccaaaacttatcatttatgaggccactaagcggccctcaggagtttcaatcgcttctctggctccaagtctggcagcacgcctcctgacaatctctgggctccaggctgagacgaggctgattattactgctactcatatggacacatcaacaaatcccgtnttcggactggaccagggtcacgtcnggtcagcccaggccaacccntcgtcatc

SEQ ID NO: 179844 - DNA, 547 bp, Homo sapiens
  misc_feature: GYAE6OF02IP5KY.25.20.B09.1.454.CMB.1.raw
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaattatcatttatgaggccactaaagcggccctcaggagtttctaatcgcttctctggctccaagtctggcagcacggcctccctgacaatctctgggctccgaggctgaggacgaggctgattattactgctactcatatggacacatcaacaaactcccgtacttccgggacccggaccagggtccaccgtccgtgggtccacgcccgaacggcccaacccactacgtcactctcgttcccaccctcctactacgtcgtacctacgtcgtacgacggtcggcgtcggacgaacggccgactaacg

SEQ ID NO: 179845 - DNA, 521 bp, Homo sapiens
  misc_feature: GYAE6OF02HN6VS.25.20.B09.1.454.CMB.1.raw
  modified_base (460)..(460): a, c, t, g, unknown or other
  misc_feature (460)..(460): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaaacgcccccaaaacttatcatttatgaggccactaagcggccctcaggagtttctaatcgcttctctggctccaagtctggcagcacggcctcctgacaatctctgggctccaggctgaggacgaggctgatttatactgctactcatatggaacacatcaacaaactcccgtcttcggacctgggaccagggtcaccgtcgtgggtcacgcccaacggcccaacccnctcgccactcttcgtcccaccctcctcacttgacngtcnggacgcggctcggacaggcacg

SEQ ID NO: 179846 - DNA, 512 bp, Homo sapiens
  misc_feature: GYAE6OF02G1OR9.25.20.B09.1.454.CMB.1.raw
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (448)..(448): a, c, t, g, unknown or other
  misc_feature (448)..(448): n is a, c, g, or t
  modified_base (486)..(486): a, c, t, g, unknown or other
  misc_feature (486)..(486): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaacgcccccaaaattatcatttatgaggccactaagcggccctcaggagtttcaatcgcttctctggctcaagtctggcagcacggcctccctgacatctctggctcagctgagacgagctgattatacngctactcatatggacanatcacaaactccgtactccggacgtcggaccaggcaccgtcgtggtacacgacccaacggcccaaacccnctcgcctactctcgtccccacctcctcgtactcgtacncgtctgacgcggtctgggcaggcacg

SEQ ID NO: 179847 - DNA, 280 bp, Homo sapiens
  misc_feature: GYAE6OF02HPS55.25.20.B09.1.454.CMB.1.raw
  modified_base (214)..(214): a, c, t, g, unknown or other
  misc_feature (214)..(214): n is a, c, g, or t
  modified_base (276)..(280): a, c, t, g, unknown or other
  misc_feature (276)..(280): n is a, c, g, or t
tcagactgtacagtcacgaccggtgctcgatttagtgtagtgtgaagggctggatgacttgggatggggagagagacccctcccctgggatcctgcagctccaggctgaggacgaggctgattattactgctactcatatggacacatcacaaatcccgtcttcggacctgggaccagggtcaccgtcctgggtcagcccaaggcccaaccccnctgtcactctgttcccaccctcctcactgtacagtctgagcgggctggccaaggcgcatagnnnnn

SEQ ID NO: 179848 - DNA, 361 bp, Homo sapiens
  misc_feature: GYAE6OF02GCCUQ.25.20.B09.1.454.CMB.1.raw
  modified_base (359)..(361): a, c, t, g, unknown or other
  misc_feature (359)..(361): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttccccctggcgccctgctccaggagcacctctgggggcacagcggccctgggctgcctggtcaaggctacttccactgtacagtctgagcgggctggcaaggcgcatagnnn

SEQ ID NO: 179849 - DNA, 594 bp, Homo sapiens
  misc_feature: GYAE6OF02FTN46.25.20.B09.1.454.CMB.1.raw
  modified_base (209)..(209): a, c, t, g, unknown or other
  misc_feature (209)..(209): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctctggtaccaacaacaccaggcaaagcccccaaacttatcatttatgaggccactaagcggccctcaggagtttctaatcgtcttctctggctcaagtctggcagcacggcctcctgacaatctctgggctccgaggctggaggacgaggctgtattattactgctactcaatatggactacataccaactaaacttaccgtcgtttaccgggaccgttcggggaaccctagggggttaccctaacccgggttcccgtagggggttacccaacgggtacccccgtaaacggggacccccctaaaaccccccgtacgttaccggttaccccaccgtttaccccgg

SEQ ID NO: 179850 - DNA, 514 bp, Homo sapiens
  misc_feature: GYAE6OF02HJOV8.25.20.B09.1.454.CMB.1.raw
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (494)..(494): a, c, t, g, unknown or other
  misc_feature (494)..(494): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaaagcccccaaaacttatcatttatgaggccactaaagcggccctcaggagtttctaatcgcttctctggctccaagtctggcagcacggcctcctgacaatctctgggctccaggctgaggacgaggctgattatactgctactcatatggacacatcacaaactcccgtcttcggacctgggaccaggtcaccgtcncgggtcncggccaggcccaacccgctcgtcactctcgtcccaccctctccactgtaccagttcngacgcggctcggcaggctac

SEQ ID NO: 179851 - DNA, 533 bp, Homo sapiens
  misc_feature: GYAE6OF02JTKAD.25.20.B09.1.454.CMB.1.raw
  modified_base (245)..(245): a, c, t, g, unknown or other
  misc_feature (245)..(245): n is a, c, g, or t
  modified_base (396)..(396): a, c, t, g, unknown or other
  misc_feature (396)..(396): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaattntcattatgaggccataagcggcctcaggattctaatcgcttctctggctcaagtctggcagcacggcctcctgacatctctggctccgagctgaggacgagctagatttactacgtgctactcatatggactacatcaacaaactcccgtnttcggacctggaccaggtccaccgtcgtacgggcacgacccaaggcccaacccncgttnccacttcctcgtcccctacctcctacgaccttacgtactcgtacctggaaccgtcggctacgggaccacgggtctacg

SEQ ID NO: 179852 - DNA, 630 bp, Homo sapiens
  misc_feature: GYAE6OF02JFIA7.25.20.B09.1.454.CMB.1.raw
  modified_base (336)..(336): a, c, t, g, unknown or other
  misc_feature (336)..(336): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgctaggttattactttgtctctggtaccaacaacacccaggacaaacgccccaaaacttatactatttatgaggccaactaagccggcctcaggtagtttctaatcgcttctctcggctcaagtctggcagcacgcctcctgacatcnctggctccaggctgaggacgaggctagtattattactgtactactacatagtacgaacactataccaaactaaaccttcccggtactaccggtaccgttacgggacccagggttacccacccggttcgtaccggggtacgaccgacccgaaccggtaaccccaaaccctccgttgtacccaaccgtttccgttcccgttaccccacccgtttccctaaccgtcgttaaccgttactacggttacccttgggaaccggtccggggtaccgttacggaaccggacgggccgtaacg

SEQ ID NO: 179853 - DNA, 653 bp, Homo sapiens
  misc_feature: GYAE6OF02H6HK0.25.20.B09.1.454.CMB.1.raw
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgattgttgctaggttattactttgtctctagtaccaacaccaccaggacaaacgccccaaattntctaattatgaggaccataacgcgccctnaggtattctaatcgcttctctcgctcagtctgcagcacgtcctccctagactacttcctacgtcgggtcctaccgacggcgtaggaggtaccggacgggtcgtagtactttaacgttacgtcgtacttaacctctaaacgttagtaccgggtaactacgtaactacctaaaccgtaaaccgttccccgttacgttcccggtaacccggttcgggtaaccccggtacgggttacccgtacccgggtcccgttacggggacccgtaacccggaccccgtaccgggaacccctaaacccccggtacgtttaccgttaccccgtaaccctttccccgg

SEQ ID NO: 179854 - DNA, 372 bp, Homo sapiens
  misc_feature: GYAE6OF02IRJYT.25.20.B09.1.454.CMB.1.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (361)..(372): a, c, t, g, unknown or other
  misc_feature (361)..(372): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcctccaccaacgggcccatccggtcttcccccgtggcgccctgctccaggacgcacctccgagngcacacgcggccctgggctgcctggtcaaggctactccactgtacngtctgagcggntggcaggcncatagnnnnnnnnnnnn

SEQ ID NO: 179855 - DNA, 713 bp, Homo sapiens
  misc_feature: GYAE6OF02HSD20.25.20.B09.1.454.CMB.1.raw
  modified_base (210)..(210): a, c, t, g, unknown or other
  misc_feature (210)..(210): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttccngcactggactcagcactgatgttgctaggtttattactttgtctcctggtaccaacaacaccaggaccaaacgacccccaaacttactactaatttatgacggaccaactaacggccggccctcgaggtagtttactaatccgtcttctctcggtctacaagtctggcacgcaccggtccctcccgtcgaactaactccgtacgtcgggtcctcccgacgggtcgtaggaacgggtaccggagggtaccttaggtaactttaacgttactggttaccttacgttactaacgttagtacggaacctaacgtacttaaccgaaaccttaaaccgttcccccggttaccgtttacccggggtaacccgttacgggggtaacccgttacggggtcccgtaaccccgggttcccggttacggggtacccctaccggacccccggtaaacgggacccccctaaaaccccccggttacgttacccggttaccctaacccgtttcccccgg

SEQ ID NO: 179856 - DNA, 676 bp, Homo sapiens
  misc_feature: GYAE6OF02F8KAF.25.20.B09.1.454.CMB.1.raw
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagccggccctcgaggtacgtttactaactcgtcttctcgtcggtcctaccgaacgttcgtcggactacgccgaccggtccctcccgtagaacctaacgttcctacggtcgggtaccctaccgacggtcgtagggaacgggacggacggtcgtagtaatttaacgttacgtcgtaccttactactaagttagtcggaaccactaactaccaaactaaacccgttccccgttaccggttaccggtacccgttacgggacccgttacgggtacccgtacccggttcccggttacgggtaccacccggaaccccggaaccgggtacccccctaaacccccgtacgtcccggttacccgtacccgtttccccgg

SEQ ID NO: 179857 - DNA, 281 bp, Homo sapiens
  misc_feature: GYAE6OF02JFPEM.25.20.B09.1.454.CMB.1.raw
  modified_base (274)..(281): a, c, t, g, unknown or other
  misc_feature (274)..(281): n is a, c, g, or t
tcagactgtacagtcacgaccggtgctcgatttagtgtagtgtgaagggctggatgacttgggatggggagagagacccctcccctgggatcctgcagctccaggctgaggacgaggctgattattactgctactcatatggacacatcacaaatcccgtcttcggacctgggaccagggtcaccgtcctgggtcagcccaaggccaaccccactgtcactctgttcccgccctcctcactgtacagtctgagcgggctggcaaggcgcatagnnnnnnnn

SEQ ID NO: 179858 - DNA, 614 bp, Homo sapiens
  misc_feature: GYAE6OF02HKS7G.25.20.B09.1.454.CMB.1.raw
  modified_base (263)..(263): a, c, t, g, unknown or other
  misc_feature (263)..(263): n is a, c, g, or t
  modified_base (395)..(395): a, c, t, g, unknown or other
  misc_feature (395)..(395): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgctagttattactttgtctcctggtaccaanaacaccaggcaaacgacccctaaatatcattatgagccactaagccggccctacgaggtacgttctaactcgtcttctctggctccgaagttctaggcaagccaccggtcccttacccgtagaactacttcnccgtcgggtcctccgacggtctggacggtacggaggctagtaagtttattactgtactacgtactaatagtcgacactagtaccaactaaacttcccggtacttaccggaccgtacgggaccgtacgggtcccgtaaccggttcccgtacgggtaccctaccgggaccctaaccggggtaccccaaaccccgtaccgtacgtacccgtacctttcccgg

SEQ ID NO: 179859 - DNA, 548 bp, Homo sapiens
  misc_feature: GYAE6OF02IK6JI.25.20.B09.1.454.CMB.1.raw
  modified_base (345)..(345): a, c, t, g, unknown or other
  misc_feature (345)..(345): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgctaggttattactttgtctcctggtaccaacaacacccaggcaaacgcccccaaacttatacatttatgaggccaactaacggccggccctacaggtagtttctaatccgtcttctctggcctccaagtctggcagcacggcctcctgacatctcnggctcgagctggaggacgaggctgtattacttactgactactcatataggacacatcaactaaactcccgtcttcggactagtcgggaccagggtccaccgtccgtgggtacacgcccgaacgcccaacccatcgtcacctctacgttccccaccctcctcaccttcgtactcgttactcgacggtcgggctcggacgaggcg

SEQ ID NO: 179860 - DNA, 368 bp, Homo sapiens
  misc_feature: GYAE6OF02JWXKW.25.20.B09.1.454.CMB.1.raw
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (322)..(323): a, c, t, g, unknown or other
  misc_feature (322)..(323): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (338)..(339): a, c, t, g, unknown or other
  misc_feature (338)..(339): n is a, c, g, or t
  modified_base (341)..(342): a, c, t, g, unknown or other
  misc_feature (341)..(342): n is a, c, g, or t
  modified_base (344)..(345): a, c, t, g, unknown or other
  misc_feature (344)..(345): n is a, c, g, or t
  modified_base (347)..(368): a, c, t, g, unknown or other
  misc_feature (347)..(368): n is a, c, g, or t
tcagactgtacagtcacgaccggtgctcgatttagtgtagtgtgaagggctggatgacttgggatggggagagagacccgtcccctgggatcctgccagctccaggctgaggacgaggctgattatactgctactcatatggacacatcaccaaatcccgtacttcggacctgggaccagggtccaccgtcctgggtcacgcccaaggcccaaaccccacgtgtacccactactcgttcccccgcccttccgtccacttcgtaccacgtccttggaccgcgggtccgtggacgaacggccgacgtaacgtacggcncngtcnncncngcnacnctncnncnncnncnnnnnnnnnnnnnnnnnnnnnn

SEQ ID NO: 179861 - DNA, 603 bp, Homo sapiens
  misc_feature: GYAE6OF02GHBKG.25.20.B09.1.454.CMB.1.raw
  modified_base (209)..(209): a, c, t, g, unknown or other
  misc_feature (209)..(209): n is a, c, g, or t
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgctaggttattactttgtctcctggtaccaacaaccacccaggcaaaacgcccccaaaattactcattttatgaggccaacgtaacgccggccctnaggtacgtttactaatcgtcttctcgtggctacagtcgtggcagcacgcctccgnacaactcgtacgtcggtcctaccgaggtcgtaggaacggacggaggtctaggttatttacgttacctcgtacttactctagtagtcggaactacgactacaaccgtaacttcccgtacgttaccgaccgtcgggaccgacgggttcccgacggttccggtcggtaccgaccgacccgaaccggacccctaaccccgtacgtcgttacccgactttacccg

SEQ ID NO: 179862 - DNA, 384 bp, Homo sapiens
  misc_feature: GYAE6OF02HAVEU.25.20.B09.1.454.CMB.1.raw
  modified_base (370)..(384): a, c, t, g, unknown or other
  misc_feature (370)..(384): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttccccctggcgccctgctccagagcacctcgtgggggccacgagccggccctgggcctgccgtggtcaaggactaccttccactgtacacgttctgaggcgggctggcaaggcgcactagnnnnnnnnnnnnnnn

SEQ ID NO: 179863 - DNA, 589 bp, Homo sapiens
  misc_feature: GYAE6OF02IFSF6.25.20.B09.1.454.CMB.1.raw
  modified_base (210)..(210): a, c, t, g, unknown or other
  misc_feature (210)..(210): n is a, c, g, or t
  modified_base (322)..(322): a, c, t, g, unknown or other
  misc_feature (322)..(322): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccattttccngcactggactcagcactgatgttgctaggtttattactttgtctctggtaccaacaaccaccaggcaaacgccccaaacttactcatttatcgaggccactaagcggccctnagtacgtttctaatcgtcttctctgctcaagtctgcagcacgcctcctgacatctctcgggactccgaggctggaggtacgaggtctagatttactacgtgaccttctacattagtcggaactacacttaccaacgttaaaccttcccgtacgttcccggtaaccgtcgggaaccctacgggttcccaacccggttccggtcggggtaccaaccggtaccccaaacggccccgtaaccccgacgtaccgttacccgactttccccgg

SEQ ID NO: 179864 - DNA, 607 bp, Homo sapiens
  misc_feature: GYAE6OF02F1JIY.25.20.B09.1.454.CMB.1.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (445)..(445): a, c, t, g, unknown or other
  misc_feature (445)..(445): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgctaaggtttattactttgtctctggtaccaacaacaccaggcaaacgcccccaaattatctatttanagaggccactaagccggccctcaggtacgtttactaatcgtcttctctcgctaccaagtctggcagctaccgcctccctagactaatcctcgtcgggctccgaggtctaggacggacgacggctagtactttatactgactactnattatacggaacacgtactaccaactaaacgttccccgttacgttaccgggaaccgttcgggaacccgtcgggtacccgtacccgggttcccgtcggggtacctaaccggaccccgaaccggaccccaaaccccgttcgttaccgtacctacccgttacccg

SEQ ID NO: 179865 - DNA, 494 bp, Homo sapiens
  misc_feature: GYAE6OF02I2HTR.25.20.B09.1.454.CMB.1.raw
  modified_base (336)..(336): a, c, t, g, unknown or other
  misc_feature (336)..(336): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagcccccaaacttatcatttatgaggccactaagccggccctcaggagtttctaatcgcttctctggctccaagtctggcagcacggcctccctgacaatctcnggctcagctgaggacgagctgattatactgctactcatatgacacatcaacaactccgtcttcggacctggaccagggtcaccgtcnggtcagccagccaaccgctnacnctctcgtcccgcctctcnctgtacngtcngacgcggctggacaggcac

SEQ ID NO: 179866 - DNA, 571 bp, Homo sapiens
  misc_feature: GYAE6OF02H6AI2.25.20.B09.1.454.CMB.1.raw
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctccgtggtaccaacaacacccaggacaaacgccccaaattancatttangagccataagcgcctcagtatttacaatcgcttcnctgctacaagtctggcagcacgcctcctgacatctgtcggctccgagctaggacggacgagctagattacgttactgctactcaacttagtacggaccactatacaaacctaaacttccccgttacgttaccggaccgttacgggacccgaggggttccaaacccggttccgtcggggttaccaccggtaccccgaacgggaccccctaaacccgtaacgtcggttaccaccttcccg

SEQ ID NO: 179867 - DNA, 676 bp, Homo sapiens
  misc_feature: GYAE6OF02JCCF2.25.20.B09.1.454.CMB.1.raw
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaagccccaaaacttatcattatgaggccactaagcggcctcaggatttcaatcgcttctctggctcaagtctggcagcacggcctcctgacaatctctcggctccaggctgagggacgacggtctagtaatttaagttaacctggtaccttaactactaattaacgttggaacctaactaacgttaccaaacaaaaacgttccccggttactttaccgggacccgtttacggggaacccctaagggggttcccaaacccgggtttcccgttcggggtaccgaacggtaaccccgaaccgggtaacccccaaacccctaaacccgttcgttacccaccgttaccgttacccgtttaccccgaccccctttccgttacccaaccgttagtaaccgtaacgttccgtaacggtcggccgggtacctcgggtaccaaggggcctaaccg

SEQ ID NO: 179868 - DNA, 638 bp, Homo sapiens
  misc_feature: GYAE6OF02IK0F4.25.20.B09.1.454.CMB.1.raw
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
tcagactgtacagtcacgaccggtgctcgatttagtgtagtgtgaaggggggggtcacaagaggcagcgctctcgggacgtctccaaccgaagtggcctgggctctgctgctcctcactctcctcactcaggacacgagggtccgtcgggcccagtctgccgtgactcagcctgcctccgtgtctgggtctccgtggacagtcgatcacctattttcctgcactggacctcagcactgattgtgctagttattactttgtctctgtaccaacaacaccagacaacgaccccaaacttatctattanagacgcactagccgcctcgaggtntttactaatcgtctctctgctacaagtcgtagcagcaccggcctccgtgacctatctcgtcggcctccgaggtcgtaggaaggacggagtacgtagttatttacttacgtcgtaccttactctaagtagtacgtaacactacgtaaccacgttaaacccttcccgttaccggttacccgtacccggttacgggtacccgtaaccggggtacccgtacccggttacccggtaccgggtaccgacccggaacccgtaacccggaacccccgtaaccccctaccggttaccgttaccctaccgttaccccg

SEQ ID NO: 179869 - DNA, 547 bp, Homo sapiens
  misc_feature: GYAE6OF02FJU2M.25.20.B09.1.454.CMB.1.raw
  modified_base (233)..(233): a, c, t, g, unknown or other
  misc_feature (233)..(233): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttncaggttattactttgtctctggtaccaacaacacccaggtcaaaacgccccctaaaacttntacattttangagccaactaagccggccctcacggtagtttcctaatcgcttctctgctcaagtcgngcagcacggcctccagacatcctacgtcgggctcaggtctaggaggacgagctgtattattacngactactctatatgactanactacaactaaactcccgttacgttccggaccgtgggaccaggggtcctacccgtcgttacgggcacgaccgaacggcccaaacccgtgtcgtacaccttccg

SEQ ID NO: 179870 - DNA, 572 bp, Homo sapiens
  misc_feature: GYAE6OF02IZDQF.25.20.B09.1.454.CMB.1.raw
  modified_base (393)..(393): a, c, t, g, unknown or other
  misc_feature (393)..(393): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgattgttgctaggttattactttgtctcctgtaccaacacaccagacaacgccccaaattatctattatgacgcaactagccgccctagagtagttctaatcgtcttctctgctacagtcgtgcagcacgtccctccgtagactactctcgtcggtcctcgacggntaggacggacggaggtctagtaatttacttcgtcaccttacactagtacgtacgaaccactactaccaactaaccgttcccgttacgtccggtaccgtacgggaccgtacggtcccgtaccggtccgtacggtccaccggacccgaacgccccaacccgtgtacgtcctaccgttcccg

SEQ ID NO: 179871 - DNA, 647 bp, Homo sapiens
  misc_feature: GYAE6OF02JACHV.25.20.B09.1.454.CMB.1.raw
  modified_base (326)..(326): a, c, t, g, unknown or other
  misc_feature (326)..(326): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacacccaggcaaacgcccccaaattatcatttatgaggccactaagccggccctcaggtatttctaatcgcttctctggctccaagtctggcagcgacgcctcccngacaatctcgtggctccgagtctggagacgaggctgtatttacttactgaccttactcgatagtggaaccactactacaactaaacttcccgttaccttaccggaccgttcgggaacccgtacgggttaccgtacccgtccgtcgggtaccaccggaccccgaaacggtcccccaaaccccgtcgttccgtaccctaacccgttccgttacccgttacccccgacccctttccctaccgttaaccgttaccggtaacctaccggtttcgtaccggtacgggtcccgggtccgttaccgggacgtaccgggtaccgtaccgg

SEQ ID NO: 179872 - DNA, 691 bp, Homo sapiens
  misc_feature: GYAE6OF02IU6I4.25.20.B09.1.454.CMB.1.raw
  modified_base (206)..(206): a, c, t, g, unknown or other
  misc_feature (206)..(206): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
tcagactgtacagtcacgaccggtgctcgatttagtgtagtgtgaagggaccggattcgccgtctccagagacaactccaagaacacggtgtttctgcaactgaacggcctgagaaatgtggacacggctgtatattactgtgcgcgatttctctccctgcttagcccactctacaactgtctcatctgacgtctgggccaggganccctaggtcaccgtctccgtcgacgccttccaacctaacgggcccctagttccggtcctttcccccgtcgccgccctcgctaccgaggacgccacctcgtcggggaccacgtacggccggtcccgtagggtccgtcgtacccggttacgggtaccgaacgggacctttacccgtttaccgtaaccgttaacgttaacgttcggttaccgttacggaacggtccgggtaccgttacgggaaccgaacgggtaccgaccgtttaacgtaacgaccgtnacgtacgtacngtactacgtacgtacacgactacgtacgtactacgtactacgtcgtacgtaacgtaacgtacgtacgacgaccgtcgtacgacgacgtacgacgtacgtacgtacgtatacgtacgtacgtcgtacgtacgtcgtacgtacgtacgtaccgtacgtacgtacgtacgtacgtacgtcgtacggtcgtacggtacgtcg

SEQ ID NO: 179873 - DNA, 636 bp, Homo sapiens
  misc_feature: GYAE6OF02F3QKC.25.20.B09.1.454.CMB.1.raw
  modified_base (299)..(299): a, c, t, g, unknown or other
  misc_feature (299)..(299): n is a, c, g, or t
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgattgttgctaggttattactttgtctctgtaccaacaacaccagcaaacgaccccaacttactctatttangacggaccacgtaagccggccctcgaggtagtttactaagtcgtcttctcgtaggcctaccgaagtctggcagcgacgcccttccngacatctcgtcggcctcgaggctgacggacgnggtactgtaattattaccgtgtaccttactactacttagtaggaacctactaacgtacctaaacgtaaccgttccccgttaccgttaccgggacccgttacggggacccgtacggggtaccctaaccggttacccggtcggggtaacccaaccgggtaccccggaaccggtacccccaaacccccgtaccggttaccggtacccttacccttaccccgg

SEQ ID NO: 179874 - DNA, 763 bp, Homo sapiens
  misc_feature: GYAE6OF02F4P28.25.20.B09.1.454.CMB.1.raw
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (334)..(334): a, c, t, g, unknown or other
  misc_feature (334)..(334): n is a, c, g, or t
tcagactgtacagtcacgaccggtgctcgatttagtgtagtgtgaagggggggtcgacgaagaggcagcgctctcgggacgtctccaccatggcctgggctctgctgctcctcactctcctcactcaggacacacgggtcctcgggacccagtctcgccgtgactcagcctgcctcgngtctggtctccnggacagtcgatcacctatttccngcactggactcagcctactgattgttcgctaggtttattacgtttgtcttcgttacggtaacctaactaaaccacccaggactaaaccgacccccctaaaactttactacttactttaacncggtaacggacccaacgtaaacgtccggtacccctacgtaagggttaacttttaccgaaacgttccgtactttaccttcgtagggttcccttaccgtaacggttccgttacgggacctaggacccctaacgggtcccctcccttacggaacctaacgtcgttcgtcggtcctaccgtaacgcgttacgacgggaccgaggtactacgttaacgttacttaacgttcgtaccgtacttaccgtaagttacgtacggtaactacgtaacttacctaaaccgtaaaccgttcccgttaccgttaccgggttaaacccgttccggggtaaccgttacgggtacccggtaacccgttcggtccgggtttaccgaccggttaacccgaccgttacccgaaaccccttggtaccctttacggaaccctttccccgg

SEQ ID NO: 179875 - DNA, 588 bp, Homo sapiens
  misc_feature: GYAE6OF02JZZPU.25.20.B09.1.454.CMB.1.raw
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (461)..(461): a, c, t, g, unknown or other
  misc_feature (461)..(461): n is a, c, g, or t
tcagactgtacagtcacgaccggtgctcgatttagtgtagtgtgaaggggggtcgacgaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttccngcacttggactcagccactgactgttgctaggttattacttgtctctggtaccaatacnccagcaagcccctaatgtcatttngagccactaagcgccctagagtagtttcaatcgcttcncgttcgcttacagttctaggccagcgacgccgtccctgactaatcctacgcggtacctcgacggtctagacggtaccggagcctagacgtttactacgtcgacctactcagttacgaggtaacctactanacgaaccttaaacgtcccgttacgttaccgaccgttggaacctcgggtaccctccggttaccgtaggttacccgaccgacccgtaacgtccccggaacccctacgtacgtttacccaaccgtttccg

SEQ ID NO: 179876 - DNA, 562 bp, Homo sapiens
  misc_feature: GYAE6OF02GD0JK.25.20.B09.1.454.CMB.1.raw
  modified_base (326)..(326): a, c, t, g, unknown or other
  misc_feature (326)..(326): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctggtctcctggacagtcgatcacctatttcctgcactggactcagcactgatgttgctaggtttattactttgtctcctggtaccaacaaccacccaggacaaacgcccccaaacttactctatttatgacgccactaagccggccctnaggtatttctaattccgacttctctggcctcaagtctgcagcacggcctcccngacatctcgtggctcgngctggagacgagctgtattatactgtactactacatagtcgacacatacaactaactcccgttcgtacgtaccgtcgggaccgtacggtccgtacccggttccgtacgggtccgacgtaccccgaaccggacccaaacccccgtactcggttaccacgtttccccg

SEQ ID NO: 179877 - DNA, 756 bp, Homo sapiens
  misc_feature: GYAE6OF02JJXAB.25.20.B09.1.454.CMB.1.raw
  modified_base (159)..(159): a, c, t, g, unknown or other
  misc_feature (159)..(159): n is a, c, g, or t
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
tcagactgtacagtcacgaccggtgctcgatttagtgtagtgtgaagggggggtcgacgaagaggcagcgctctcgggacgtctccaccatggcctgggctctgctgctcctcactctcctcactcacggacacaggtcctgggcccagtctgaccgtnactcacgcctcgcctccgtgtcctgggtctccgtgacagtccgatccaccgtattttccngcactggacttcgagcactgtatggttncgtaggttacttacttttgtacttccgtcggtaaccctaacgaacctaacccaggacctaaaccgaccccccaaaagtttacctactaattttaacacggaacggtacctaactaacggccgtaccctacgaaggtacgtttacctaagtcgtccttccgtgtcgtaccttaccgagttcgtacggtcacggtaccgtaccgggcccttacccgtaggtaaccacgttcctcgtaccgggtccttaccgaggtaccgttggaacggacccggtggtaccgttagtaacgtttactacgttcgtacgttaaccttacgtactagtacgtaccgaataacgtcctaaactaaccgttcccgttaccggtttacccgaacggttaccgggtaccgtaacgggtccccgttaaacccgggttccgttaccggggtacctaacccggttaacccgaacccggtacccccctaaacccgttcccggtaaccggtaccttaccccggtttaacccg

SEQ ID NO: 179878 - DNA, 672 bp, Homo sapiens
  misc_feature: GYAE6OF02IFX0V.25.20.B09.1.454.CMB.1.raw
  modified_base (232)..(232): a, c, t, g, unknown or other
  misc_feature (232)..(232): n is a, c, g, or t
  modified_base (319)..(319): a, c, t, g, unknown or other
  misc_feature (319)..(319): n is a, c, g, or t
tcagactgtacagtcacgaccggtgctcgatttagtgtagtgtgaagggggggtcacaagaggcagcgctctcgggacgtctccaccatggcctgggctctgctgctctcactctcctcactcaggacacagagtcctgggcccagtctgccgtgactcagcctgcctccgtgtctgggtctcctggacagtcgatcacctatttcctgcacgtggactcagcactgatgtnctaggttattactttgtctctgtaccaacaaccaccagcaacgaccccaaacttactacattactgaggtacactaacgccgccctnaggtagttctaatctcgttctctcggtctacctaagtcgtcggtacacgcgtaccgcccttcccgtagaccaactccgttaccgtacgggtcccttaccggacgggtaccgtacgggtacggaaccgggtacggttcgtaggttaaccgtttaatttaacccttggtacttaccttccgaattgtacggacctaacgacttactaaaccgtaaacctttcccggttaccgttccgggtaaccgttacgggaacccgttaccggggtcctaccccggttacggttaccggggtaccgtacccgggtacccgaaccgggtacccccaacccccgtacgtccgtacccgttacccg

SEQ ID NO: 179879 - DNA, 698 bp, Homo sapiens
  misc_feature: GYAE6OF02H23SB.25.20.B09.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
tcagactgtacagtcacgaccggtgctcgatttagtgtagtgtgaaggggggggtcacaagaggcagcgctctcgggacgtctccaccatggcctgggctctgctgctcctcaccctcctcactcagggcacagggtcctgggcccagtctgccctgactcagcctgcctccgtgtctgggacctcctggacagtccggtcaccatcctcctgcactaggaacccngccgtgactagttggtncttaataacttatcgtctcctcggtacccaacaaccacccacggaccaacggacccccaaactcatactatttangatcgtcagtcacgtccggtccctcgtggttacgtttcgtcggttcgtctttctcgtcggtcctccagtctcggaccaaccgtccggtccctcccgtacgacctacgttaccggtccggggtcctaccgacggtcgtacggaacgggacgacggtacctttacgtttattacgttcgtcttaacttttcaacgttacaagtaacgtaacctaaccgtaaacgtacgttacgttacgggttacggttaccggggacgggtaacgggtaccgtaacggtttaccgtacccggttccggttccgggtaccaccggtacccgtaaccggtccgttcccgtacccccggttcggttaccctaccgttccgttcccggttcccccg

SEQ ID NO: 179880 - DNA, 874 bp, Homo sapiens
  misc_feature: GYAE6OF02G69Q4.25.20.B09.1.454.CMB.1.raw
tcagactgtacagtcacgaccggtgctcgatttagtgtagtgtgaagggggggtcacaagaggcagcgctctcgggacgtctccaccatggcctgggctctgctgctcctcactctcctcactcaggacacgaggtcctggcccagtctgccgtgactcagcctgcctccgtgtcgtggtctccgtggacagtcgatcacctactttcctgcacgtggacctcgacgctacgtagtagttggttagaccgtaaggttttaacttttaccgtttttcggttcctttcccggttacggttaaaacccctaaaccgtaaacccgaaccccgtaagggtaaccccaaaacccggtaaccccccctaaaaacttttacgtaccgttaactttttagacgggtaaccgtaccctaaacgttaaccggcccggtaccccttaacgaacggggtttaacttttaaccgttaaccgttccggttacctttccttaccggtacggtacccttaaccggtaaacgtttcccgtaacgggaccctacggtacccgtaacccggtcccccttacccgtaaggtaacccttaacgttccgttccggttacgggtcccttaaccggcggttaccgtacggggaaccgtaacgggtaacggtcgttaacggttaactttaacgttaccgttacgtaccttaactacggtattaaccggtacgaaccgttaccaacttaacccgaaacttaaccgttccccgttacggtaacccggtacggttaccgggaaccgttcggtacccgtaaccggttccggtaacgcccggttaaccggaaccgtaacccgtaaccccgtaacccttaacggccgttaccctaaccgttccccg

SEQ ID NO: 179881 - DNA, 761 bp, Homo sapiens
  misc_feature: GYAE6OF02ICM3E.25.20.B09.1.454.CMB.1.raw
  modified_base (264)..(264): a, c, t, g, unknown or other
  misc_feature (264)..(264): n is a, c, g, or t
tcagactgtacagtcacgaccggtgctcgatttagtgtagtgtgaagggctggatgacttgggatggggagagagacccctccctgggatcctgcagctccaggctcccgtgactcagcctgcctccgtgtctgggtctcctggacaggtcgatcacctatttcctgcactggactcagcactgattgttgctaaggtttatttacgtttgtccttccgtaggtaaccaacaaccaccaaggacaaaccgaccccaaattactntacttatgacgacctacgtaacggcgccctacgaggtagtttactaacgttcgtacttctcgtcgctaccgaacgtcgtgcgacgacgaccggtcctccgtagactaactctcgtcggcctccgacggcgtaggacggtacggacggtcgttagtaactttacgttacgttcgtacgttacttacgtaattacgtacggtaactaactactaactaaaccttaaaccgttcccggttaccgttaccgggttaaccggtaccgggtaccgtaacgggtacccgtacccggttaccggtcgggtaaccgtaacccggaacccggtaacccggtaccccgtaaaccccgtacgttacccggtaccctaaccgtttcccgttacccgtttaccccctaccccgtttcccgttaacccgttaccggttaaccgttaccgacccggtttacggtcggtaaccgggtccgggtacgttaccgggacggtaccgggcgtaaccgg

SEQ ID NO: 179882 - DNA, 730 bp, Homo sapiens
  misc_feature: GYAE6OF02J3HMC.25.20.B09.1.454.CMB.1.raw
  modified_base (208)..(208): a, c, t, g, unknown or other
  misc_feature (208)..(208): n is a, c, g, or t
tcagactgtacagtcacgaccggtgctcgatttagtgtagtgtgaagggggggtcacaagaggcagcgctctcgggacgtctccaccatggcctgggctctgctgctcctcactctcctcactcaggacacgagggtcctgggcccagtctcgccctgactcagcctgcctcgtgtctggtctccgtggacagtcgatccacatctcngcacgtgaactcaccgatgatgttcgcttatttcatcgtaccttgtctcgtacgtaacccaacaaccaccccgaactaacccgacccctaaagtcacgttagtaactttagacggacgactaacggtacgcccggtaccctggttacgggttcagccgttcgtccttcgtcgtcgtaccgtactaggttcctacggtacctaaccggtcccgtacccctccgtacgaacctccggtccgttccggggacctaccggtaacggtaccggttaggaccgggtaaccggtacggttaaccttaacgttttacgttaacgttaccgtaacgtttaccttactaacgttaccgaaggtaaccaacccgtaaccgtaacgttacggtaccgtttagggtccggttacgggaccgggtaccgtaaacgttcgttaccggtacccgtccggttacgaccgtaacccggtacccgtaagtcccgtaacccggtccccgttaccgacccggtttcctacccgtttcccccgg

SEQ ID NO: 179883 - DNA, 246 bp, Homo sapiens
  misc_feature: GYAE6OF02IBK12.25.20.B09.1.454.CMB.1.raw
  modified_base (241)..(246): a, c, t, g, unknown or other
  misc_feature (241)..(246): n is a, c, g, or t
tcagactgtacagtcacgaccggtgctcgatttagtgtagtgtgaaggggcgacagcagatggtggagcaagtgactggggccagggaaccctggtaaccgtctcctcaccttccacaaggccatcggtcttcccctggcgccctgctccaggagcacctcgtgggggcacagcggccctgggctgcctggtcaaggactacttccactgtacagtctgagcgggctggcaggcgcatagnnnnnn

SEQ ID NO: 179884 - DNA, 577 bp, Homo sapiens
  misc_feature: GYAE6OF02IZYF7.25.20.B09.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttccngcactggactcagcactgatgtgctagttattacttgtctctaggtaccaacaacaccgaggacaacgaccccaaattactactattangacgaccacgtaacgccgcctacgaggtattactaatcgtcttctctcggctacgaagtcgtgacagccacggtccctaccgtcgactaactctacgtcggctaccgacggtcgtaggacgacgaggtctagtacttattacgtgtaccttctcacgtacgtcgtacggactacgtagtccgttaggttcgggttacgttcggatacggacggtaacctaggtccgtacgtccgtcggtacacggtaccgacgccgtccgccccgttcgaccttaccg

SEQ ID NO: 179885 - DNA, 680 bp, Homo sapiens
  misc_feature: GYAE6OF02HMJZT.25.20.B09.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (359)..(359): a, c, t, g, unknown or other
  misc_feature (359)..(359): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctcgtgtctggtctcctggacagtcgatcacntttccngcactgactnagcactgatgttgcaggtttattactttgtctcctggtaccaacaaccaccaggacaaacgcccctaaagttatcatttatgtacgaccactaacgcgtcctcaggtagtttcaattcgacttctcgtcgtcctcgtaagtcnggtactacggcaaccgggtccttacccgtgaactaacgtcctttacgtacgggtacccttacccggaggtccgttacgggaacgggtaacggtaacgggtcccttaggtaacgttttaacgttaactcggtaccttacttacaacgttacgtccggaactaccacgtaccaaccgttaaacttcccggtaccgtttaccgaaccgggttcggaacccgtacgggtacccgtacccggttacccgtcggggttaccaacccggacccgtaaccggaccccgtaaaccccgttaccggtacgttacccgtacccgttacccgg

SEQ ID NO: 179886 - DNA, 626 bp, Homo sapiens
  misc_feature: GYAE6OF02H1E4L.25.20.B09.1.454.CMB.1.raw
tcagactgtacagtcacgaccggtgctcgatttagtgtagtgtgaagggctggatgacttgggatgggggagagagacccctcccctgggatcctgcagctccaggctcccgtgactcagcctgcctccgtgtctgggtctcctggacagtcgatcaccatttcctgcactggactcagcactgatgttgctaggttattactttgtctcctaggtaccaacaaccacccaggacaaacgaccccaaattatctatttatgaggccacttaaacgcgccctcaggtagtttctaatcgcttctctggctccaagtctggcagccacggccctccctagacctaatcctcgtcggctccgaggtctaggaggacggaggctagtaattacttacgtgtactacttcaattagtcggaacactataccgaaactaaacttcccgttaccgttacgaccgttacgggacccgtacgggtacctacccgttccggtcgggttaccaccggaccccgaacggaccccaacccctacgttcgtaccaccgttccgtaccttccccacccttcctacctaccgttccgtactcgtactggacggtccggtcgtacggacgtacggccgtaacg

SEQ ID NO: 179887 - DNA, 744 bp, Homo sapiens
  misc_feature: GYAE6OF02FT6GD.25.20.B09.1.454.CMB.1.raw
  modified_base (318)..(318): a, c, t, g, unknown or other
  misc_feature (318)..(318): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatcacctatttcctgcctactggaacctcagcacgtgattgttgctaggttatttactttgtctccgtaggtaccaaacaaccacccagaccaaaccgccccctaaattactactatttanagagacctaacgtaacgccggccctacgaggttagtttctaatcgtctttctctcggtcctaccgtaaggtccgtacggtcgacgcccgtaacccgggtccccttacccgtacgaacctaacgtttcccgttaccggtcgggtacccgttaccgtacggggtcttaacggggaaccgggaaccgggtacgggtacttaagggtttaaacttttacgtttaccggttacgtaccttaccgtactaaacttacggttaacgaacctacgtaactaaccctaaacgtaaacccgttcccgttacgttaccgggtaccgtaccggggtaccgtaccgggtaccgtaacccggttcgtacgggtaccgaacccgaaccccggaaccggtaccccctaaacccgtcgttaccgtacccttaccgtttccccg

SEQ ID NO: 179888 - DNA, 754 bp, Homo sapiens
  misc_feature: GYAE6OF02GLZCI.25.20.B09.1.454.CMB.1.raw
  modified_base (212)..(212): a, c, t, g, unknown or other
  misc_feature (212)..(212): n is a, c, g, or t
tcagactgtacagtcacgaccggtgctcgatttagtgtagtgtgaagggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatcacctatttccngcactggactcagcactgatgttgctaggtttattactttgtcttcctggtaccaacaaccacccgaggaccaaaccgtacccccctaaattactactaatttagtacggacggaccaacgtaacggccgggtacccctacgaggtacgttttactaagttccgtactttcctcgtcggtaccttacccgaagttccgtaggtcacggtaccgaccggtcccttacccgtagaacctaacttccgtaccgtcgggtacctaccggagggtccgtagggaacgggaccgggtacggtcgtagtaacttttaacgttaccgtcgtacctttactacttaattacggtacggtaacctaccgtacttaaccgtaaccttaaaccgttccccgtttaccgttaccgggtaacccgtacggggtacccgtaccggggttaccctcccgggtttacccggtacggggtacccgaaccggtccccggtaaacccggacccccttaaacccccggtccgttaccggttaccctacccgtttttaccccgg

SEQ ID NO: 179889 - DNA, 735 bp, Homo sapiens
  misc_feature: GYAE6OF02JQQXE.25.20.B09.1.454.CMB.1.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
tcagactgtacagtcacgaccggtgctcgatttagtgtagtgtgaagggggggggtcacaagaggcagcgctctcgggacgtctccaccatggcctgggctctgctgttcctcaccctcctcactcagggcacgagggtcctgggcccagtctgccctgactcagcctgcctccgtgtctgggacctccgtggacagtcggtcaccatcctcctncctactaggaaccaggcccgtgactagttcgggtntccttaataacttntcgttccttcctcggtacccaacaaccacccgacggaccaaccggacccctaactacactactatttactgatcgtacagtcactccggtcctcgtggtacgttctggtctcttcgtctcgtctactacgtcgtacgcgtacgtccgcccttacacgtaccgtacgtccggtaccgggtccgtccgacggtccgtacgggacggtacggtacggtccgtttaacttacgtttacgttcgtaccgtttactttacgtaaacgttacctaacggaacccgttaacccgaaaccttaaccgtaggtttaccgggttagggtttaccgggtcgggggtaaccgggtaccggtaaacggtacgggttaccgttaccggtaccggttaccgggacctaccgggaacccgtaacggtcccgtacccggtaccccgtcggtacccgtacgtttcccgttacccgttccccttaaccccg

SEQ ID NO: 179890 - DNA, 619 bp, Homo sapiens
  misc_feature: GYAE6OF02FOH2T.25.20.B09.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (444)..(444): a, c, t, g, unknown or other
  misc_feature (444)..(444): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcacgcctgcctcgtgtcgtggtctcgngacacgtcactacactacttcngctagtcgactcgacacatagntgtnacgttagtttactttgttctcctcgtacgtaaccaacaccaccgacgaaccaaccctaccctaattactacttaagttagacgggtaccacctaacgtacgcccgtacctagtaggttactttactactctcttcgcgtcgactacgtacgttcgacgtacacgaccgtaccgtccctacgctaactacgtccgtcgtacggctacggngtacggtagaacgtacgcgtagtagttaactttacncgctactactatanacgtacaactntacaactaacttcccgttcgtaaccgtgaccgtacggtcccgtagtccccgcgttccggacgtacccaccggtacaccccgaccctaccttgtaccgtaccgttccttacccgg

SEQ ID NO: 179891 - DNA, 467 bp, Homo sapiens
  misc_feature: GYAE6OF02JULZG.25.20.B09.1.454.CMB.1.raw
  modified_base (440)..(440): a, c, t, g, unknown or other
  misc_feature (440)..(440): n is a, c, g, or t
  modified_base (443)..(467): a, c, t, g, unknown or other
  misc_feature (443)..(467): n is a, c, g, or t
tcagactgtacagtcacgaccggtgctcgatttagtgtagtgtgaagggccgattcgccgtctccagagacaactccaagaacacggtgtttctgcaactgaacggcctgagaaatgtggacacggctgtatattactgtgcgcgatttctctccctcgctcgcccactctacaactgtctcatctgacgtcgtgggccagggcgtcccgtggtccacccgtcctccctacgacgccttacccgaccgaacggccctacgtccggttccccttcccccgtcggcccgtccccgtcggcctaccgacggacgcccgtacctcggtcgggggcaccgcggcccggcctcggggcctcgccgtcggtacgaacggtacctaccttaccacgtcgtactacgtcgtgacggccggcggtacggacggtaacggccgacgtaagntgnnnnnnnnnnnnnnnnnnnnnnnnn

SEQ ID NO: 179892 - DNA, 702 bp, Homo sapiens
  misc_feature: GYAE6OF02F9NKA.25.20.B09.1.454.CMB.1.raw
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (320)..(320): a, c, t, g, unknown or other
  misc_feature (320)..(320): n is a, c, g, or t
tcagactgtacagtcacgaccggtgctcgatttagtgtagtgtgaagggctggatgacttgggatggggagagagaccccctcccctgggatcctgcagctccaggctcccgtgactcagcctgcctccgtgtctgggtctcctggacagtcgatcacctatttcctgcactggactcagcactgatgttgctagttattacttgtctctgtaccaacaacaccagacaacgccccaatntactattntgacgccactaagcgcctgagtagttctaactcgtcttctctcgcctacgagtctggcagcgaccgcctccngactactctcgcggtcctcgaggtcgtagaggaccggaggtctagtaatttaacttacgtagtaccttaactactaatacgtaggtaaccaacgtaactacctaaaacctaaacccgttaccccgttccgttacccgggtaacccggttacgggtaacccggtaccgggttcccgtaaccccggttcccggtttaccggggtaccgtaaccggtaaccccgaacccggtaacccctaaacccccgtacgttaccgttacccgtacccttacccgttcccgttacccccgtaccccttcccgtaacctaacccgttaccttaaccgtaccgttaccgtacggtacggtccgggtaccggccgggtaacgaacggtccgtaacg

SEQ ID NO: 179893 - DNA, 881 bp, Homo sapiens
  misc_feature: GYAE6OF02J0MSA.25.20.B09.1.454.CMB.1.raw
  modified_base (817)..(817): a, c, t, g, unknown or other
  misc_feature (817)..(817): n is a, c, g, or t
tcagactgtacagtcacgaccggtgctcgatttagtgtagtgtgaagggctggatgacttgggatggggagagagaccccctcccctgggatcctgcagctccaggctcccgtgactcagcctgcctccgtgtctgggtctcctggacagtcgatcacctattcctgcactggactcagcactgatgttgataggtttacttacttttcgtcttccgtaggtaacccaaacgtaaccaccgaagggaccaaaacccggacccccctaaaattttctaacttaacgttttaacgtcggacggggtacccaaaccgttaaccggccggtacccgtacgtaagggtaaccgttttacttaaacttccggttcctttaccgtccgttacgggaccttaacccgaacgtttccggtacggaccgacggtacccggtaaccgggttccccctacccctagggtaaccctaacgttccgtaccggttcgggggtacccgtaccgggtaacggtccgggttaacgggaaccggggaacccggttacgggtacgttaagggtttaacgtttttaacgttaacccgtttcggtaccgtttacccgttagtaacgtttagaccggggtaacctaacctaacttaacccgaaactttaaaccggttccccgggtttaaccggttcccgggtaaccggttccgggaaaccgggttaccgggtttacccgaacccgggttccggtacggggttaccgaacccggtacccgaacccggtaaccccgtaaaccccgtcgttaccgtacctaccgttaccgtacccgttccccnccgttactacccgtacgttcgtcacgttcgcggtacgccggtacggtacgtacggcgggctacg

SEQ ID NO: 179894 - DNA, 747 bp, Homo sapiens
  misc_feature: GYAE6OF02IIEAE.25.20.B09.1.454.CMB.1.raw
  modified_base (165)..(165): a, c, t, g, unknown or other
  misc_feature (165)..(165): n is a, c, g, or t
  modified_base (270)..(270): a, c, t, g, unknown or other
  misc_feature (270)..(270): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggcagtcgatcacctatttccngcactggactcagcactgattgttcgactaggttatttacgtttcgtctccgtggtaacccaacaaccaccaggaccaaaccgccccctaaattatcgtaatttnacggacggccaacttaacggccgtcccctacgagggttactttacgtaacgttccgtcttctccgtcgggaccttaccgaaggttcgtacggcacggccgtaccggtcccttcccgtacgtaaccgaattccgttaccgtcgggtaccgtacccgaacgggtcgttacgggaacgggtaaccggtaacggttcgttaacgttaacttttaccgttaaacgtccggtaaccgtttactacgtaacttacgtacgggaaacctaactaacgtacccgtaactaacccgttcccgttacggttaccccggacgttaccgggacccgtacgggtacctcccggttcgtcggtacaccgtaacccggacgtaccccgaaccgtcctcgtacctccgttaccgtccgtccccgcccttccgtaccgtcttaccgtaatccggtcgaccggtcggtcggttccgacggtcggacggccgtaacg

SEQ ID NO: 179895 - DNA, 786 bp, Homo sapiens
  misc_feature: GYAE6OF02I9K3S.25.20.B09.1.454.CMB.1.raw
  modified_base (191)..(191): a, c, t, g, unknown or other
  misc_feature (191)..(191): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctcgtgtcgtggtctcgaggacngtcatccacctactttccgtgctacgtcgtactcgacgacactgtagttggtgacgttaaggtttactttacgtttcgtcctccgtacggtaaccaaaccaaccaacccggacgtaaccaaaacccgtacccccttaaaatttcgtaacttatttacgtacggtacgaccctaaacgaacggcccgtacccgtaacgaaggtttacttacctaacgtcctacgttccgtcgtacgtccctaacgtaccggttcgtcgaccgtacgaaccggtcccgttcccttccggaacgtaacctttacgttcccgttacggtcccgggtacctaccggtacggttacggtacgggaacgggtacggtacggtacgttacgtttaactttacgttaacgtcgttacctaacgtactaaggttaccacgtaccgactacgtaacctaacgttaaccgttcccgttacggttacccgtaaccggttccgggaacgttacccgtaccggttaacccgggttcggttaccggacccggaaccccgtacccggaaacccggtccccctaacccggtacgttaccccggttactacccggtttaccccg

SEQ ID NO: 179896 - DNA, 689 bp, Homo sapiens
  misc_feature: GYAE6OF02I9S8Q.25.20.B09.1.454.CMB.1.raw
  modified_base (186)..(186): a, c, t, g, unknown or other
  misc_feature (186)..(186): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctcgtgtctgggtctccnggacagtcgatcacctatttccgcactggacctcagccacgtgattcgttgctaggtttactttactttgtcctcgtaggtaccaaccaacacccaggacaaacgaccccctaaacttactactactttatgtacggaccaactaacggccggccctacgaggtagtttacctaactccgtcttctcgtcgtcctacgtactcgtcggcacgacgaccggtcctccctagaccaattcctaccgtcgggtcctccgtacggctacggtagggaacggcgggtacctaggtactttaacgttaccgttacggtccttaacgtacttaacgttacgggttacggaaacccttaccgtaacttaaccaaaccgttaaacccgtttcccgttacccggttaacccggtccggtacgggtacccgtaacgggtcccgtacccggttaccgcgggtaccaccggtacccaaccgggtaccccaaacccgtcgtacgtccgaccttcccg

SEQ ID NO: 179897 - DNA, 811 bp, Homo sapiens
  misc_feature: GYAE6OF02GWRUQ.25.20.B09.1.454.CMB.1.raw
  modified_base (450)..(450): a, c, t, g, unknown or other
  misc_feature (450)..(450): n is a, c, g, or t
tcagactgtacagtcacgaccggtgctcgatttagtgtagtgtgaagggctggatgacttgggatggggagagagacccctccctgggatcctgcagctcaggctcccgtgactcatcctgcctccgtgtctgggtcctccgtggacagtcgatcacctatttcctgcactggacctcagcactgattgttgcgtaggtttactttactttgtcttccgtacgtaacccaacaacccacccgacggaaccaaaccgacccccgtaaattactactatttacgtgacgacctaactacggccggtcctcgtacggttagtttactacgtccgttcttcttccgtcggtcctaccgtagtaccggtcggaccacgaccggtacccggtccctacccgtagtaactactccttcggtccggtcctccgaaggctagggaccggacgacgggtnttagtaacgtttacttacgtcgtacctttacgtactataacggtcaaccttaacactaaccgtaaccgtaaacccgttcccggttaccgtaccgggtccggttaaccggacccgggttacccgggtccgttacccgggtacggtttacccggaccgtaacccggtaacccccggaacccggttaaacccctccccggttacgttaacccttaacccgttcccgtttaacccgttacccccggtttaacccctacccccgtttaccgtaaccccgtccggttttaacgaccccgttaacggttacccgggtagggtcccgggtacgggttccccggtaaggaccccgggttacgtaccgacg

SEQ ID NO: 179898 - DNA, 692 bp, Homo sapiens
  misc_feature: GYAE6OF02F87CL.25.20.B09.1.454.CMB.1.raw
  modified_base (220)..(220): a, c, t, g, unknown or other
  misc_feature (220)..(220): n is a, c, g, or t
  modified_base (509)..(509): a, c, t, g, unknown or other
  misc_feature (509)..(509): n is a, c, g, or t
  modified_base (536)..(536): a, c, t, g, unknown or other
  misc_feature (536)..(536): n is a, c, g, or t
tcagactgtacagtcacgaccggtgctcgatttagtgtagtgtgaaggggggggtcacaagaggcagcgctctcgggacgtctccaccatcggcctgggctctgctgctcctcactctcctcactcaggacacgagggtcctgggcccagtctcgcccgtgaacctcagcctgccctccgtgtcctgggtcctccgtgacgagtcgatcacctatttccngcacgtggactcagctactggtattgttgactaggttttaactttcgttctcgttaccgtcggttaaccaaaacctacccgtaaccccgtagaaccgtaaaacccgacccccctaaaactttctaaccttagttttacgacggtaacggacctaacgtaaacggcccggtcccctaaggaggttaccgtttaagtacgtcctcgtttcgtccgtagtcctacgtatcgtcggactgacgtccgcctccagtactaagtcctcgtcgctccgaggtcgtagacgtaccgngtctagttataaccttcggtctacttnacgtaagtcttcgaattaccacgtaccaaacgttccgtacccttaccggtaccgtaacggccgttaccggacgttaacccgtcccggttaacggtcggtaccgtacccgaaccgtacccgggaccctaaccgtaccctcgggtactacccttcccg

SEQ ID NO: 179899 - DNA, 668 bp, Homo sapiens
  misc_feature: GYAE6OF02FY6G8.25.20.B09.1.454.CMB.1.raw
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatcacctatttcctgctactggactcagcactgatgttgctaggttattacttgtctctcggtaaccaacaaccacccgaggaccaaacgacccccctaaacttatactaatttagtgacggcctaacgtaacgccggaccctagacggtacgtttactaacgttcgtccttccgtcgtacggtcctaccgtaagttccgtacggcgtaacggaccgaaccgggtcccttcccgtaggaacctaacttccgttaccgtcgggtccctaccgtacggtcgtacggaacgggaccggagtccgtagttaagtttacgttacttcgaccttacgtactattacgtacgacctacgactacgaactaaccgttcccgtacttccggaccgttacgggaccgtacggtcctaaccggtcgtacggtaccgtacgacccgtaacggccccaacccgtcgtacgtacctacctcccgg

SEQ ID NO: 179900 - DNA, 880 bp, Homo sapiens
  misc_feature: GYAE6OF02F8O4A.25.20.B09.1.454.CMB.1.raw
  modified_base (512)..(512): a, c, t, g, unknown or other
  misc_feature (512)..(512): n is a, c, g, or t
tcagactgtacagtcacgaccggtgctcgatttagtgtagtgtgaagggctggatgacttgggatggggagagaaacccctcccctgggatcctgcagctccaggctcccgtgactcagcctgcctccgtgtctgggtctcctggactagtcgataccacctattttcccgtgaccctacgtacggacctccgagcctaacgtagtagttggttcggcgttaagggtttttaactttaaccgttttcggtccctttccgtaacggttaaaccccaaaaaccaaacccaaccccgaacgggtaaaccaaaaaccccgtaacccccctaaaaactttacttaacggtaatttttaacgacgggaaacccgggtacccctaaacggtaaaccggccggtacccccgttaagtacgggtttaaactttaccttaaacgtccgtcctttccgttaccgtcggtacctaccggtaacgttcggtcggaccgtacgccgtaaccggtcccctaccgtanaacctaacgtctccggtcgtccgtcccgtaacggtacgtagggaaccggacgacggtcttaagtaacgtttaacttacgtcgtaccttacgtataacgtaacgtaggaacctaaccgacgtaactaaacccgtacttcccggttaccgtacccggtaccggtaccgggtaaccgtaccgggtacccgttacccggtaccgggttacgtacccggacccgtaaacccggaccgaaccccctaaccgaccgttccgtacctacgttcccctacccgttccccgtacccttcgtacctccggttaactacccgtaacgggttccgtaccgggacggtccggaccgtccggacggtaccggcctacggtacg

SEQ ID NO: 179901 - DNA, 793 bp, Homo sapiens
  misc_feature: GYAE6OF02HIZUD.25.20.B09.1.454.CMB.1.raw
  modified_base (238)..(238): a, c, t, g, unknown or other
  misc_feature (238)..(238): n is a, c, g, or t
  modified_base (460)..(460): a, c, t, g, unknown or other
  misc_feature (460)..(460): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacgagggttcctgggcccagttctgccgtgactcagcctgccttccgtgtactcgggtctcctggacaggtccatccaacctatttccagccacgttggacctcgacnctacgtgtattggttacgacgttaggttttactttacgttttcgtccttaccgtacggttaacccaaaccaaccaacccgaaggaccaaaccgtaaccccctaaaacttacgtactatttaactagacgggaccctaacgtaacgaccggtccctacgaaggttacgtttactaactcgtaccttctcgtacggacctaccgtaacgttcgtacgacgtacnccgtaccggtaccctacccgtaacacgtaaccttccgtccggtcggtaccgttaccgacgggtcgtacgggacggaacggtagggtcgttaagttaactttacgtttaccgcgttaaccttacgtaacctaggttaacgtacggaacctaactaacgttaaccgtaaaccctaaccgttttaccccggttaccgttaaccggtaacccggtacgggacccggtttaacggggtccccttaacccggggttccggtaaccgggacccttaaaccgggacccctaacccggaccccgtaaaccccgttactaccggtcccttaacggtttccccc

SEQ ID NO: 179902 - DNA, 561 bp, Homo sapiens
  misc_feature: GYAE6OF02GZPB1.25.20.B09.1.454.CMB.1.raw
  modified_base (392)..(392): a, c, t, g, unknown or other
  misc_feature (392)..(392): n is a, c, g, or t
  modified_base (481)..(481): a, c, t, g, unknown or other
  misc_feature (481)..(481): n is a, c, g, or t
  modified_base (552)..(552): a, c, t, g, unknown or other
  misc_feature (552)..(552): n is a, c, g, or t
tcagactgtacagtcacgaccggtgctcgatttagtgtagtgtgaagggctggatgacttgggatggggagagagacccctcccctgggatcctgcagctccaggctcccgtgactcagcctgcctccgtgtctgggtctcctggacagtcgatcaccatttcctgcactggactcagcactgatgttgcaggttattactttgtctcctggtaccaacaacaccaggacaaacgcccccaaacttatctatttatgaggccaactaagccggccctcaggtatttctaatcgcttctcgtggctccagtctggcacgcaccggcctccctgactactcctcgtggcctccaggctgaggacgagctgatttatactgtctactacattagnggtacactatacaactaacgtcccgtcttaccggacttcgggacctagggtccaccgtccgtgggtcaccggaccgacgcccaaccctntcgtctacttccgtcgtccccacccttcctactacgttctacgcgttccgtgacggcgggtactacggganacggctacg

SEQ ID NO: 179903 - DNA, 876 bp, Homo sapiens
  misc_feature: GYAE6OF02J1QHY.25.20.B09.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (432)..(432): a, c, t, g, unknown or other
  misc_feature (432)..(432): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacgtcaancactattcctgctacgtggaaccngctactgatgttcgcttacttgtaccttntcctcttcggtaaccaaccaacctaccggacaaacggcctaccgaactctaatttaagtttcgacaaccgagtaacggtccggccctggtttacgggttcgttacgtacggtacttcgacgtcggtacctaccgtaacggtcgtacggaacaaacccgtccggtaaccccttacccctaaaanaaccgtttccaccgggtttcgggacccttacccgacggtacggttaacccggaaagggttacggtaccggttaactttttaccgggttttattttcgttcggttaacggtttcgttacggttaccgttaagttcggggttaacgttaaaccgggttaaaacggttaaaaaaccgttttggggtttaccggggttacgttaacccgggggttaccggggggtaacccgggggttaaaaaccggtaacccccggtttaacggtttaaacccggtaccccgggtttttaaagaacccgggttaccctacccggggtacccgttaacgggtcccccgtttaacccccgggtacccccttcgggtaacccctttaaccggtccccttttaccccgggttacccccttaccccggttaccgtaaacccgttaccgtacgtttaacccggg

SEQ ID NO: 179904 - DNA, 885 bp, Homo sapiens
  misc_feature: GYAE6OF02HTIIO.25.20.B09.1.454.CMB.1.raw
tcagactgtacagtcacgaccggtgctcgatttagtgtagtgtgaagggctggatgacttgggatggggagagagaccccctcccctgggatcctgcagctccaggctcccgtgaactcagcctgcctccgtgtctgggtctcctggacagtcgatcacctatttcctgcactggactcgagcactgatgttgcgtagttattacttgtctctaggtaaccaacaacctaccaacggaccaaaccgacccccctaaattactacgtaatttacgtaggacgtaccctactaaaggcccggaccctacgtaggtacgtttactaaagttcgtacttcgttcgtcggtacctacgtaagttccgtacggactacggaccgtaccggtacccctacccgtaggtaaacctaacgttcctaccggtaggggtacctaccggtaacggtagttacgggaaacgggtacgggtaaacggttacgtaacgttaacttttaaacttaccggtcggttaaccttaaccttaacgtaacgttaacgggtaaccgtaaaccgtaactaacccgtaaacctaaaaccgttaaacccgttaccccgtttaacccggttaccggtacccggttaacgggaaccccgggttaacgggttaccccgttaacccgggttcccgggttaccggtaaccgtaacccgggttaaccccggaaacccggtaaccccgtaaacccccgttacggttaccgttacccgtaccgttacccgttttacccggttccccccgtacccttacccgtaacccgttaaccggtaccgggttaaaccctccgggttacccggtacgggtacggcccggttaccgggttccggaaccggaccggttactaacccgg

SEQ ID NO: 179905 - DNA, 668 bp, Homo sapiens
  misc_feature: GYAE6OF02FOL07.25.20.B09.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (443)..(443): a, c, t, g, unknown or other
  misc_feature (443)..(443): n is a, c, g, or t
  modified_base (502)..(502): a, c, t, g, unknown or other
  misc_feature (502)..(502): n is a, c, g, or t
  modified_base (527)..(527): a, c, t, g, unknown or other
  misc_feature (527)..(527): n is a, c, g, or t
  modified_base (538)..(538): a, c, t, g, unknown or other
  misc_feature (538)..(538): n is a, c, g, or t
tcagactgtacagtcacgaccggtgctcgatttagtgtagtgtgaaggggggggtcacaagaggcagcgctctcgggacgtctccaccatggcctgggctctgctgctcctcactctcctcactcgaggacacgagggtcctcgggcccagtctgccgtgactcagcctgcctcgtgtctggtcctcgtggacncgtcgatccacctatttccngacctactcggactccagacctacgtcgagttacgttcggngtaacggttactttacgttcgtccgtcctacggtaaccaaccaacctacccctagggtaccaaaccgtaccccctaaattacgtactaacgttacgtagaccggtacctaacggtacgccggtaccctgtaacggttactttacgaattcgtccttcgtcgtaggtacctagtacgtcgtggcgtacnccgtacggccctacgtgtacctagtccgtacgtcggtccctagccgtagcggtaaccgngacgtcgtagtactttagtaccgtntacttaccgtntaacgtgtaacgacctagtagtaactaaccgttacgtacccgtcgttaccgtacgggacggtaccacggttcccgaacggtccgttaggccgcgacccgtacaccctaacgtctcggttaccagttcccg

SEQ ID NO: 179906 - DNA, 810 bp, Homo sapiens
  misc_feature: GYAE6OF02G4UYO.25.20.B09.1.454.CMB.1.raw
  modified_base (148)..(148): a, c, t, g, unknown or other
  misc_feature (148)..(148): n is a, c, g, or t
  modified_base (244)..(244): a, c, t, g, unknown or other
  misc_feature (244)..(244): n is a, c, g, or t
tcagactgtacagtcacgaccggtgctcgatttagtgtagtgtgaagggggggtcacaagaggcagcgctctcgggacgtctccaccatggcctgggctctgctgctctcactctcctcactcaggacacagggtcctggccaccgtntcgtcgcgtagactacgcctcgtcgtcccgtcgtgttcggtcgttcctccggagaacctcgtactactccgactttccttcgcgtactcgacgtcngacacgtcgtatgttcgttacgaacgtttaagtttactttaccgttcggtccttccgggtaactaaaaccaacaacccctaccggacaaaaccgtaacccccgaacccctttaagttacctagtttactttaagggaccgtacccggtaacctaaacggtccgggaccccttcgtaccggttaatttacgttaaacctgttcccgttcttcgttaccgcgttaccttaacggagttcgcccggaacggtcgaacccggttcccgtacctccgttaacgaaacctctccgtacggcggttaccccgtaaggtacggttaccgacgggtacgggacgttaccgtacgttaacgttaaccttaggttaaccgttaccgtcgtttaacccagttaacttacgggtaaccaaccgtagttaactaacccggttaaactaacccggttcgttaacccggtaccggtccgggtacggaaccgggttaccggtaacgttaccccgggttggaaccgtacccgtaaccgtaccgtaacccgtaaccccgacgtttaccgcccttaacctacccgg

SEQ ID NO: 179907 - DNA, 288 bp, Homo sapiens
  misc_feature: GYAE6OF01CMAN2.10.10.A10.1.454.CMB.1.raw
  modified_base (285)..(288): a, c, t, g, unknown or other
  misc_feature (285)..(288): n is a, c, g, or t
tcagcatagtagtgcacgaccggtgctcgatttagcgtcgatctcaggggtccttgaccgattctctggctccaagtctggcacctcagccaccctggccatcactgggctccaggctgaggatgaggctgattattactgtcagtcctatgacagtaggctgagtctttgggtgttcggcggagggaccaagctgaccgtcctaagtcagcccaaggctgcccctggtcactctgttcccacctcctccactactatgctgagcgggctggcaaggcgcatagnnnn

SEQ ID NO: 179908 - DNA, 317 bp, Homo sapiens
  misc_feature: GYAE6OF02HS4GG.10.10.A10.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
  modified_base (304)..(317): a, c, t, g, unknown or other
  misc_feature (304)..(317): n is a, c, g, or t
tcagcatagtagtgcacgaccggtgctcgatttagcgtcgatctcagggtccttgaccgattctctggctccaagtctggcacctcagccaccctggccatcactgggctccaggctgaggatgaggctgattattactgtcagtcctatgaacagtaggctgagtcgtttgggtgtcggtcgggaggacccgaaggtcgngtaccgtactaaagtcagccaacggtcncgcccctggtacactctacgttcccacctcctcncttacatgactgagccgggtcaggcgaggtcgactaatgcnnnnnnnnnnnnnn

SEQ ID NO: 179909 - DNA, 162 bp, Homo sapiens
  misc_feature: GYAE6OF01C0F4Y.52.14.B03.1.454.CMB.1.raw
  modified_base (160)..(162): a, c, t, g, unknown or other
  misc_feature (160)..(162): n is a, c, g, or t
tcagcgcagtacgacacgaccggtgctcgatttagtgtgagtagttccgcgggcacgaccggtgctcgatttagtcacgcgagaaaggaagggctggcctgacgtgttctgttcccacctcctctatacgatcgctgagcgggctggcaaggcgcatagnnn

SEQ ID NO: 179910 - DNA, 193 bp, Homo sapiens
  misc_feature: GYAE6OF01DHRF7.52.14.B03.1.454.CMB.1.raw
  modified_base (191)..(193): a, c, t, g, unknown or other
  misc_feature (191)..(193): n is a, c, g, or t
tcagcgcagtacgacacgaccggtgctcgatttagtgtgagtagttccgcgggtcagcctccaccaagggcccatcggtcttcccctggcaccctcctccaagagcacctctgggggcacagcggccctgggctgcctggtcaaggactacttcctatacgatcgctgagcgggctggcaaggcgcatagnnn

SEQ ID NO: 179911 - DNA, 221 bp, Homo sapiens
  misc_feature: GYAE6OF01EH5N9.52.14.B03.1.454.CMB.1.raw
  modified_base (190)..(221): a, c, t, g, unknown or other
  misc_feature (190)..(221): n is a, c, g, or t
tcagcgcagtacgacacgaccggtgctcgatttagtgtgagtagttccgcgggtcgagcctccaccaaggccatcggtcttcccctggcaccctcctccaagacgcacctctggggcacaggcggccctgggctgcctggtcaaggctacttcctatacgatcgctgagcgggctggcaaggcgcatagnnnnnnnnnnnnnnnnnnnnnnnnnnnnnnnn

SEQ ID NO: 179912 - DNA, 192 bp, Homo sapiens
  misc_feature: GYAE6OF01EHF29.52.14.B03.1.454.CMB.1.raw
  modified_base (192)..(192): a, c, t, g, unknown or other
  misc_feature (192)..(192): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctatacgatcgctgagcgggctggcaaggcgcatagn

SEQ ID NO: 179913 - DNA, 191 bp, Homo sapiens
  misc_feature: GYAE6OF01BOIKL.52.14.B03.1.454.CMB.1.raw
  modified_base (191)..(191): a, c, t, g, unknown or other
  misc_feature (191)..(191): n is a, c, g, or t
tcagcgcagtacgacacgaccggtgctcgatttagtgtgagtagttccgcgggtcagcctccaccaagggcccatcggtcttcccctggcaccctcctccaagagcacctctgggggcacagcggccctgggctgcctggtcaaggactacttcctatacgatcgctgagcgggctggcaaggcgcatagn

SEQ ID NO: 179914 - DNA, 192 bp, Homo sapiens; identical to SEQ ID NO: 179912
  misc_feature: GYAE6OF01EUSPE.52.14.B03.1.454.CMB.1.raw
  modified_base (192)..(192): a, c, t, g, unknown or other
  misc_feature (192)..(192): n is a, c, g, or t

SEQ ID NO: 179915 - DNA, 194 bp, Homo sapiens
  misc_feature: GYAE6OF01DDQXO.52.14.B03.1.454.CMB.1.raw
  modified_base (192)..(194): a, c, t, g, unknown or other
  misc_feature (192)..(194): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctatacgatcgctgagcgggctggcaaggcgcatagnnn

SEQ ID NO: 179916 - DNA, 520 bp, Homo sapiens
  misc_feature: GYAE6OF01DBW8K.52.14.B03.1.454.CMB.1.raw
  modified_base (264)..(264): a, c, t, g, unknown or other
  misc_feature (264)..(264): n is a, c, g, or t
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagatatatagtgttgctggtatcagcagataccagggaaancccctaaatcctgatctataaggcgtactagtttaagaagtgggtccctanaaggttcagcggcagtggatcgtgggacagaattcactctacaccatccaacngacctgcagcctgatgtatttgactaacttattactgaccaactactataatctaattacttctaccggtcctacgtttcggcccttgggacctaagtctagtatacgtcggacgtaacgtggtcgctcgaccaaccatccttgttcttacc

SEQ ID NO: 179917 - DNA, 197 bp, Homo sapiens
  misc_feature: GYAE6OF01EX6ZY.52.14.B03.1.454.CMB.1.raw
  modified_base (191)..(197): a, c, t, g, unknown or other
  misc_feature (191)..(197): n is a, c, g, or t
tcagcgcagtacgacacgaccggtgctcgatttagtgtgagtagttccgcgggtcgagcctccaccaagggcccatcggtcttcccctggcaccctcctccaagagcacctctggggcacagcggccctgggctgcctggtcaaggactacttcctcgtagcactctgagcgggctggcaaggcgcatagnnnnnnn

SEQ ID NO: 179918 - DNA, 581 bp, Homo sapiens
  misc_feature: GYAE6OF01D1BNR.52.14.B03.1.454.CMB.1.raw
  modified_base (235)..(235): a, c, t, g, unknown or other
  misc_feature (235)..(235): n is a, c, g, or t
  modified_base (268)..(268): a, c, t, g, unknown or other
  misc_feature (268)..(268): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagaatattaanagtgtgctggtatcagcagataccgagggaacncccctaaatcctagatctaagtaacggcgttacttaagtttagaaggttcggggtacccttacgaaggttcaggcggactaggtggatcgtggacagaattcactctcacatcaacacgcctagcagctgatgtatttgactaatttatactcgacctaactactaataactctaatttacttcctcccggtacctaccgtttccggacccgttacgggaacctaagtcgtaagtacttacggtaccggtaacgtaacgttcggtacggtacctacgtacccgtaaccctatttccttacgttcctttacccg

SEQ ID NO: 179919 - DNA, 650 bp, Homo sapiens
  misc_feature: GYAE6OF01DQFND.52.14.B03.1.454.CMB.1.raw
  modified_base (310)..(310): a, c, t, g, unknown or other
  misc_feature (310)..(310): n is a, c, g, or t
tcagcgcagtacgacacgaccggtgctcgatttagtgtgagtagttccgcgggggggagtcacgtacccgagttcgaggacacgtagcatggacatgaggggtccccgcgtcacgctcctggggctcctggctgtctctgggctccaggtgccaaatgtagacatccgagatcgacccagtctccgtccacctgtctgtcattctgtaggtagacgagacgtcaccatcgacttcgaccgggcaggtcagaagtattaagtaaggtcggttaggcctgggtactccagacagactaacccgagggaaacncccctaaatccgtagatacttataacggtcgtacgtagtttagaagtcgggtacccttagaaggttcacgtcgggacacgtggactcgtagggactaggaacttcgacgtcgtcgaacctatacaacgtagtcctgacagtaccttagtaatcgtaatttggacttaactttagttacgtacggacctaaactactaacttaactctaagttaacgttccgtacccggtaccttaccgtttaccgggacccgttaggggaacctaagtcgtaacgaataacgtacgggaacctacgtcggttaggacttacggacctacgtactcgttcgtcgtttaccg

SEQ ID NO: 179920 - DNA, 676 bp, Homo sapiens
  misc_feature: GYAE6OF01A1I8R.52.14.B03.1.454.CMB.1.raw
tcagcgcagtacgacacgaccggtgctcgatttagtgtgagtagttccgcgggggggagtcagacccacgtcaggacacagcatggacatgagggtccccgctcagctcctgggctcctgctgctctgggctcccaggtgtcctaaagtggtgacatccagatggacccacgtcctccttccacccgtgtctgcatctgtaggagacaggagtcaccgatcgacgttcggccggggccagtcaggaatattaataacgtggttgacctggttatcgagcagtactaaccgaagggtaacgaccccttaaaactccctagtacgtacgtaacgtaacggccgtaccgttaaggtttaacggaaaggttcggggttacccttacggtaaggtttacgacggtcgggcgaacggtacggaacgtacggtacggaacgtagtaacttacacgttccgtactactacgtacaacgtcgtccgtaggaccgacggtcctagtagttggttaagtttcgaacgttaacttacgtaccgacgtaacctaacgtacgttaataactagtaactttacttcccgacgtccgttacgttcccggaccgtacggaacacgtacgtatacgttcgacggtactaacggtcggtaccggctacggaccgtactcgttctcgtcgttaccg

SEQ ID NO: 179921 - DNA, 518 bp, Homo sapiens
  misc_feature: GYAE6OF01ALT0T.52.14.B03.1.454.CMB.1.raw
  modified_base (325)..(325): a, c, t, g, unknown or other
  misc_feature (325)..(325): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacgcccctaaaactcctgatctataaggcgtctagtttagaaagtgggtcccttnaaggttcagcggcagtggatctgggacagaattcactctcaccatcaacagcctgcagcctgatgtattttgactaacttattactgccaacactataactctattattcctccggtcctacctttccggcccttagggaccctaagctaagatacgtcggactaacgtgtacgctcgacaccatctgtcttc

SEQ ID NO: 179922 - DNA, 599 bp, Homo sapiens
  misc_feature: GYAE6OF01CQ5S8.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctccaggtgccaaatgtgacatccagatgacccagtctccttccaccctgtctgcatctgtaggagacagagtcaccatcacttgccgggcagtcagaatattaatagtggtgcctggtatcagcagataccagggaaacgcccctaaactcctgatctataaggctactaggtttagaaaggtggggttacccttagaaggttcaggcggcaggtgatctgggacagaattcactctcaccatacaacacgcctgcagcctgatgtatttcgactaactttattacctgaccctaactaacttaataaactctaatttactttccgtacccggtacctaccgttttccggaccccgttaggggaacccctaaggaccgttaagtaacgttaacgttacccgggtaacgtaaaccggttgggttacggtccttacggaccctaaccctagttaccttcggttctttacccg

SEQ ID NO: 179923 - DNA, 545 bp, Homo sapiens
  misc_feature: GYAE6OF01CMDJP.52.14.B03.1.454.CMB.1.raw
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccgagggaaacgcccctaaaactcctgatctataaggctctagtttagaagtgggtcccttnaaggttcagcggcagtggatcgtgggacagaattcactctcacatcaacngcctgcagcctgatgtattttgactaactttattactcgacctaacacttaataactctaatttacttccgtacccggtcctaccgtttccggccctgggaacccaggtctaagattacgtccggaacgtaacgttggtcggccttaggcctaccattcctgttcttacc

SEQ ID NO: 179924 - DNA, 533 bp, Homo sapiens
  misc_feature: GYAE6OF01AYASS.52.14.B03.1.454.CMB.1.raw
  modified_base (320)..(320): a, c, t, g, unknown or other
  misc_feature (320)..(320): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagaatattaataagtggttgctggtatcagcagataccgagggaaacgcccctaaactctgatctataaggcgtctagtttagaagtgggtccttnagttcagcgcagtgatcgtggacagaattcactctcacatcaacagcctgcagcctgatgtatttgactaactttatactcgacctaactacttaataactctaatttacttccgtaccggtcccttaacgttttccggccctagggacccaagtctagaatacgtacggaacgtacttggtacgcttaggacctactattcttgttcttacg

SEQ ID NO: 179925 - DNA, 503 bp, Homo sapiens
  misc_feature: GYAE6OF01CSY69.52.14.B03.1.454.CMB.1.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaaatgtgacatccagatgacccagtctccttccaccctgtctgcatctgtaggagacagagtcaccatcacttgccgggcagtcagaatattaataagtggttggcctggtatcagcagataccagggaaancccctaaaatcctgatctataaggcgtntaagtttagaaagtgggtcccttnaaggtcagcggcagtggatcnggacagaattcatcncaacatcaaacagcctgcagcctagatgaattttgctaacttattactgaccaacactaataatcaattagttctccggcctactttcggccctgggaccaagcagatagtcggagaactgnggtncgcaccatctgtcttc

SEQ ID NO: 179926 - DNA, 533 bp, Homo sapiens
  misc_feature: GYAE6OF01D4I6H.52.14.B03.1.454.CMB.1.raw
  modified_base (274)..(274): a, c, t, g, unknown or other
  misc_feature (274)..(274): n is a, c, g, or t
  modified_base (325)..(325): a, c, t, g, unknown or other
  misc_feature (325)..(325): n is a, c, g, or t
  modified_base (378)..(378): a, c, t, g, unknown or other
  misc_feature (378)..(378): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacncccctaaactcctgatctataaggcgtactagtttagaagtgggtcccttnaaggttcagcggcagtggatcgtgggacagtaattcactctacaccatcaacngcctgcagcctgatgtattttgactaacttattactagaccaactactaataactctaatttacttccttacccggtcctaccgtttccggccctagggaccaacgtctagtatacgtcggacgtacgtggtcgctcgcaccattctgttcttac

SEQ ID NO: 179927 - DNA, 614 bp, Homo sapiens
  misc_feature: GYAE6OF01BOWOC.52.14.B03.1.454.CMB.1.raw
  modified_base (343)..(343): a, c, t, g, unknown or other
  misc_feature (343)..(343): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataaccgaagggaaacgccccctaaaactcctagatctataaggcgtctagtttagaagtcgggtccttgaaggttcagcggnagtgatcgtggacagtaattcactctacaccatacaacagcctgcacgcctagatgtacttttgactaactttattactcgaccaactacttaataactactaatttaacttccgtacccggtacccttaccgttttcccgggacccgttacggggaaacccctaaggtacccgttaagtaaaccgttacgttacccgggtaaccgtaaacggttgggttacgggtaccttacggaccctaacccttatccgtttacgttccctttaaccg

SEQ ID NO: 179928 - DNA, 604 bp, Homo sapiens
  misc_feature: GYAE6OF01CXTEB.52.14.B03.1.454.CMB.1.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (587)..(587): a, c, t, g, unknown or other
  misc_feature (587)..(587): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctccaggtgccaaatgtgacatccagatcgacccagtcctccttccaccctgtctgcatctgtaggagacagagtcaccatcacttgccggcagtcagaatataatagtggtgctgtatnagnagataccgaagggaacctaccctaaactcctagattacgtaagtaacggtcgttacgttaaggtttaagaaacgggttcggggttaccccttaggtaaacggttcgaaggcgggtacaggttcggtaacttcggtagggaactaagtaacttccaactactaccaacctactaccaacgacgtcctagcacgtcctagtattcgtaattttcgaacttaaccgtttatacctacgaacctaactacttaatacttacgtatttaccttccgtacccgtaccttacgttccggaccgtagggacctaagtctagatacgacggtaactacgtgcgtncgcactattctgtctac

SEQ ID NO: 179929 - DNA, 686 bp, Homo sapiens
  misc_feature: GYAE6OF01BR0VX.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccgggcagtcagaatatataagtggttgctggtatcagcagataaccgaagggaaacgacccctaaaactcctagattactaagtaacggccgttacgttaaggttttaaggaaaagggttcggggttacccctttacgaaacgggttttaccgaaggtccgggctaaggttagggacgttcggtaggggaacaaggtaaactttccaacttcctacctaacctaattaccgaaaccacggtaccctggtaccacggtcccttagtacttaggttaacttttacgaaccttaaaccttttaactttaaccgtacgtaaccctaaactaaccttaaataacttactaatttaacttccgtacccgtacccttaccgtttccgggacccttacgggaacctaacgtctaaagagttaacgtaccgggaacgaacgttggtacggacctcgtaccctactattcctagttcttacc

SEQ ID NO: 179930 - DNA, 572 bp, Homo sapiens
  misc_feature: GYAE6OF01D8UPL.52.14.B03.1.454.CMB.1.raw
  modified_base (368)..(368): a, c, t, g, unknown or other
  misc_feature (368)..(368): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttgcctggtatcagcagataccagggaacgcccctaaactcctgatctaataaggcgtctaggtttagaaagtggggtcccttgaaggttcaggcggctaagtggatcgtgggacagtaatcactcncaccatacaacacgtcctgacacgtctagtattagtatttgaccttaacgttacttactacgaaccaactacttaacttaactactaatttacttccgtccgtacctacgtttccgacccgtaggaacctagtaccgtagtaactacgtaccggtaactaacgtcggtacgtcgtcgtaccctaactattccgttgtccttacc

SEQ ID NO: 179931 - DNA, 614 bp, Homo sapiens
  misc_feature: GYAE6OF01C2OCJ.52.14.B03.1.454.CMB.1.raw
  modified_base (198)..(198): a, c, t, g, unknown or other
  misc_feature (198)..(198): n is a, c, g, or t
  modified_base (271)..(271): a, c, t, g, unknown or other
  misc_feature (271)..(271): n is a, c, g, or t
  modified_base (399)..(399): a, c, t, g, unknown or other
  misc_feature (399)..(399): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtcctcccttccaccctgtctgcatctgtagganacagagtcaccatcacttgccggcagtcagaatataatagtgtgctggtatcagcagataccgaagggaaacnccccctaaatcctagaattactaagtaaggcgttacttaaggtttaaggaaaggttcggggttacccttagaaggttcaggcggactaggtggatcgagggacagtaactcactctacaccatcaacngcctgcagcctagattagtattttgacttaactttattaaccgtcaaccctaaactaacttaattaattactaatttactttacccgtcccggtacccttaccgtttcccgggtaccccttacggggaaccctaagtacctaagtaactacggttaccggaaccgttaacgtggtacggcttacggacctaaccgtattccgttcgttccttacc

SEQ ID NO: 179932 - DNA, 200 bp, Homo sapiens
  misc_feature: GYAE6OF01BUNLN.52.14.B03.1.454.CMB.1.raw
  modified_base (192)..(200): a, c, t, g, unknown or other
  misc_feature (192)..(200): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctcgtagcactctgagcgggctggcaaggcgcatagnnnnnnnnn

SEQ ID NO: 179933 - DNA, 588 bp, Homo sapiens
  misc_feature: GYAE6OF01ATSMH.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccacctgtctgcatctgtaggagacagagtcaccatcacttgccggccagtcagaatataataagtggtgcctggtatcagcagatacagggaaacgcccctaaactcctagatctatacggcgtacttagttagaaagttcggggtaccttgaaggttcaggcggctagtggatcgtgggaacagaacttcaacgtcctcaaccatacaacgtacgcctgccaagtcctagattgtagtttacgacctaactttattactacgaccctaactaacttaataaacttctaatttacttcctacccgggtaccttaccgtttccggcccgttacgggacctaacggtcctagaacttaggtaccgggacctaaaggttcggtggtacctagacccaccgtattcttcgtctttaaccc

SEQ ID NO: 179934 - DNA, 499 bp, Homo sapiens
  misc_feature: GYAE6OF01CYAF7.52.14.B03.1.454.CMB.1.raw
  modified_base (266)..(266): a, c, t, g, unknown or other
  misc_feature (266)..(266): n is a, c, g, or t
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagatatatagtgttgctggtatcagcagataccagggaaancccctaaatcctgatctataaggcgtctagtttagaagtgggtcccttnaaggttcagcggcagtgatctggacagaatcactctanaccatcaacngcctgcagcctgatgtattttgctaacttatactgacctaactactataattctaatttacttcctccggtcctactttcggcccttgggacctaagctagatagtcggacaactgtggctgcacatctgtcttac

SEQ ID NO: 179935 - DNA, 866 bp, Homo sapiens
  misc_feature: GYAE6OF01DVCAI.52.14.B03.1.454.CMB.1.raw
tcagcgcagtacgacacgaccggtgctcgatttagtgtgagtagttccggcgggggggagtcagacccagtcaggacacagcatggacatggacgggtccccgctcagctccgtggggctcctgctgctctggctcccgaggtgaccaaatgtgacatccagatcgacccagtcctcccttccaccctgtctgcatctggtaggagacgagagtcaccatcacgttcggccgggccagtcaagtaattattaagtaaggtggttcggccgttggtatcgagacaagaactaaccggaagggtaaacctacccccttaaaatcccgtagtaacttaccgttaaaggtaacggtccgtttacgtttaaaggtttaaacgggtaaaacgggtttcggggttaccccctttaagggtaaacgggttccgaacgggtcgggtaccgtaaggttacgggtaacttacgggtaaggggaacctaacggtaacgttccctaacgttaccctacctaaaccactaaccgaaaccgtaccgtccgttacgacctaaccggtccgttaggtaacgtttacgtttaacgttttacggaaccctttaaacgttttacttaacccggtaccgtaaacccctaaacttaaacgtttaaacttaaactttaacctttaacgttttaaccgttaccccggtaccccggttaaccccgtttacccggttttccccgggaccccggtaaacggggtaaaccctaaagggttcccgttaaaaggtaccgtttaaacgggtacccgggtaaaccgttaacggttcgggtaccggtaccgtaccggtacccctaacccgttaagtttcccgtacgttccgtttacccg

SEQ ID NO: 179936 - DNA, 511 bp, Homo sapiens
  misc_feature: GYAE6OF01D5LFE.52.14.B03.1.454.CMB.1.raw
  modified_base (385)..(385): a, c, t, g, unknown or other
  misc_feature (385)..(385): n is a, c, g, or t
  modified_base (430)..(430): a, c, t, g, unknown or other
  misc_feature (430)..(430): n is a, c, g, or t
  modified_base (502)..(502): a, c, t, g, unknown or other
  misc_feature (502)..(502): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaaggagacagagtcaccatcacttgccgggccagtcaagaatattaataagtggttgctggtatcagcagataccgaggaaacgcccctaaatcctagatctaagtaaggcgtactaagtttagaaagttcgggtcccttagaaggttcagcgcagtggatcgtgggacagtaacttcactctacacatcaaacngcctgcagcctagatgtattttgactaatttattactgacctaanactaataatctaattactctccgtctacgtttccgcctaggacaagctagatagcggagactgcgctgcacntctgtctac

SEQ ID NO: 179937 - DNA, 626 bp, Homo sapiens
  misc_feature: GYAE6OF01AKCRG.52.14.B03.1.454.CMB.1.raw
  modified_base (390)..(390): a, c, t, g, unknown or other
  misc_feature (390)..(390): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagaatattaatagtggttggcctggtatcagcagactaccgaaggaaacgcccctaaactcctgatctataacggcgttactaagtttaaggaaaggttcgggtcccttagaaggttcagcgcagtggatcgtgggacagaacttcacgtctacacctatacaacncgcctgcacgcctgatgtatttgaaccttaacttacttaccacgaccctaactacttaataactacttaactttaacttccgtaccccggtacctttaccgtttccgggtacccgtaccgggtaaccctaacgtaccttaacggtaactaaccggttaccgggtaaaccgttaaccgtcgggtacggtcccttaggacccctaccgtaattcccggtttccgttacttttaccccg

SEQ ID NO: 179938 - DNA, 658 bp, Homo sapiens
  misc_feature: GYAE6OF01AC5LH.52.14.B03.1.454.CMB.1.raw
  modified_base (351)..(351): a, c, t, g, unknown or other
  misc_feature (351)..(351): n is a, c, g, or t
tcagcgcagtacgacacgaccggtgctcgatttagtgtgagtagtttgggtttgtgggtgggtccaggaggcagaactctgggtgtctcaccatggcctggatccctctacttctcccctcctcactctctgcacaggctctggggcctcctatgaactgacacagccaccctcggtgtcagtgtcctcgaggacagacggccaggatcacctgctcgtgggagatgcactgaccaaagcaaatagtggttattcggtaaccagcgagacggccaggccacggcccccttagtggtgatatagtaaggaccatgagacgcctacgagggactcccgtgacgacgtacttcncgtcggcctccctccgtcgaacgggaccaaacgtacggtaccgtaacgtttgactacgacgttacgacgggtcgggtaccggtccggggacagggaacgggaaccggtagggtaccgttaggaaccttacggtttaacgtacggttaacaacgttaccaaacgacgtaacgtaagttaaggtttacgggtaactttacgtaggttagacgtaggttcgggacgggtaggtacccgaagccgttacggacccgttacggtacggtaccgacgacccgaacggtcctacccgccccgtcggtctacccg

SEQ ID NO: 179939 - DNA, 195 bp, Homo sapiens
  misc_feature: GYAE6OF01A0LLA.52.14.B03.1.454.CMB.1.raw
  modified_base (192)..(195): a, c, t, g, unknown or other
  misc_feature (192)..(195): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctatacgatcgctgagcgggctggcaaggcgcatagnnnn

SEQ ID NO: 179940 - DNA, 697 bp, Homo sapiens
  misc_feature: GYAE6OF01C40BN.52.14.B03.1.454.CMB.1.raw
  modified_base (201)..(201): a, c, t, g, unknown or other
  misc_feature (201)..(201): n is a, c, g, or t
  modified_base (267)..(268): a, c, t, g, unknown or other
  misc_feature (267)..(268): n is a, c, g, or t
  modified_base (685)..(685): a, c, t, g, unknown or other
  misc_feature (685)..(685): n is a, c, g, or t
tcagcgcagtacgacacgaccggtgctcgatttagtgtgagtagttccgcggggggagtcagacccagtcaggacacagcatggacatgagggtccccgctcagctccgtggggctcctgctgctctggctcccaggtgccaaatgtgacatccagatcgacccagtcctcccttccaccctgtctgcatcgtggtagganacagacgtcaccatcacgttcggccggccagtcaagaatattaagtaggtggtgctaggtatcgannagactaccgaagggaactacccctaatcctagactactaagtaggcgttacgtaagtttaacggaaaggttcgggttacccttagtaacggttcgacggtcggacgtaggtggacttacggtagggaactaagtaacgttccacttactaccgaacctactaacaacccgtacgccccgtagaccgtaccgtagttacgtactttaacggtttacttaaccgtaaacctttaactttacgtaaccgtacctaacctaaactacttaataactacttacttaccgttcccgtacccgttaccttacccggttcccggtaccgtaaccggaaccgtaacgtaccgttaaacgtacggtaaccggtaaccggtacttacggtcggtccgtacggtaccctacctaccttagttcccgttnttaccttacccg

SEQ ID NO: 179941 - DNA, 774 bp, Homo sapiens
  misc_feature: GYAE6OF01CSN67.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctccaggtgccaaatgtgacatccagatgacccagtctccttccacctgtctgcatctgtaggagacagagtcactatcacttgccgggcagtcagatatatagtgtgctggtatcagcagactaccgaagggaaactcccctaaactcctagactctaagtacggctacgttaagtttacgaaaggttcggggttacccttagaacggttcgaggccggtctaggtggaactcggtaggggtaactagtaacgtttccaacgttctacctaaccgattaccgaaacgtacggtcccttaggaccctagggtaccccttaggtaacgttcggttaacgtttttcggaaacctttaaccgtttaacgtttaaccgtaccggtaaccccttaaacgttaaacccttaagtttaaaccttaccgttaaaccttttaaccggttacccggttaccccggttacccttaaacccggtttttcccgggaaccccgtttacgggggaaacccttaacgggtaccgttaaaccggttacgttaaccggttaacccgggtaaccggtttaaaccgttcgggttaccgggtacctttaaccggggaccccttaaaccgttaaccgtttccttacccgggttttaccccttaaccgg

SEQ ID NO: 179942 - DNA, 520 bp, Homo sapiens
  misc_feature: GYAE6OF01BZGCI.52.14.B03.1.454.CMB.1.raw
  modified_base (272)..(272): a, c, t, g, unknown or other
  misc_feature (272)..(272): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttgcctggtatcagcagataccagggaaacncccctaaactcctgatctataaggcgtactaggtttagaaaggtgggtcccttcgaaggttcagcggcagtggatcgtgggacagaattcactctcaccatcaacagcctgcagccctgatgtacttttgactaactttattactacgaccaactactaataacttcatttacttcctccggtacctacgtttccgcctcggaccaagctagatacgtcggagtattgtgctcgcactatctgtcttc

SEQ ID NO: 179943 - DNA, 768 bp, Homo sapiens
  misc_feature: GYAE6OF01CVE46.52.14.B03.1.454.CMB.1.raw
  modified_base (250)..(250): a, c, t, g, unknown or other
  misc_feature (250)..(250): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatcgacccagtctccttccaccctgtctgcatctgtaggagacagagtcaccatcacttcgccggcagtcagaatattataagtgtgctgtatnagacagataccgaggaaacgcccctaaactctagactactataacggcgttacgttaagtttaaggtaaacggtcggggttacccctttagtaacggttcgaacggcggacgtaggtacggtagtcgtacggggaactaacggtaattccaaccttccttaccaaccctaacgttaccaaaaccgtacgtcccgttaggacctaccgtaccgttacggaaacgtttcgtttaacgtttttacgacctttaaaccttttacgtttaacccgtaacggtaacccctaaaccttaaaccttaacgtttaaaacttaccttaaacgtttttaaccgtttccccgtttaccccggggttacccttaacccggtttttaccccgggtacccgttaaccgggggtaaaccctaacgggtaccgttaaacggtacgttaaccggtaccgggtaaaccggtaacggttcggtacgggtaccgttacgtacccctaacttaccgtttccgttaccgtttcttaccccg

SEQ ID NO: 179944 - DNA, 695 bp, Homo sapiens
  misc_feature: GYAE6OF01AQH6W.52.14.B03.1.454.CMB.1.raw
  modified_base (275)..(275): a, c, t, g, unknown or other
  misc_feature (275)..(275): n is a, c, g, or t
tcagcgcagtacgacacgaccggtgctcgatttagtgtgagtagttccgcgggggggagtcagacccacgtcaggacacagcatggacatgacgggtcccgctcacgctcctgggctctgctgctcgtggctcccaggtgtccaaagtgtgacatcccaagatgaccccagtcctccttccaccctgtctgcatctggtagagacgagacgtcaccgatcacgttggccgggccagtcagtaatattaataaggtggttacgcctggtactcganacagactaccgaaggggaaccaccccctaaactccgtacgatacgtaagtacggtcgttagttaagttaggaaagggttcggggttaccctttacgaagggttccaggtccggacgtaggttacggtaacttacgtaggggaccaaggtaaacgtttacgtaaacgttccgtacctaaccgtataaccaaccgtacgtcccgtacgggactaccgtaccgtagtactacggttacttttacggaccttaagtttacgttactacgacctaactacttaataacttactaactttaacctccgtacccggtacccttacggtttacccgtccgttacggacctaagtacgagtacggtacgtaccgggaagtaccggtggtaccgtcttacggacctaccaagttccttcgttcccttacg

SEQ ID NO: 179945 - DNA, 838 bp, Homo sapiens
  misc_feature: GYAE6OF01E5494.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccggcagtcagatataatagtgtgctggtatcagcagataccgagggaaacgcccctaaactcctagactactaagtaacggcgttacgttaaggtttaaggaaacggttcggggttacccctttacgtaaacgggtttccgaagggtccgggtaccgtaaggttgggaacttccgggttagggggaacctaaaggtaaactttaccgaacctttccctaacccgtaaaccctaacttaacccgaaaccgtacggtaccccgttacgggaccctaaccgggtaccccgtttagggtaacttttaggtttaacgttttttacggaaaccctttaaaaccgtttttaacgtttaacccgttaccggtaaacccccttaaaacccttaaacctttaaatttaaaccttactttaactttttaaccttcccggttaccccgggttacccctttaacccggttttccccgggaccccgttaacggggaaacccctaaaggtacccgttaaaggtaaaccgttaaccgggttaacccggggtaaaccggtaaaccggtttcggggtaccgggtaccgttaccgggaacccttaacccgtaacgtttcccgtttacgttcccttttaacccg

SEQ ID NO: 179946 - DNA, 592 bp, Homo sapiens
  misc_feature: GYAE6OF01A3BFA.52.14.B03.1.454.CMB.1.raw
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
  modified_base (337)..(337): a, c, t, g, unknown or other
  misc_feature (337)..(337): n is a, c, g, or t
tcagcgcagtacgacacgaccggtgctcgatttagtgtgagtagttccgcggggggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccgggcagtcagatattanagtgtgctgtatcagcagataccagggtaacgacccctaaactcctgatctataaggcgtctagttagaagtgggtccttnaaggttcagcggctagtggatcgngggacagaattcactctcacatacaacagcctgcagtcctagacttgaattttgactaatttattactacgtacctaactacttaactaaagttcctaatttaactttcccgtacccggtaccttaccgttttcccgggtacccctacgggggtaaccctaagggtccctaaacgtactaacggttccgggaaccgtaaacggttcggtaaccggctttacggacctaccctaacttcttacggttcctttaccc

SEQ ID NO: 179947 - DNA, 769 bp, Homo sapiens
  misc_feature: GYAE6OF01CBNJY.52.14.B03.1.454.CMB.1.raw
  modified_base (323)..(323): a, c, t, g, unknown or other
  misc_feature (323)..(323): n is a, c, g, or t
tcagcgcagtacgacacgaccggtgctcgatttagtgtgagtagttccggtcgggggggagtccagacccagtcagggacgacagcatggacatgacgggtccccgctacgacgctccgtggggccctccgtgcctgcctacgtgggcctaccccagggtggacccaaaatggtcggaccagtcccaggactcggacccaaggtcctaccctttccacccgttgcctgcagtcgtggtaggagacaggacgtcaacatccacttcgccgggcagtcagaatataatagtggtagctaggtatcagcagataccgagggaaacnccccctaaatcctagactactagtaacggtcgtacgtaagtttaggaaacggttcggggttaccccttagaaacgggttccaaggccggtacaggttgggaatccgagggtaaccaagtaaacttccgaactctaccaacccaataccgaaacgtcgtacccgtagacccgagtaccctaggtaaagtttcgttaacgttttacggacccttaaaccttttaagtttaaccctacgtaaccgtaaacctaacttaaacgttaaccttaactaactttacggttaccccgtacccgggtacccttaccgtttaccccgggaccctacgggggtaaccctaaagggaccttaaaccggtaacgttacggtaaccgggtaaccgtaaaccgttggggtacccggtacttacgggaaccaaccggttataccgttaggttccctttaacc

SEQ ID NO: 179948 - DNA, 589 bp, Homo sapiens
  misc_feature: GYAE6OF01AUWEC.52.14.B03.1.454.CMB.1.raw
  modified_base (275)..(275): a, c, t, g, unknown or other
  misc_feature (275)..(275): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
tcagcgcagtacgacacgaccggtgctcgatttagtgtgagtagttccgcggggggagtcagacccagtcaggacacagcatggacttatgagggtccccgctcagctcctggggctcctgctgctctggctcccaggtgccaaatgtgacatccagatgacccagtctccttccacctgtctgcatctgtaggagacagagtcaccatcacttgccggcagtcagatataatagtgtgcctggtatcagcagataccgaggaacgcccctaacncctagatctataggctactaagttaagaacgtcgggtcctagaacggttcgagcggacagtgacgtcgtaggacagtattcactcncactatacacagcctancacgtctgatcgtattcgacttaacttacttacgtaccgtaccaactacgttaataacgttactattttaaccgtccgtacccgtaccgttaccgttttacccggcccgttacgggtaaccctaacggtaccgtaaggtaactaacggttacccgggaactaacggttggtacgtcgttaacgcctaaactagttccttgttccgttaccc

SEQ ID NO: 179949 - DNA, 641 bp, Homo sapiens
  misc_feature: GYAE6OF01AV82J.52.14.B03.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
tcagcgcagtacgacacgaccggtgctcgatttagtgtgagtagttccgcgggggaggtcgagacccagtcaggacacagcatggacatgagggtccccgctcagctcctggggctcctgctgctctggctcccaggtgccaaatgtgacatccagatcgacccagtctccttccaccctgtctgcatctgtaggagacagagtcaccatcacttgccgggccagtcagaattattaatagtgtgctggtatcagcagatacgaggaaacncccctaatcctgatactatacggcgtnttaagttagaacggttgggtcccttagacgttcgacgcggtcaaggtcgagtcgtagggactaagacttctaacncgttacacctaatccgaaacacgtcctacggacaccggtacctggtacttaggtacgttttaggtacctaacgtttactttaacgtacgtaccctaaaccttaacttaagtaaccttactaatttaccgtttaccgtacccggttacccttaccgtttacggccccggtttaacggaccgtaacgtcctaaacgtactaggttccggtaacgaacccgttgtacccggtactcggtaaccacccgtattccgttacgtttccttaccg

SEQ ID NO: 179950 - DNA, 553 bp, Homo sapiens
  misc_feature: GYAE6OF01AMMHI.52.14.B03.1.454.CMB.1.raw
  modified_base (261)..(261): a, c, t, g, unknown or other
  misc_feature (261)..(261): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagatatatagtgtgctgtatcagcagatacgaggaacnccctaaactctgatctagtaaggtcgtacttaagttagaaggtcgggttcccttagaaggttcaggcggctaggtggatcgtgggacagtaacttcactctcacctatacaacacgcctagccagtcctagatttagtaattttcgacttaactttacttactcgaccctaactacttaataacttctaatttactccgtaccgtaccttaccgttccgaccctagggacctaagtctagtactacgtcggaacgtacgtggtacgactgacctactattcttgtcttaccg

SEQ ID NO: 179951 - DNA, 867 bp, Homo sapiens
  misc_feature: GYAE6OF01DR8MV.52.14.B03.1.454.CMB.1.raw
  modified_base (266)..(266): a, c, t, g, unknown or other
  misc_feature (266)..(266): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcactgccggcagtcagatattatagtggttgctgtatcagcagataccaagggaaacncccctaaactcctagactactaagtaacggcgttacttaaggtttaaggaaaggttcggggttaccctttacgtaaacggtttccgaacgggtcggacgtaggttacgggtaagttccggtaggggaacctaaggtaaactttaccgaaccttccgttaccaaccctaatacccgtaaaaccgacggtaccccgttacgacccgtaacggtccccttaggtaacgtttaggttaacgttttttacggaccctttaaacctttttaacgtttaacccgttacggtaacccccttaaaaccttaacctttaaactttaaaacgtttacctttaaacgtttttaaccgttttaccccggttacccccggggtttacccctttaaacccggggtttttttacccccggggaaccccccggtttacggggggtaaaacccccttaaaacgggttcccgtttaaaacgggtaaccgttttaaaccgggttaaccccgggggtaaacccgggttaaaccggttttccggggttacgggttccccggttaccggtaacccgtaaaccccccgttagttttacccggttcgttttaccccttttaacccg

SEQ ID NO: 179952 - DNA, 520 bp, Homo sapiens
  misc_feature: GYAE6OF01DIERY.52.14.B03.1.454.CMB.1.raw
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatataataagtggttggcctggtatcagcagataccagggaaacgcccctaaactcctagatctataaggcgtctagtttagaaagtgggtcctagagttcagcggcngtggatctgggacagaattcactctcaccatacaacngacctgcagcctgatgtatttgctaattattactgaccaatactaataatcaatttacttacctccgtcctacgtttccggccctgggaacctaagctagatacgtcggaacgacgtgcggtctagccaacctatctgttcttaccg

SEQ ID NO: 179953 - DNA, 642 bp, Homo sapiens
  misc_feature: GYAE6OF01B5V4M.52.14.B03.1.454.CMB.1.raw
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
tcagcgcagtacgacacgaccggtgctcgatttagtgtgagtagttcctcgggggggagtcagacccagtcaggacacagcatggacatggagggtccccgctcagctccgtggggctctgctgctctggcctccaggtcgaccaaatgtgacatccagatcgacccagtcctcccttccaccctgtctgctatcgtggaggagacgagagtccacatctacgtcggccggactagacagtaatattaagtagtggttcgactggtanacgaganaacgacgtaccgaacggaacctaccctaatcctagacttacgtagtaacggtcgttacgttaagttaggaacggttcgggttacccttagtaacggttccgaggtccggaagtaggtagacgttacgggaggaactaggtacttacgacctactacaactactaccaacgtcgtacctacggcacggtctagtattagttacttagaacttaacttatactaccgactaactactaatactactttacttaccttcccgtaccgttacctaccggttccgtaccgtacgaacgtacgtaacgcgtaacgtacggtaccggtaacctaggttcgtacgacctacgacctaactctctcggttcctacg

SEQ ID NO: 179954 - DNA, 836 bp, Homo sapiens
  misc_feature: GYAE6OF01EYU4W.52.14.B03.1.454.CMB.1.raw
tcagcgcagtacgacacgaccggtgctcgatttagtgtgagtagttccgcggggggagtcagacccagtcaggacacagcatggacatgagggtccccgctcagctccgtggggctcctgctgctctggctcccaggtgccaaatgtgacatccagatgacccagtcctccttccaccctgtctgcatctgtaggagacagagtcaccatcacttcggccgggccagtcaagattaattaataaggtggttcgcctaggtatcagcagaactaccgaagggaaaccgacccctaaactccgtagactacgtaagtaacggtcgttacgttaagtttaacggaaaggttccgggtaccccttagtaacggttccgaggtccggacgtaggtaggacttacggtacgggtaacaacggttaaacttccgaacgtttaccctaaccgtaaaccctaacgttaacccgaaaccgtaccggtacccgttacggacccgtaaccgggtaccccgtttaggtaacgtttaaggtttaacgtttttaccgaaaccgttttaaaccgtttaaccttttaaccgtacccggtaaaccccttaaaaccttaaactttaaacttaaacctttaccgttaaattttaacccggtttccccgttaaccccggttaccccgtttaacgtttttacccccggggaccccggttaacggggtaaacccctaaacgggttaccgttaaaacgggtaacctttaaccgggttaacccgggtaaaccggtacggttacgggtacggtacgtaccgtacccgtaacttaacttttcgggtacctttcgttaaccccg

SEQ ID NO: 179955 - DNA, 636 bp, Homo sapiens
  misc_feature: GYAE6OF01D18ET.52.14.B03.1.454.CMB.1.raw
  modified_base (256)..(256): a, c, t, g, unknown or other
  misc_feature (256)..(256): n is a, c, g, or t
  modified_base (399)..(399): a, c, t, g, unknown or other
  misc_feature (399)..(399): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatcgacccagtcctcccttccaccctgtctgcatctgtaggagacagagtcaccatcacgttgcccgggccagtcagaatattaatagtggtgctggtatnagcagataccgaggaaacgacccctaaactcctagatctaagtaaggtcgttacgttaagtttaggaaacggttcggggtacccttacgtaaggttcaggcggctaggtgatcgtggactagtaattcactctcacatcaacncgcctgcacgctagattgtactttgacttaattacttacacgtacctaactaacttataaacttctaactttacttccgtaccgggttaccctaccggttttcccggaccccgttacgggtaacctaacgtaccgtaagtaacgttaacggtaccgggttaaacggtaaccgttgggttacggtaccgttaccgtaccctaaacccgttacctttccgtacggtttccctttaaccg

SEQ ID NO: 179956 - DNA, 195 bp, Homo sapiens; identical to SEQ ID NO: 179939
  misc_feature: GYAE6OF01AL3BG.52.14.B03.1.454.CMB.1.raw
  modified_base (192)..(195): a, c, t, g, unknown or other
  misc_feature (192)..(195): n is a, c, g, or t

SEQ ID NO: 179957 - DNA, 685 bp, Homo sapiens
  misc_feature: GYAE6OF01EO1P5.52.14.B03.1.454.CMB.1.raw
  modified_base (258)..(258): a, c, t, g, unknown or other
  misc_feature (258)..(258): n is a, c, g, or t
tcagcgcagtacgacacgaccggtgctcgatttagtgtgagtagttccgcggggggagtcagacccagtcaggacacagcatggacatgagggtccccgctcagctcctgggctcctgctgctctggcctcccaggtgccaaatgtgacatccagatcgacccagtccttcccttccaccctgtctgcatcgtggtaggagacagagtcaccatcactgccgggcagtcagtaatattaataggtggtcgcgtgtatnagcagactaaccgaagggaaaccgcccctaaactcctgactctaagtagcgttagttaagttaagaaggttcgggttacccttagtaacggttcgaggcggacgtaggtcgagtcggtaggaactagtaacttcaaccttcgaccacctataccaacgtacgccgttcgaccgtcgccgttaggtatttacgttacgttttacgtaacttaaccgttttaacgttacctaaccgtaaccctaaacctaacttaacttaacttacttaattttaccgttacccgtcccgggttacccttaccggttttaccccggcccgtaccgggtaaccgtaacggtaccttacggtaacgttacggtaccggtaacggtacgttcgggtacggtaccgttcgtaccctacgtacttcgttccgttccgttaaccg

SEQ ID NO: 179958 - DNA, 571 bp, Homo sapiens
  misc_feature: GYAE6OF01BR7N6.52.14.B03.1.454.CMB.1.raw
  modified_base (196)..(196): a, c, t, g, unknown or other
  misc_feature (196)..(196): n is a, c, g, or t
  modified_base (424)..(424): a, c, t, g, unknown or other
  misc_feature (424)..(424): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatcgacccagtctccttccaccctgtctgcatctgtagganacagatcacatcacttgccggcagtcagaatataatagtgtgctggtatcagcagataccgaaggaacgacccctaaatcctagatactagtaacggcgttactagtttaagaaaggttcggggtacccttagaacggttcaggcgactaggtggatcgtaggacagtaattcactcacactatacaacagcctagcagcctgactgtatttgacttaattacttacncgaccctaatacttaataactactaatttacttccgtcccggtaccttaaccgtttccgggaccctagggaaccctaagtaccgtagtaacgtacgtaccgggaactaacgtggtcgactcgacctaaccgtattctcgttcttacc

SEQ ID NO: 179959 - DNA, 575 bp, Homo sapiens
  misc_feature: GYAE6OF01CIU2R.52.14.B03.1.454.CMB.1.raw
  modified_base (275)..(275): a, c, t, g, unknown or other
  misc_feature (275)..(275): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagaatattaataagtggttgcctggtatcagcagataaccgagggaaacnccccctaaatcctagattactataacggtcgtacgttaagtttaggaaaggttcggggtcccttacgaaggttcaggcggcagtggatcgaggacagtaattcactctcaaccatacaacacgcctagcacgctgatgtattttcgacttaactttattactacgacctaactactaattaactactaatttacttccgtacccggtccttaccgtttccggccttacgggacctaagtcgtagacttacgtccggaataacgtcggtagtcctcgaccacctattccgttgtccttacg

SEQ ID NO: 179960 - DNA, 582 bp, Homo sapiens
  misc_feature: GYAE6OF01BLNJI.52.14.B03.1.454.CMB.1.raw
  modified_base (264)..(264): a, c, t, g, unknown or other
  misc_feature (264)..(264): n is a, c, g, or t
  modified_base (382)..(382): a, c, t, g, unknown or other
  misc_feature (382)..(382): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttcaccctgtctgcatctgtaggagacagagtcacatcacttgccggcagtcagatatatagtgtgctggtatcgagcagataccgagggaaacncccctaaactccgtagatactaagtaggtcgttactaaggtttagaaaggttcggggtacccttacgaaggttcaggcggacaggtggatcgtggacagtaattcactctacacctanacaacagcctgcagtcctagatggtatttcgactaactttatacctagacctaactacttaataacttctaatttacttccgtcccggtaccttacgtttacccggcgtaccgggaaccacggtactaaggactacgtccgggtaacgaacgttggtacggtctacggtacctaaccgtagtttccttgttcctttaccg

SEQ ID NO: 179961 - DNA, 677 bp, Homo sapiens
  misc_feature: GYAE6OF01B9Y7F.52.14.B03.1.454.CMB.1.raw
  modified_base (253)..(253): a, c, t, g, unknown or other
  misc_feature (253)..(253): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtcctccttccaccctgtctgcatctggtaggagacagagtcaaccatcacttgccgggcagtcagtaatattaatagtggtgctgtatnagcagataccgaagggaacgacccctaaactctagtactacgtaagtaacggtcgtacgttaagtttaaggaaaggttcggggttacccttacgtaacggttcgaaggtccggacgtaggtggtagtacgtagggaactaaggtaacttccaacgttccttaccgaacctacttaaccaaccgacggtaccctggacccgaagtcccgtagtaattgttaattttcgaacttaacgtttatttaacgtaccgaaccctaaactaacttaattaacctacttaagtttaaccttcccgtaccccgggtccttaaccggttttcccgggaccccgttacgggaacccaaggtacgtaagtacgttaacgtaccggtaacgtaacggtcggtaggaccttcgaccctactacgtcgttcgttctacc

SEQ ID NO: 179962 - DNA, 694 bp, Homo sapiens
  misc_feature: GYAE6OF01D39AI.52.14.B03.1.454.CMB.1.raw
  modified_base (277)..(277): a, c, t, g, unknown or other
  misc_feature (277)..(277): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttcgccgggccagtcagtaatattaataaggtggttgctggtatcagcagataccgagggaaacncccctaaactcctagatactaagtaacggtcgttactaaggtttaaggaaacggttcggggttaccccttagaaacggttcgaacggccggacgtaggtggtacgtcgtaggggaactaagtaacttcctaacgtacctccaacccgtataccaaaccgacgtcccgtagacctacgtcctaggtattgttaattttcgaaccttaacttttacttaccgtacgaaccctaaactaccttaaataaccttacttaattttacctttcccgtaccccgggttacccttacccggttttcccgggaccccggttacgggaaaccctaacgtaccgttaagaacgttaccggtaccgggtaacgtaacgttcgggtaccggcttacggacctaaccctagttccgttcggttcttacccg

SEQ ID NO: 179963 - DNA, 767 bp, Homo sapiens
  misc_feature: GYAE6OF01A4G5A.52.14.B03.1.454.CMB.1.raw
  modified_base (197)..(197): a, c, t, g, unknown or other
  misc_feature (197)..(197): n is a, c, g, or t
tcagcgcagtacgacacgaccggtgctcgatttagtgtgagtagttccgcgggggggagtcagacccagtcaggacacagcatggacatgagggtccccgctcagctccgtggggctcctgctgctctggctccaggtgccaaatgtgacatccagatgacccagtcctccttccaccctgtctgcatctgtagganacagacgtccaccatccacttcggcccgggccagtcagtaatattaaataggtggttggcctggtatcagcaagtataccgaaggggaaacgccccctaaactcctagtactacttaagtaacggtcgttacttaaggtttaagtaacggttcgggggttacccctttacgtaacggtttcgaggaccggcgtaggtcggtacgtcggtacggggtaacagtaactttcacgttccaccaccctataccaaaccgtacgtacccttcggacctaacggtcccgttagagttagttacgtttttaacggaacccttaacgttttaactttaaccgttacctaaacccctaacttaaaccgtttaactttaaacgtttaactttaaacgttttaccgtttcccggtacccccggttacccgtttaacccgttttcccgggttaaccccgttacggggaaccctaacgttaccgttaggtaacctttacggaacccggtaacggtacggttacggttacgggtcctttaacggacccctaccttaaccttccggttccgtttccgttaacccg

SEQ ID NO: 179964 - DNA, 502 bp, Homo sapiens
  misc_feature: GYAE6OF01D3WE2.52.14.B03.1.454.CMB.1.raw
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
tcagcgcagtacgacacgaccggtgctcgatttagtgtgagtagttccgcggggggagtcagacccagtcaggacacagcatggacatgagggtccccgctcagctcctggggcctcctgctgctctggctcccaggtgccaaatgtgacatccagatgacccagtctccctcaccctgtctgcatctgtaggagacagagtcaccatcactgccggcagtcagaatataatagtggttgctggtatcagcagataccgaggaaacacccctaaatccctagatactagtaaggtctacttaggtttaagaaggttcgggttacccttagaagttcgagcggctagtggactgtaggacagtaatcactctacaccatccaacgtcgcctgacncgtctagattgtatttgactactatcngacaactatanatntaattctcncgtccacgtttcgcngactacgntagattacgcgtacatgcgtcagcacntcntctcc

SEQ ID NO: 179965 - DNA, 515 bp, Homo sapiens
  misc_feature: GYAE6OF01BYQKN.52.14.B03.1.454.CMB.1.raw
  modified_base (265)..(265): a, c, t, g, unknown or other
  misc_feature (265)..(265): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtacggagacagagtcaccatcacttgccggccagtcagatatatagtgtgctgtatcagcagataccgagggaacncccctaaatcctgatctataggcgtctagttagaagtcgggtccttnaaggttcagcgnagtgatcgtggacagattcactctcacatcaacacgcctgcagcctagatgtatttgacttaacttattactcgaccaactatataatactatttattccgtaccgtcctacgtttccgccctagggacctaagtctagatacgtaccggtagacgtgtcggcctcgtaccacctatccgttgtccgttac

SEQ ID NO: 179966 - DNA, 558 bp, Homo sapiens
  misc_feature: GYAE6OF01CCG53.52.14.B03.1.454.CMB.1.raw
  modified_base (316)..(316): a, c, t, g, unknown or other
  misc_feature (316)..(316): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgcggcagtcagaatataataagtggttgctggtatcagcagataccgaggaaacgcccctaaatcctagatctataagcgtactagtttagaaagtgggtccctnaaggttcagcggcagtgatcgtaggacagaattcactctacaccatcaactagcctgcagcctgatgtatttgctaactttattactgacctaacgacttaataacgtctaattacgtttccgtacccgggtccctaccgtttaccggtccccgttagggaacccaaggtcctaaaggtaattaacgtccgggtaacaaacgttcggtaggccttacgcctacccattcttcgtctttaccg

SEQ ID NO: 179967 - DNA, 745 bp, Homo sapiens
  misc_feature: GYAE6OF01BKUEJ.52.14.B03.1.454.CMB.1.raw
  modified_base (582)..(582): a, c, t, g, unknown or other
  misc_feature (582)..(582): n is a, c, g, or t
tcagcgcagtacgacacgaccggtgctcgatttagtgtgagtagttccgcgggggggagtcagacccagtcaggacacagcatggacatgagggtccccgctcagctcctggggcctcctgctgctctggctcccgaggtgaccaaatgtgacatccagatcgacccagtcctcccttccaccctgtctgcatcgtggtaggagacgagacgtaccaccatctacgttccggccggcagtacaagtaattaattaagtaggtggttgccgtggtactcagcagaactaaccggaagggaacctacccctaacgtccgtagacttacgtaagtacggtcgttaagttaaggttaacggtaacgggttcgggttaccccttaaggtaacggttcgaacgggtccggtacgtaaggtacgtacgttacgggtacgggaaactaacggttaacttcccgtaacgtaccctacaacccgtaacgtaccaaacggtccgtaccgtacgaccgacgtccgttaagtacgttagttaactttcaaacgtttaccttttataccgtacaaccctaataacttataaccttnttaacttaccttccggacccgttacccttacggttccccgggtacccgtaacgggaaccttaacggtacgttaacgtaacgttcgggtaaccggtaaccgttaggtcggttccgtaacgtacccgtacgttaaccctaggtttccttcggtccctttaacccg

SEQ ID NO: 179968 - DNA, 770 bp, Homo sapiens
  misc_feature: GYAE6OF01CY5RE.52.14.B03.1.454.CMB.1.raw
  modified_base (750)..(750): a, c, t, g, unknown or other
  misc_feature (750)..(750): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggcctcccaggtgaccaaatgtgacatccagatcgaccctagtcctcccttccaccctgtctcgctatcgtaggtaggacgacagagtccaacctatccacgttcggcccgggacagtcaagtaattaattaagtaaggtggttacggtccgtaggtactcgagacgagaactaaccgaacgggaaacctaccccttaaactcctagtatacgtagtaacggtcgttaacgttaggtttaacggtaacgggtcgggttacccttaggtaacggttacgacggcggtacgtaggtacggtacttacgggtacggtaactaaggtaacttacccgtaaccttcctaaccgtaaaccctaactaacccgaaaccgtaccgtacccgtacgccgtaaccgtaccgttagggtaactttacgttaacttttacggtaacccttaaacgttttaccttaacccggtaaccaaccctaaaccttacttaaacgttaactacgttttaactaaccgtttccccgtaccggtaccctttaccgggtttaccccggaccggttacgggaaacccttaggacctaagtactacggtacggaacgtacggttggacgtacgtcgaacccgtactntttccgtgttacccttaccg

SEQ ID NO: 179969 - DNA, 594 bp, Homo sapiens
  misc_feature: GYAE6OF01CF1QT.52.14.B03.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagaatattanagtgttgctggtatcagcagataccgagggaaacncccctaaactcctagatctataacggcgtntagtttaagaaggttcgggtcccttagaaggttcaggcggacgtaggtacggatcggtagggactaggtaattcactcgtacaccatacaacngcctgcacgtcctagnttagttatttacgacttaacttattactacgaccaactaacgttaataacttacgttaatttaccgttacccgttacccggtccttaaccgtttcccggaccgtacgggaacctacggtactaagtacgtacgtaccggaagaacgttcggacgtcgtacgaccacctattcttcgttccttacccg

SEQ ID NO: 179970 - DNA, 788 bp, Homo sapiens
  misc_feature: GYAE6OF01CWFDW.52.14.B03.1.454.CMB.1.raw
  modified_base (762)..(762): a, c, t, g, unknown or other
  misc_feature (762)..(762): n is a, c, g, or t
tcagcgcagtacgacacgaccggtgctcgatttagtgtgagtagttccggcggggggagtcagacccagtcaggacacagcatggacatggacgggtcccccgctcagctccgtggggcctcctgctgctctggcctcccgaggtcgacctaaattgtacgaacctactcccaagtactacgacccctagttccctcccttcccacccttgtcctgctacttcgtaggtaaggacgacgagacgtaccaacctataccgtaccgttcggcccgggtacctacgtacaagtaattaagttaacgttaggtggttacggtccgttaggtacgtacacggacgtaacgtaacgtaaccggaaacggggtaaaccctacccctaaactccgtagtacttaacgtacgtacggtacgttagttaaaggttaacggtaacggtttcggttacccttagtaacggtacgacggcggtacgtaggtacggtacgttacggaacgggtactaaacgttactacctaccgttacctacccgtaactaactacccgaaccgtacgtccgtacgtacccgacgtcctagttacgtttagttacttacgtaactttaacgtttactaccgtacgaaccttaacgttaacttaacttaacttaccgtttaatttacccctacccgttacccgttacccgttaccccggttacgggtacccgtacggaaccttacgtaccgtaagttacgtacgtaccggaactcggtcgacgtacnctaccgtactgtacctgttcttaccg

SEQ ID NO: 179971 - DNA, 732 bp, Homo sapiens
  misc_feature: GYAE6OF01AJH8C.52.14.B03.1.454.CMB.1.raw
  modified_base (253)..(253): a, c, t, g, unknown or other
  misc_feature (253)..(253): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagacgtcaccatcacttgccggcagtcagaatattaatagtggtgctgtatcagnagatacgacggaaccgaccctaactctagatactaagtacgtcgtacgttaaggttaacggtaacggttccgggttacccttacgtaacggttcgacggtccggtacgtaaggtcggtacgttacgggtagggtaactaacggttaacttacctaccgtcctaccaacccgtacttaaccgaacctccgtaccgttacgaccgtaaccgtccgtaaggttacgttacgtttacgttttacgaacccttaattttcgtaacccgtacgtaaccctaaacgttacttaataaacttaccgttaacttttaccgtcccgtacccggttaccctttaccggtttacccggacccggttacgggaaacccgttaacggtacgttaacgaacgtttacccggaaccggttaagtaacccgttgggtaacccgtcgtaaccctaccgtaacccgtttattacccggtttcgttacccgtttacccg

SEQ ID NO: 179972 - DNA, 866 bp, Homo sapiens
  misc_feature: GYAE6OF01DCMW0.52.14.B03.1.454.CMB.1.raw
  modified_base (174)..(174): a, c, t, g, unknown or other
  misc_feature (174)..(174): n is a, c, g, or t
tcagcgcagtacgacacgaccggtgctcgatttagtgtgagtagttccggcgggggggagtcagacccagtcaggacacagcatggacatggacgggtccccgctcagctccgtggggcctcctgctgctctggcctcccaggtcgacaaatgtgacatccagactcgaacccngttccttcccttcccgaccctcgtctgctagttcgtaggtaggagtacgagacgtccaaccatcctacgttcgggacccgggaccagtaccaagtaattaattaaagtaggttggttcggaccgtggtaactcaagaccaagtaacgtaacccggaacgggaaaccctacccccgtaaaccgttccgtagtaacgttaccgttaaggtacggttaccgtttaacggtttaaggtttaacggtaaacgggtttccgggtttaccccggtttaacggtaacggtttaccggacgggtaccggtacgttagggtaggtacgttacggtacggggaactaacggtaacttccgacctacctaaccacctaacgtaacaaacccgtgtacccgtacgacccggacgttaccggttagttacgtttaacggttacgttttaacaacccggttttaacttttaaccgttacccgtaccgtaaaccctaacgttaaacttaacgtttaacctttacgttaacctttaccgttaacccccggttccgtaacccctttacccgggttaccccggttaccggtaaccggtacgtaacggtaccgttacggtaaccgtttaccggtaaccgggtaacggttaacggttcggaccgggttcccaacgttaccctacttagttccgtttcgttccccgttaaaccg

SEQ ID NO: 179973 - DNA, 756 bp, Homo sapiens
  misc_feature: GYAE6OF01BYISI.52.14.B03.1.454.CMB.1.raw
  modified_base (727)..(727): a, c, t, g, unknown or other
  misc_feature (727)..(727): n is a, c, g, or t
tcagcgcagtacgacacgaccggtgctcgatttagtgtgagtagttccgcgggggggagtcagacccagtcaggacacagcatggacatggacgggtccccgctcagctccgtggggcctcctgctgctctggctccgaggtcgacctaaatgtcgactactccgagactcgaaccctcgttccctcccttcccacccttgtctgctattcgtaggtaggacacagactccacatcgacgtcggccggacagtacaagtaattaatttaaagtaggttgggttcggtaccgttaggtactccgaaggacaacgaacctaaccggaacgggaaaccctacccccttaaaattcccgtagtacttacgttaacggtaacggtcgtttacgttaaaggtttaacggaacgggttcccgggttaccctttaacgggtaacggttcgacgggtacggtacgtaaggttcggtacgttacgggtaacgggaactaaacgttaaaccttccgtaaccttacctacccaaccgtaacgtaaccgaacgacggtccctacgggacctacggtcttaaggtattacgttaacgtttacaaccttaatttactaccgtaaccaaccttaaattacttaattaccgttactttattaccgttccgacccgttccttaccgttccgaccgtacgaacctagtacctagtacgtaccgtacgaacgtcgtcggacgtaccncgtacccttactgtccgttcgtcttaccg

SEQ ID NO: 179974 - DNA, 822 bp, Homo sapiens
  misc_feature: GYAE6OF01A4355.52.14.B03.1.454.CMB.1.raw
  modified_base (166)..(166): a, c, t, g, unknown or other
  misc_feature (166)..(166): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggcctcccgaggtgccaaatgtgacatccagatcgacccngtctcccttccaccctgtctgctatccgtgtaggagacagtacgtaccacctactctacgttcggaccggacctacgtacaagtaaattaagttaaagtaaggttggttacggtccgttagggtactaccgacgtacgaacgtaacgaaccggtaaaacgggtaacccgtaacccccttaaacgtccgtacgtaacttaaccgttaacggtaacggttccgttaacggttttaaggtttaaacgggtaaacgggtttccgggttaaccccgtttaaggtaaccggtttacgaacgggcgggtactagggtcggtacgttacggagggtaactacggtaaccttacctaaccgttccaacgtaacctaacgtaccgaacgttacgaccttaggacctaccgtacggtacgttaagttaggttacgtttaccgtaaacttaaccgtttaccttaactaccgaaaccctaacttaaccttaaatacctttaacgttaacctttaaccgttaccccggttacccgttaccccgttaacggttttccccgggacccggttacgaaaccggtactaaccggaagttaccgtaaaccgggtaccgtaacggtacgttcgtaacgtccaacgtaccacgttacgttccttaccgttcttacccg

SEQ ID NO: 179975 - DNA, 710 bp, Homo sapiens
  misc_feature: GYAE6OF01E5KTE.52.14.B03.1.454.CMB.1.raw
  modified_base (445)..(445): a, c, t, g, unknown or other
  misc_feature (445)..(445): n is a, c, g, or t
tcagcgcagtacgacacgaccggtgctcgatttagtgtgagtagttccggcgggggggagtcagacccagtcaggacacagcatggacatggagggtcccccgctcagctccgtggggcctcctgctgctcgtggcctccgaggtcgaccaagtgtagacactaccgagactaccgaccctacgttcccttcccttcccacccgttgtctcgactagtcgtaggtacggacgacgagtacgtaccactactccgtacggtccgggccggtacctagtactaaagttaatttaaagttaacggttagggttcggtcgaccgttaggtactacgagacgacgaaccgaaccggaacggtacccctaccctaactcgtagtactataaggtacgtacgttacggttaagttacggtacggttccgtactagtacgcgaggcgtgtagngtactcgggagtatacgtacctacctcacctacactacaccgacgcgtcgcgtacgaccgtagtcgttagttacgtttacttaacgttaactacttactaccgtaactaaccgttaactattaactacttactttaccgtaccttcccgtacccgttaccgttacccggtacccggtacgtaccgacctagtacgttacgacgggttacgtaacggtacgacgtcgaccgtcgtaccactacctagttccgttcctaccttcccg

SEQ ID NO: 179976 - DNA, 638 bp, Homo sapiens
  misc_feature: GYAE6OF01EABX9.52.14.B03.1.454.CMB.1.raw
  modified_base (477)..(477): a, c, t, g, unknown or other
  misc_feature (477)..(477): n is a, c, g, or t
  modified_base (626)..(626): a, c, t, g, unknown or other
  misc_feature (626)..(626): n is a, c, g, or t
tcagcgcagtacgacacgaccggtgctcgatttagtgtgagtagttccgcgggggggagtcagacccagtcaggacacagcatggacatgagggtcccccgctcagctcctggggcctcctgctgctctggcctcccgaggtgaccaaatgtgacatccagatcgacccagtccttccttacccaccctgtctcgcatcgtaggtaggaagacgagacgtacaccatcctacgttcggaccggaccagtacaagtaataattaagtaggttggttcgtcgtaggtatcagcaagacgtaaccgaaggaaacctaccctaactctagtaatacgttaagtacggtaccgttagttaagttaacggtaacggttcgggttacccttacgtaacggttccgaggtcggacgtaggtcggtagtcggtacgggataaggtacttacacctctacctaaccaataccaaccgacgaccgtanaccgacgtccgttagacttagttaagtttacaccttaacttactacttacgaactaactattactaatactattactccgtaccgtcttacgtccgactacgaactagtactagtacgttacgacgacgttagtggtcgtcactcactnttcttctcttcc

SEQ ID NO: 179977 - DNA, 596 bp, Homo sapiens
  misc_feature: GYAE6OF01BYD3T.52.14.B03.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (383)..(383): a, c, t, g, unknown or other
  misc_feature (383)..(383): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatataanagtgttggcctggtatcagcagataccagggaaacncccctaaatcctgatctataaggcgtctaagtttagaaagttcggggtacccttgaaggttcaagcggcagtggatcgtgggacaggaacttcaactctacaccataccaanacgcctgcagcctgactgtatttgactaacttattactcgaccaactacttaataactctaatttacttccgtacccggtaccctaccgttttcccggaccccgttaggggaaccctaaggtaccgttaacgtaacgtacgttaccgggaacgtaacgttcgggtaggtaccgtcggtacctaacccgtaattccgtttggttcccttaaccg

SEQ ID NO: 179978 - DNA, 646 bp, Homo sapiens
  misc_feature: GYAE6OF01CS8UZ.52.14.B03.1.454.CMB.1.raw
  modified_base (515)..(515): a, c, t, g, unknown or other
  misc_feature (515)..(515): n is a, c, g, or t
tcagcgcagtacgacacgaccggtgctcgatttagtgtgagtagttccgcggggggagtcagacccagtcaggacacagcatggacatgagggtcccgctcagctcctggggctcctgctgctctggctcccaggtgccaaatgtgacatccagatgacccagtctccttccaccctgtctgcatctgtaggagactagacgtcacatcacttggccgggcagtcaagaatattaagtaaggtggttggcctaggtatcagacaagactaaccgaagggaaacgaccccctaaaactcccgtagactactaagtaacggtcgttacttaaggtttaaggaaaacgggttccgggggttaccccttacggtaaacgggtttaccaaggtaccgggtagtaacggttagggaacttcgggtaacggggaactaaggtaacgttcctaacgtctaccaaccgtagtaccaaacgtacgccgtagacacggtcctagattgtatttacgactaactttntactcgaacctaactaactataactactaacgttactccgtaccgtaccttacgttccgtacccgtaggaaccagtccgatatacggtacggaactacgtggtcgactcgacacttattcctgttccttcg

SEQ ID NO: 179979 - DNA, 197 bp, Homo sapiens
  misc_feature: GYAE6OF01E1C1P.52.14.B03.1.454.CMB.1.raw
  modified_base (192)..(197): a, c, t, g, unknown or other
  misc_feature (192)..(197): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnnn

SEQ ID NO: 179980 - DNA, 818 bp, Homo sapiens
  misc_feature: GYAE6OF01BREIQ.52.14.B03.1.454.CMB.1.raw
  modified_base (233)..(233): a, c, t, g, unknown or other
  misc_feature (233)..(233): n is a, c, g, or t
  modified_base (804)..(804): a, c, t, g, unknown or other
  misc_feature (804)..(804): n is a, c, g, or t
tcagcgcagtacgacacgaccggtgctcgatttagtgtgagtagttccggcggggggagtcagacccagtcaggacacagcatggacatgacgggtccccgctcagcctccgtggggctcctgctgctctggcctccgaggtcgaccaaatgtgaactactccaagactacgaccctacgttccttacccttacccaccccgttgtccgtcgctacgttcgttaggaacgganacgaggactaccaacctataccgtacgttcgggacccggacctagtacaagtaatttaaagttaagttaggtcgggttacggtccgttaggtactcgagacgtaacgtaacgtaaccggaacggggtaaacccctaccccgttaaacttaccgtacgtactaacgttaacgtacgggtacgtttaacgtttaaaggtttaacggaacgggtttccgggttaccttacggtacggttaccgaagggtccgtacggtacggtaggttacgtacgggtacggtaacacggttaacttccgaacttcgaacccaacgtactaaccaccgtacgtccgtaacgtaccgacgttccgttagtacgtttaagtttacgtttacgtaaacctttaacttttaccgtaccgttaactaacccaacgttaacttaacgttaacttacggttactttaacccggttccgtacccggtacccttacccggtttacggacccggtacgtaaccgtagacgttaccgtaggtccgtaacggttacgaggttccggtacgtcgaccgtaccgtaccttacgtttcncccgttcttacccg

SEQ ID NO: 179981 - DNA, 795 bp, Homo sapiens
  misc_feature: GYAE6OF01CSR39.52.14.B03.1.454.CMB.1.raw
tcagcgcagtacgacacgaccggtgctcgatttagtgtgagtagttccggcgggggggagtcagacccagtcaggacacagcagtggacatggacgggtccccgctcagctccgtggggctcctgctgctctggcctcccgaggtcaccaaatgtgacatccagatcgaccctagttcctcccttcccaccctgtcctgctatcgtggtaggagacagacgtcaccatctacgttcggcccggcagtcaagtaattaagttagtaaggttggttacggccttaggtactcagcaagtaacgtaccggaacggtaacccaccccttaaactccgtagacttactagtaacggtcttacgttaaggtttaaggaacgggtttccgggttacccttaggtaacggttcgacgggacggtacgtaggtacgtacgtcgggtaacgggaactaacggttacttaccgtaacctcgtaaccaaacctacgtaaccaaacgtccgttaccgtacggacctacggtaccttgtaacgtttcggttaactttacggtaaccctttaaagtttacccgttaccgaccgtaaaccctaagtttaaacccttaagtttaacctacgttttaaacttacccggtttccccggacccggtttacccgtttaacccggtttaccccggacccggtttaacggggaacctaaacggttaccgttaaaggaccgttaaaccggtccgggaaaccttagggtccgtcggtactcggtaccctaacggttttcccgtttgttccccgttaaacc

SEQ ID NO: 179982 - DNA, 204 bp, Homo sapiens
  misc_feature: GYAE6OF01BWOYB.52.14.B03.1.454.CMB.1.raw
  modified_base (186)..(186): a, c, t, g, unknown or other
  misc_feature (186)..(186): n is a, c, g, or t
  modified_base (192)..(204): a, c, t, g, unknown or other
  misc_feature (192)..(204): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagccggccctgggctgcctggtcaaggactacttcctatacgatcgctgagcggctggcaaggcncatagnnnnnnnnnnnnn

SEQ ID NO: 179983 - DNA, 783 bp, Homo sapiens
  misc_feature: GYAE6OF01DT81T.52.14.B03.1.454.CMB.1.raw
  modified_base (189)..(189): a, c, t, g, unknown or other
  misc_feature (189)..(189): n is a, c, g, or t
tcagcgcagtacgacacgaccggtgctcgatttagtgtgagtagttccgcgggggagtcagacccagtcaggacacagcatggacatgagggtcccccgctcagctcctgggctcctgctgctctggcctcccaggtgaccaaatgtgacatccagatcgaccctagtcctccctccaccctgtctgcntctagtaggagacagtacgtaccaccataccgtacgttcggacccgggaccaggtacaagtaattaacttaagtaacggtaggttcggcccgttaggtaacttcgacggactaacggtaacgtaacccggaaacggggtaaaaccctcccccccgttaaaaacgtcccttaagtaaccgttaacgttaaggtaaaccgggtcccgtttaacgttaaaggttttaaacgggtaaacgggttccggggttacccccttaaggtaaccggtttaccggcggtacgggtccgttaagggtcggtacttccgggaaggtaaccgaagttacgtaccctaccgtcccgtaacccaacccttaacgtaccgtaaaccgtccgtaccgtcgacccgtagtcccgtaaggtagttcgttaacgtttagaacccttaacgtttatacccgttacgaccctaaacgtattaacctaactctaagtttccacccgttccgaccttccgttccgacccgtaccggaattccggactaaggtagtaccggtaccgtaactcggtcgtaccgtactacgtacccgtatacctccgttcgttctaccccg

SEQ ID NO: 179984 - DNA, 750 bp, Homo sapiens
  misc_feature: GYAE6OF01CEIBF.52.14.B03.1.454.CMB.1.raw
  modified_base (305)..(305): a, c, t, g, unknown or other
  misc_feature (305)..(305): n is a, c, g, or t
tcagcgcagtacgacacgaccggtgctcgatttagtgtgagtagttccgcgggggggagtcagacccagtcaggacacagcatggacatggacgggtccccgctcagctccgtggggctcctgctgctctggcctcccgaggtcgacctaaatggtgacactccgaagtataccgacccgtacgttcccttccccttcccacccgttgtctgctactcgttaggaacggagacgagtacgtcaacctatccgtcgttcggccggacagtacaagtaattaattagtaggtggttcggctaggtancgagcaagtacgaacgaacggaaccctaccctaactcgtagtacttactaaggtagtcgttaacgttaaggtttaacggtaacgggtttcccgggttaccttaagggtaaccggttaccggacggtaccgggtacgtaagggttcggacgtttacgggacggtaaacttaacgtaaccttacccgacttaccgtaacccgaacctaacgtaacgaaccgtccgtaccgtacggtaccgtacgtccgttagtagtttagtacgttttaccgaactttaccttaacttacgacctaacctaaccttaataacgtactacgttattacccgttcgtaccccgttaccgttaccgttaccggaccggtccgtaacgtacgttactaggtaactacggtaccgtaagtacggtcgtacgtcaccgtcgtaactgttctacttccttaccg

SEQ ID NO: 179985 - DNA, 826 bp, Homo sapiens
  misc_feature: GYAE6OF01ETBKT.52.14.B03.1.454.CMB.1.raw
tcagcgcagtacgacacgaccggtgctcgatttagtgtgagtagttccgcggggggagtcagacccagtcaggacacagcatggacatggacgggtccccgctcacgcctccgtggggcctcctgctgctctcggcctcccgaggtacacctaaagtgtacgaactactaccaagtacgtaccggaccctacgtttcccttccccttacccctacccgttgttccgtacgtctacgttcgtaaggtaggaacgacgtagtacgaccaccgtactccgtacgtccggccggtactacgtacgaagtaattaagttaagtaggttacggttcggtaccttaggtactcgtagaccgtaagtaaaccgtaaccggaaacggtaaaccctaccctaacgttcgagtaaccgtacgtaacgtacggttcgttaacgttaaggttaacgggtacgggtttaccggtcgttaacgggtaacgtcggacggtacggtacggtaggtacgtacgttacgggttaggaaactaacggtttacctccgttaaccgtccgtaaacccaacggtaactaaccggaccgggtaacccgtcgtaccgtaccgacctaccgttaagttacgtttagttacgtttaacaaccgtttaacctttaactaccgttaacctaaccctaagtacttaacttactacttacgttaaccgttcccgtaacccgtccgttacccggtcccgtaaccggtacgtacccgtaagtacgttacggactaacggttaccacgtaacggtcggacgtaccgaccgtactacgtacgttacttccgtcgttacccg

SEQ ID NO: 179986 - DNA, 802 bp, Homo sapiens
  misc_feature: GYAE6OF01BDVJG.52.14.B03.1.454.CMB.1.raw
  modified_base (101)..(101): a, c, t, g, unknown or other
  misc_feature (101)..(101): n is a, c, g, or t
  modified_base (134)..(134): a, c, t, g, unknown or other
  misc_feature (134)..(134): n is a, c, g, or t
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (496)..(496): a, c, t, g, unknown or other
  misc_feature (496)..(496): n is a, c, g, or t
  modified_base (703)..(703): a, c, t, g, unknown or other
  misc_feature (703)..(703): n is a, c, g, or t
tcagcgcagtacgacacgaccggtgctcgatttagtgtgagtagttccgcggggggagtcagacccagtcaggacacagcatggacatgacgggtccccgntcagctccgtggggctctgctgctctggctccngtgccaatgtagacatccagtatcgaccagtcctcctccacctgtactgctatcgtaggtaganacagacgtcactatcctagtcggccggcacgtanagtaatagttaagtaggttgttcggacttggtactcgacganaacgtacgtaaccggaacgggaaacctacccctaaaacgtcccgtaggtacttacctaagggtaaccggtacgttacgttaaggtttaaacggtaacggggtttccggtacccctttaacggaaaggtttccggacgggaccggtaacgtacggttaggtaccttacgggttacggggaactaacgggtaactttccgtaacctacccggttacctaaaccncgttaaaccgaaccgtacccgggtacccttacgggaacccttacggtacccgttagggttaaccgtttacgttaggttttaaccaacgtttaacctttaacgttaccaaccggtaacctaacgttaacctaagtttaccttaactggtttaacccttaccggtaccggttacccgttaccggttcccggtaacgtacccgggttaanacggtacccgtagttacggaaccggttacggtaacggttacgtcgggttaaccggcttacgacgtaccccttaaggttcccttgtttaaccctaccggg

SEQ ID NO: 179987 - DNA, 601 bp, Homo sapiens
  misc_feature: GYAE6OF01AFMCI.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggtggcctggtatcagcagataccgaagggaaacgcccctaaaactcctagatctataaggtcgtacttaagtttaaggaaaggttcggggttacccttagtaaggttcaaggcggcaaggtggatcgtgggacagattcactctcacatcaacagcctgcagcctagactgtacttttgacctaactttattacctcgacccaaactacttaataacttactaatttaacgttcctacccgggtaccttaaccgttttccggaccccggttagggaaccctaagtctaacgtaacttacgtaccgggaacgtaaccgttggtacggtctacgacctaacctacttcgttgttccttaccg

SEQ ID NO: 179988 - DNA, 687 bp, Homo sapiens
  misc_feature: GYAE6OF01EOV9G.52.14.B03.1.454.CMB.1.raw
  modified_base (273)..(273): a, c, t, g, unknown or other
  misc_feature (273)..(273): n is a, c, g, or t
tcagcgcagtacgacacgaccggtgctcgatttagtgtgagtagttccggcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagaatattaatagtgttgctggtatcagcagataccgaagggaaaccncccctaaactcctagactctaagtaaggcgttacttaaggtttaaggaaaggttcggggtaccccttagaaaggttcaggtcggacgtagtggatcggtgggaactagtaaacttcactctaccaccataccaacgtagcctagaccgacgtccgtagtattgtaacttttagaccttaaactttactttaccgtacgtaccctaaacgtaacttaacttaaacttacgttaactttaaccgttacccgttccccggtaacccgttacccgtttcccgggacccccgtttacggggaacccgtaacgttaccgttaacggtaacgttaccggtaccgggtaaccgtaaccgttcggttacggtacccgttacggaccctaacccgttaacgttcctttacggtcctttaccccg

SEQ ID NO: 179989 - DNA, 736 bp, Homo sapiens
  misc_feature: GYAE6OF01C6XYH.52.14.B03.1.454.CMB.1.raw
  modified_base (138)..(138): a, c, t, g, unknown or other
  misc_feature (138)..(138): n is a, c, g, or t
  modified_base (281)..(281): a, c, t, g, unknown or other
  misc_feature (281)..(281): n is a, c, g, or t
  modified_base (472)..(472): a, c, t, g, unknown or other
  misc_feature (472)..(472): n is a, c, g, or t
tcagcgcagtacgacacgaccggtgctcgatttagtgtgagtagttccgcggggggagtcagacccagtcaggacacagcatggacatgagggtccccgctcagctccgtggggctcctgctgctctggctccaggtnccaaatgtgacatccagatcgacccagtctccttccaccctgtctgcatcgtggtaggagacagacgtcacctagtcaccgttggccgggactagtacaagtaataattaaagttaaggtggttggaccgtaggtatacgagngaagtactaacgaacggggtaaacctaccccgttaaaactccgtagaacgttacgtaaagtaacgggtcttacgttaaggtttaacggaagggtttccgggtacccttaggtaacgtcgacggtgcgtaaggtggaactggagggtacaagtacgttctaacgtctaaccgaactaacgtacctaaacgcnccgtacaccgtacgtaccgtagtagttacggttactttacgaaccgtttaactttacgtttaaccgaaccgtaacctaacttaaactaattaactaacttacgtttaccttacccggtacccgtaccgtttaccgttacccgggtacccgttacgggaaccctaaggttacgaaacggtacgtaaccggtaaccggtaacgtaacggttcggtaccggcgttaccggtaccttaaccggactttcgttccgttactttacccgg

SEQ ID NO: 179990 - DNA, 921 bp, Homo sapiens
  misc_feature: GYAE6OF01AIX6O.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatcgacccagtcctcccttccaccctgtctgcatcgtagtaggacacagtacgtccaaccatccgacgttcggcccgggacctacggtacctaagtaaacttaagtttaaacgttaaagggttcgggtttcggtacccgttagggttaactccgtaacggaccgtaacggtaacgttaaacccggaaaacgggggtaaaaccccgtaacccccccttaaaaccttccccgttaaggtaaccgttaacccgttaaaaggtaaacggggttcccgtttaacgtttaaacgggttttaaacgggtaaaacggggttccgggggtttaacccccttacggtaaaacggggtttccgaacgggtccgggtacgtaacgggttggaacgttaccggtaacggggtaaacctaaacggttaaacctttcccgaacccgttccgttaacccaacccgtactaacccgtaacccgaccggtaccctcgggaaccctcggtacccgttaggtactttaacggttacgtttaacgtaaaccttaacgtttaaacttccaccgtaaccctaactaacgttaacttaactacttacgtttaccgttaccgtaccccggttaccttaccggttacccggtacccggtaacggtaaaccccgtaaggttccgttaaaacggtaacggttaaccggttccgggaaacgtttaacgggttcggttaccgtaccggttacgtaccccttaacggttaccttacggtttcgttaccctttacccg

SEQ ID NO: 179991 - DNA, 776 bp, Homo sapiens
  misc_feature: GYAE6OF01A3MBQ.52.14.B03.1.454.CMB.1.raw
  modified_base (141)..(141): a, c, t, g, unknown or other
  misc_feature (141)..(141): n is a, c, g, or t
  modified_base (214)..(214): a, c, t, g, unknown or other
  misc_feature (214)..(214): n is a, c, g, or t
  modified_base (472)..(472): a, c, t, g, unknown or other
  misc_feature (472)..(472): n is a, c, g, or t
tcagcgcagtacgacacgaccggtgctcgatttagtgtgagtagttccgcggggggagtcagacccagtcaggacacagcatggacatgacgggtccccgctcagctccgtggggctcctgctgctctggcctccgaggtnaccaatgtgacacgtccagactcgaccctagtccttcccttcccaccctgtctgctattctaggtaggacganacgacgtaccaccactctaccggttcggcccgggacctaagtacctaagtaatttaagttaaagttacgggttcggttcggtacccgttggtactaccgaaggacgtaaggtaaccgtaacgggtaaccggtaaaccccgttacccccgtaaacttacccgtaggtaacttacgttaacggtacggtaccgttttaagttaacggtttaacgggtaacgggttcgggttacccttacggtaaggttacgcgtaccggnggttaggtgtacgtcggtacggaactacggtacttccgacttaccaccgtacaacgttaccaccgtacgtccgtaggtccgacttacgttgtacgtacggtttactttacgaactttacgttacctttaccgactacccgtaactaacgtataacttcttaacttacttccggacccttaccgttacgttaccggtacccgtacggtactacgtaaacttcggtaaacctcggggttaccgaacttacggttacggtaccgtacgttaccgaccgttacgtccttacgttcgttcccttacccg

SEQ ID NO: 179992 - DNA, 813 bp, Homo sapiens
  misc_feature: GYAE6OF01D53V0.52.14.B03.1.454.CMB.1.raw
  modified_base (776)..(776): a, c, t, g, unknown or other
  misc_feature (776)..(776): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgaccaaatggtgacatccagatcgacccagtcctccttcccaccctgtctgcatctgtaggagacagagtccaccatcctacttcggcccgggaccagtacaagtaattattaaagtaaggttggttggccgttaggtatacgagaccaagtaactaaccgaacgggaaaccgtaccccctaaacgttccctagacttacgttaagtaacggtcgttacgttaaggtttaacggaacgggttcggggttaccctttacggtaagggttccgtaggccggtactaggtaggtacttcggtacgggtaacaagtaacgttactaccgtccctaccaacctaactaccaaactcggtcctacgacctaacgtcctaggtacttgttaattttacgactttaacgttttactacctaccgtacctaaacgtacttaacttaacgttcttaaacgttttaccttaccccggttacccccgggttaccctttaacccggttttacccccgggacccggttaacggggtaaccctaaacgggttaccgttaaccgggttaacggtttacccggaaccggggttaaacccgttacgggttaccgggttccgggtaacccgttacccggtaacccttaaaccccctnttttacccgggtttcccgtttaacccgtttaccccgg

SEQ ID NO: 179993 - DNA, 712 bp, Homo sapiens
  misc_feature: GYAE6OF01CSTEJ.52.14.B03.1.454.CMB.1.raw
  modified_base (162)..(162): a, c, t, g, unknown or other
  misc_feature (162)..(162): n is a, c, g, or t
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (409)..(409): a, c, t, g, unknown or other
  misc_feature (409)..(409): n is a, c, g, or t
tcagcgcagtacgacacgaccggtgctcgatttagtgtgagtagttccggcgggggggagtcagacccagtcaggacacagcatgggacagtgacgggtcccccgctcagctccgtggggctcctgctgctactggctccaggtgaccaaagtcgtagacanccgaaggtactccggaccctagttcctccccgttaccacccttgtctgactatccgtaggtaaggacgtacaggacaccaaccgtatcctacgtcggccggtaccagttanagtaattattaagaggttggtcggactggatacagacanaacgtacgaaggaacctacctaatctagacttagtaacgtacgtntacgttaagtttacggaacggttccgggtaccttggtaacggtcaggcggtntaaggtctaggtccgtaggactaagtacttctaccacttacaacctaggtaaccacggacctacgtacgaccgtacgtacgttagaagtttagttactttaacggtaaccttaacgggtttactaaccttaccgaaacttaacctaaattaactttaaaccgtacgttaacctttacggttacccgtaccgttaacccgtacccgtttacccggggcgtaaccggtaccgtaacgtaaccttagaacgtacggtaacgacgtaacgtgtaaccgctcgaacctacgtactcgttcgctttacg

SEQ ID NO: 179994 - DNA, 797 bp, Homo sapiens
  misc_feature: GYAE6OF01BZSBX.52.14.B03.1.454.CMB.1.raw
  modified_base (183)..(183): a, c, t, g, unknown or other
  misc_feature (183)..(183): n is a, c, g, or t
tcagcgcagtacgacacgaccggtgctcgatttagtgtgagtagttccgcggggggagtcagacccagtcaggacacagcatggacatgagggtcccgctcagctcctggggctcctgctgctctggctcccaggtgaccaaatgtgacatccagatgactctacgtcctcctacctaccgtntctgtacactcgtaggtagagacagcgtacacctactactacgtccggccgcgacgtacgtaagtaattacttaaggttaggttcggtcggtcgttaagtctacgacgacgacgtaacgtaaccggaacgggtaaccctacccctaacgtccgtagtaacgtacgtaaggtacgtaggtttacgttaagggttaaggtaccgggttcgttacccgtaagtacgtcggtacggacgtacgtggtacgtacgtacggtaacgggaactaggtacctaccgtaccgttactaacccgaccttaacgtacccgtaacggtaccgtacccgttacgacggtaacccgttacgttaacggtacgtttacggtttacgttaaccgttaacccgtttaactttaaaccgtaccggtaacctaactaaacgtacttaaactactttaacctttacgtttaccccgttacccggtaccccttacccggtttacccggttacccggtacccggaaccggttaaccgaacgtttccgaaaacggtttccgaacggttaccggtacggttaccggacggttcccggttaacgcccgtactaacccgtcgttaccttccgttaacccg

SEQ ID NO: 179995 - DNA, 773 bp, Homo sapiens
  misc_feature: GYAE6OF01EKBVW.52.14.B03.1.454.CMB.1.raw
  modified_base (160)..(160): a, c, t, g, unknown or other
  misc_feature (160)..(160): n is a, c, g, or t
tcagcgcagtacgacacgaccggtgctcgatttagtgtgagtagttccgcgggggagtcagacccagtcaggacacagcatggacatggagggtccccgctcagctccgtggggctcctgctgctctggcctcccgaggtgaccaaatggtgacatccanatcgaccctagttcctcccttccaccctgtctgactatctaggtaggagacgagacgtccacctatacctacgtcggcccggactagtacaagtaattaagttaaagtagggttggttcggtaccgttaggtacgtccgagtacgaagtaaccgtaaacccggaaacgggtaaaccccgtaacccccttaaaccgttacccgtagtaacttacgttaaggtaacggtaccggtttacgtttaaggtttaaacgggtaacgggtttaccggggttaccctttaacggtaaggtttaccgacgggtaccggaggtaggtacggtacttacgggtacggtaaaccgtaagttaacttaccaccgttacctacccgaactacgtaaccaacgtaccgtcctacggacgacgttccgtaggtattagttacgtttacgtaaccttaacgtttacttaccgacctaaccgtaactattaacgttattacttaacgtttacctcccgtccgttacccgttaccgttacccgggtaccgtacgaaccgtactagtagtaacctacgggtaccgtacgtaggtcgtacgtcgtactacctattacctctccgttcgtacccg

SEQ ID NO: 179996 - DNA, 770 bp, Homo sapiens
  misc_feature: GYAE6OF01EIW23.52.14.B03.1.454.CMB.1.raw
  modified_base (290)..(290): a, c, t, g, unknown or other
  misc_feature (290)..(290): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggcctcccaggtgaccaaatgtgacatccagatcgacccagtcctccttcccaccctgtctgcatctagtaggagacagatcaaccatcctacgttcggcccgggccagtacaagtaattaattaaagtaaggtgggtttacggtaccgtggttactacaggnaagaacgtaaccgaacgggaaaccgtaccccgttaaactcctagtactaccgtagtaacggtctttacgttaaggtttaagggtaacgttccgggttaccctttagtaaacggtttacgacggtccggtacgtaacggtggtaacttcgggtaacgggaactaacggtaaactttcccaacgttccctacccgtaacctaacgtaccaacccgaacgtcccgtacgaccgacgtccgtagttagttacgttatttgtaacccttaacgttttaacttacccggtacaaccctaaacgttaacctaatttaacttacttaacgttttaacccttccccggtaccgttaccccgttaaccgttcccggggtaacccttacgggaaccctaaacgttacggttaacgtaaggttaccggtaacggtaaccgtagtttcgggtcgaccgtgtaccccacgtaccttccgttaccgtcttacccg

SEQ ID NO: 179997 - DNA, 561 bp, Homo sapiens
  misc_feature: GYAE6OF01D4400.52.14.B03.1.454.CMB.1.raw
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
tcagcgcagtacgacacgaccggtgctcgatttagtgtgagtagttccgcggggggagtcagacccagtcaggacacagcatggacatgagggtcccccgctcagctcctggggctcctgctgctctggctcccaggtgaccaaatgtgacatccagatcgacccagtctcccttccaccctgtctgcatctgtaggagacagagtcaccatccacgttcggcccggccagtacagtaattattaataaggtggttggcctggtatcagcagataccgaagggaacacccctaaactcctgactcgtagtaaggtcgtacttaagtttaggaaggttcgggttacccttagtaggttcaggcggacgaggtgagtcgtaggacagtactcactcncacancaacgngctgcacgctgtatgttattcgactaacttactacncgtaacctactaatataactcgtattactccgtaccgtccttacgttccgaccggtacggaacagtctagactcggtacggactacggttgcgtctcgactacctattgtccttcttcc

SEQ ID NO: 179998 - DNA, 206 bp, Homo sapiens
  misc_feature: GYAE6OF01A7NV3.52.14.B03.1.454.CMB.1.raw
  modified_base (190)..(206): a, c, t, g, unknown or other
  misc_feature (190)..(206): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggctacttcctatacgatcgctgagcgggctgcaaggcgcatagnnnnnnnnnnnnnnnnn

SEQ ID NO: 179999 - DNA, 824 bp, Homo sapiens
  misc_feature: GYAE6OF01A0UKO.52.14.B03.1.454.CMB.1.raw
  modified_base (803)..(803): a, c, t, g, unknown or other
  misc_feature (803)..(803): n is a, c, g, or t
tcagcgcagtacgacacgaccggtgctcgatttagtgtgagtagttccgcggggggagtcagacccagtcaggacacagcatggacatgagggtcccccgctcagctccgtggggcctcctgctgctctggcctcccgaggtcgaccaaatgtgacatccgagactccgaaccctgttccttccccttacccacccgtgtcgtgacctacgtcgtaggtacggaacacgtacgtacgtaccaacctattaccgtacggttccggaccccgggtacctaaggtaaccaaagtaaacgtttaaagtttaaacgttaaggggttccggttacggtaccgttaggtaacgtacgacgactaagtaaccgtaaccggaaacgggtaaccctacccctaaacgtcgtacgtacttacgtaacggtacggtacgttacgttaaggtttaacggtaaccgggttccgggttacccgtagtaacggtcgaggccgtagtaggtagtcgtacgggtaggtactacgtacttcgtaaccttccgtaacctaaccgaacttacccgaaacgtccgtccgcgtaacccgtgtacccgttagttatttacggttactttaacgtaaccttaactttaccgtaccgtaaccgtaacctaacgttaaccttaattaaccgtttactttaacttacccggttacccgtcccgggttaccttaccgggttacccgtacggaccggtaacctacggtacgtaacgtacgtcgggtaacctaacggttacgcggttaccgacccgtacgttaccctaacgttnttccgttcgttaccgtacccc

SEQ ID NO: 180000 - DNA, 202 bp, Homo sapiens
  misc_feature: GYAE6OF02FNVUN.52.14.B03.1.454.CMB.1.raw
  modified_base (167)..(202): a, c, t, g, unknown or other
  misc_feature (167)..(202): n is a, c, g, or t
tcagcgcagtacgacacgaccggtgctcgatttagtgtgagtagttccgtcgggcacgaccggtgctcgatttagtcgacgcgagaaagggaaaggggctggccctgacgtgttctgttcccgcctcctctatacgatcgctgagcgggctggcaagggcgcatagnnnnnnnnnnnnnnnnnnnnnnnnnnnnnnnnnnnn

SEQ ID NO: 180001 - DNA, 193 bp, Homo sapiens; identical to SEQ ID NO: 179910
  misc_feature: GYAE6OF02G782P.52.14.B03.1.454.CMB.1.raw
  modified_base (191)..(193): a, c, t, g, unknown or other
  misc_feature (191)..(193): n is a, c, g, or t

SEQ ID NO: 180002 - DNA, 206 bp, Homo sapiens
  misc_feature: GYAE6OF02I5YIU.52.14.B03.1.454.CMB.1.raw
  modified_base (204)..(206): a, c, t, g, unknown or other
  misc_feature (204)..(206): n is a, c, g, or t
tcagcgcagtacgacacgaccggtgctcgatttagtgtgagtagttccgcgggcacgaccggtgctcgatttagtgtgagtagttccgcgggcacgaccggtgctcgatttagtcacgcgagaaaggaaaggggctggccctagcgtgttcctgttcccaccctcctctatacgatcgctgagcgggctggcaaggcgcatagnnn

SEQ ID NO: 180003 - DNA, 215 bp, Homo sapiens
  misc_feature: GYAE6OF02HKHRE.52.14.B03.1.454.CMB.1.raw
  modified_base (194)..(196): a, c, t, g, unknown or other
  misc_feature (194)..(196): n is a, c, g, or t
  modified_base (198)..(215): a, c, t, g, unknown or other
  misc_feature (198)..(215): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaagggactacttcctcgttactgcgctgagcgggctggcaaggcgcatagnnngnnnnnnnnnnnnnnnnnn

SEQ ID NO: 180004 - DNA, 193 bp, Homo sapiens; identical to SEQ ID NO: 179910
  misc_feature: GYAE6OF02GFP1C.52.14.B03.1.454.CMB.1.raw
  modified_base (191)..(193): a, c, t, g, unknown or other
  misc_feature (191)..(193): n is a, c, g, or t

SEQ ID NO: 180005 - DNA, 201 bp, Homo sapiens
  misc_feature: GYAE6OF02G0MKZ.52.14.B03.1.454.CMB.1.raw
  modified_base (201)..(201): a, c, t, g, unknown or other
  misc_feature (201)..(201): n is a, c, g, or t
tcagcgcagtacgacacgaccggtgctcgatttagtgtgagtagttccgcgggcacgaccggtgctcgatttagtcgagctctctcgcgggcacgaccggtgctcgatttagtcacgcgagaaaggaaggggctggcccgacgtgtttctgttcccgccctcctctatacgatcgctgagcgggctggcaaggcgcatagn

SEQ ID NO: 180006 - DNA, 489 bp, Homo sapiens
  misc_feature: GYAE6OF02G878O.52.14.B03.1.454.CMB.1.raw
  modified_base (323)..(323): a, c, t, g, unknown or other
  misc_feature (323)..(323): n is a, c, g, or t
  modified_base (373)..(373): a, c, t, g, unknown or other
  misc_feature (373)..(373): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaatcctgatctataaggcgtctagtttagaaagtggggtcccttnaaggttcagcggcagtggatctgggacagaattcactctcaccatcaacngcctgcagcctgatgatttgctaacttattactgccaacactataatcattattctccgctactttcgcctggaccagctagatagtcggacactgtggctgcaccatctgtcttc

SEQ ID NO: 180007 - DNA, 194 bp, Homo sapiens
  misc_feature: GYAE6OF02G66WH.52.14.B03.1.454.CMB.1.raw
  modified_base (193)..(194): a, c, t, g, unknown or other
  misc_feature (193)..(194): n is a, c, g, or t
tcagcgcagtacgacacgaccggtgctcgatttagtgtgagtagttccgacgggtcagcctccaccaagggcccatcggtcttccccctggcaccctcctccaagagcacctctgggggcacagcggccctgggctgcctggtcaaggactacttcctatacgatcgctgagcgggctggcaaggcgcatagnn

SEQ ID NO: 180008 - DNA, 204 bp, Homo sapiens
  misc_feature: GYAE6OF02I88BK.52.14.B03.1.454.CMB.1.raw
  modified_base (202)..(204): a, c, t, g, unknown or other
  misc_feature (202)..(204): n is a, c, g, or t
tcagcgcagtacgacacgaccggtgctcgatttagtgtgagtagttccgcgggcacgaccggtgctcgatttagtgtgagtagttccgcgggcacgaccggtgctcgatttagtcacgcgagaaaggaaggggctggccctagcgtgttcctgttcccacctcctctatacgatcgctgagcgggctggcaaggcgcatagnnn

SEQ ID NO: 180009 - DNA, 194 bp, Homo sapiens; identical to SEQ ID NO: 179915
  misc_feature: GYAE6OF02HPUQA.52.14.B03.1.454.CMB.1.raw
  modified_base (192)..(194): a, c, t, g, unknown or other
  misc_feature (192)..(194): n is a, c, g, or t

SEQ ID NO: 180010 - DNA, 194 bp, Homo sapiens; identical to SEQ ID NO: 179915
  misc_feature: GYAE6OF02F634F.52.14.B03.1.454.CMB.1.raw
  modified_base (192)..(194): a, c, t, g, unknown or other
  misc_feature (192)..(194): n is a, c, g, or t

SEQ ID NO: 180011 - DNA, 495 bp, Homo sapiens
  misc_feature: GYAE6OF02H5270.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaaactcctgatctataaggcgtctagtttagaaagtggggtcccttcaaggttcagcggcagtggatctgggacagaattcactctcaccatcaacagcctgcagcctgatgatttgctaactttattactgaccaacactataatcattattctccgccactttcgccctggaccagctagatatcggacaacgtgtgctgcaccatctgtcttc

SEQ ID NO: 180012 - DNA, 504 bp, Homo sapiens
  misc_feature: GYAE6OF02GYNJ1.52.14.B03.1.454.CMB.1.raw
  modified_base (499)..(499): a, c, t, g, unknown or other
  misc_feature (499)..(499): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacgcccctaaactcctgatctataaggcgtctagtttagaaagtggggtcccttcaaggttcagcggcagtggatctgggacagaattcactctcaccatcaacagcctgcagcctgatgattttgctaacttattactgaccaacactaataatctattattctccggcctactttcggccctggaccaagctagatatcggacgaactgtggctgcaccatctgtnttacc

SEQ ID NO: 180013 - DNA, 543 bp, Homo sapiens
  misc_feature: GYAE6OF02J282L.52.14.B03.1.454.CMB.1.raw
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (504)..(504): a, c, t, g, unknown or other
  misc_feature (504)..(504): n is a, c, g, or t
tcagcgcagtacgacacgaccggtgctcgatttagtgtgagtagttccgcgggggaggtcagaccagtcaggacacagcatggacatgagggtcccgctcagctcctgggctcctgctgctctggctcccaggtgccaaatgtgacatccagatgacccagtctccttccaccctgtctgcatctgtaggagacagagtcaccatcacttgccgggccagtcagaatattaataagtggttgcctggtatcagcagatacccgagggaaacncccctaaatcctagatctanaaggctactagtttagaacgtgggtccctanaaggttcagcggcagtggactcgtagggacagtaacttcactctcaccatcaacngcctgcagcctagatgtatttgctaaacgttnttaacttcgacctaaacacttactaatctatttacttccgtaccgtcctacgttttccggcccttagggaccaagtctagacttacgtccgganaacgttgacggtctaggccacctatcctttagtccttac

SEQ ID NO: 180014 - DNA, 205 bp, Homo sapiens
  misc_feature: GYAE6OF02JG9OX.52.14.B03.1.454.CMB.1.raw
  modified_base (194)..(205): a, c, t, g, unknown or other
  misc_feature (194)..(205): n is a, c, g, or t
tcagcgcagtacgacacgaccggtgctcgatttagtgtgagtagttccgtcgggtcgagcctccaccaagggcccatcggtcttcccctggcaccctcctccaacgagcacctctggggcacagcggccctgggctgcctggtcaaggactacttcctatacgatcgctgagcgggctggcaaggcgtcatagnnnnnnnnnnnn

SEQ ID NO: 180015 - DNA, 498 bp, Homo sapiens
  misc_feature: GYAE6OF02IQC6M.52.14.B03.1.454.CMB.1.raw
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatataataagtggttgcctggtatcagcagataccagggaagcccctaaatcctgatctataaggcgtctagttagaagtgggtcccttnaaggttcagcgcagtgatntgggacagaattcactctcaccatcaacngcctgcagcctgatgtatttgactaacttattactgaccaacactataatctaattacttctccgtacctactttccggccctggaaccagctagatagtcggaacgaacgtgtgctcgcaccatctgtctc

SEQ ID NO: 180016 - DNA, 542 bp, Homo sapiens
  misc_feature: GYAE6OF02JYZ78.52.14.B03.1.454.CMB.1.raw
  modified_base (354)..(354): a, c, t, g, unknown or other
  misc_feature (354)..(354): n is a, c, g, or t
  modified_base (514)..(514): a, c, t, g, unknown or other
  misc_feature (514)..(514): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttgcctggtatcagcagataccgagggaacgcccctaaactcctagatctataaggcgtctagttagaagtggggtcccttgaaggttcaggcggcagtggatcgtaggganaggtaattcaacgtctaccaccatacaacacgcctgacacgcctgatcgtattttacgactaacttattactgaccaactactaataactctattactcctaccgtcctacgtttccgaccgtcggaccacgtctagactacgtcggacgtactgtacgngtacgctaccgtatcgtcgttacttacg

SEQ ID NO: 180017 - DNA, 550 bp, Homo sapiens
  misc_feature: GYAE6OF02H26AZ.52.14.B03.1.454.CMB.1.raw
  modified_base (324)..(324): a, c, t, g, unknown or other
  misc_feature (324)..(324): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaagcccctaaaactcctgatctataaggcgtctagtttagaaagtgggtcccttnaaggttcaggcggcagtggatcgtgggacagaattcactctcaccatcaacagcctgcagcctgatgatttgctaactttattactgaccaaactactaataatcaatttattccgtccgtaccctactttccggccctaggaccctaagcctagactagtaccgggaaccgtaacgttggtacggtccttacggaccaacccgtattacccgtcgttaccttacc

SEQ ID NO: 180018 - DNA, 515 bp, Homo sapiens
  misc_feature: GYAE6OF02INVT8.52.14.B03.1.454.CMB.1.raw
  modified_base (278)..(278): a, c, t, g, unknown or other
  misc_feature (278)..(278): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagcgcagtacgacacgaccggtgctcgatttagtgtgagtagttccgcggggggagtcagacccagtcaggaccacagcatggacatgagggtccccgctcagctcctggggctcctgctgctctggctcccaggtgccaaatgtgactatccagatgaacccagtctccttccaccctgtctgcatctgtaggagacagagtcaccatcacttcgccgggccagtcagaatattaataagtggttggcctggtatcagcagataccagggaaacncccctaaactcctgatctataggctctagttagaagtgggtccttnaagttcagtcgnagtggatcgtgggacagaattcactctcacatcaacagcctgcagcctgatgtatttgctaacttattactgaccaaacactataatcaatttattcctccgcctactttccgccctaggacctagctagactagtcggaacgactggtacggctggacctaccgagttctgtcttacg

SEQ ID NO: 180019 - DNA, 571 bp, Homo sapiens
  misc_feature: GYAE6OF02GIZDI.52.14.B03.1.454.CMB.1.raw
  modified_base (379)..(379): a, c, t, g, unknown or other
  misc_feature (379)..(379): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacgcccctaaactcctagatctataaggcgtactagtttagaaagtgggtacccttgaaggttcagcggcagtggatcgtgggacagaattcactctcaccatcaacngcctgcagcctgatgtatttgactaactttattactcgtaccaaactactaataatctaatttacttcgtcccgtacctaccgttttccggaccccttacgggaaccctaagtcctagtacttaacgtccgggtaacctaacgttggttacggcttacggacctaacccgtattccgttacgttccttaccg

SEQ ID NO: 180020 - DNA, 193 bp, Homo sapiens
  misc_feature: GYAE6OF02H8IOE.52.14.B03.1.454.CMB.1.raw
  modified_base (192)..(193): a, c, t, g, unknown or other
  misc_feature (192)..(193): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctatacgatcgctgagcgggctggcaaggcgcatagnn

SEQ ID NO: 180021 - DNA, 598 bp, Homo sapiens
  misc_feature: GYAE6OF02FNNW2.52.14.B03.1.454.CMB.1.raw
tcagcgcagtacgacacgaccggtgctcgatttagtgtgagtagttccgcggggggaaggtcgacgacccgaggtcaggacacaggcatggacatgaggtcccgctcagctcctcgggctcctgctgctctggcgtcccaggtgccaaatcgtgacatccagatgacccagtcctccgttccaccctgtctcgcatctgtacggagacagacgtcaccatcacttgccggcagtcagaataattaatagtggttgcctagtatcagcagactaccgacgggaagcccctaaatcctagatactaataaggcgttacgtaaggtttagaaacgtggggtacccttagaacggttcagcggcagttgatcgtggacagtaacttcaacgtctacaccatccaacgtcgcctgcagccgtagtactgtagtttagacgtaacgttagttactacgtacctaactactaataactactaattacttaccgtaccgtaccgtacgtttccgccgtaggtaccgtaagtcgtacggtagtacgtacggtaacgtaacgtcggtacggtacgtacgccgacccgtagtccgttcgtcccttaccg

SEQ ID NO: 180022 - DNA, 504 bp, Homo sapiens
  misc_feature: GYAE6OF02IHX6M.52.14.B03.1.454.CMB.1.raw
  modified_base (274)..(274): a, c, t, g, unknown or other
  misc_feature (274)..(274): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (489)..(489): a, c, t, g, unknown or other
  misc_feature (489)..(489): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaancccctaaatcctgatctataaggcgtctagtttagaaagggtgggtcccttnaaggttcagcggnagtggatctgggacagaattcactctcacatcaacagctgcagcctgatgtatttgactaacttattactgacccaaacactaataatctaatttattcctccgcctactttccgccctggaccaagctagatagtcggacgaactgtgntgcaccatctgtctc

SEQ ID NO: 180023 - DNA, 193 bp, Homo sapiens; identical to SEQ ID NO: 180020
  misc_feature: GYAE6OF02HOV90.52.14.B03.1.454.CMB.1.raw
  modified_base (192)..(193): a, c, t, g, unknown or other
  misc_feature (192)..(193): n is a, c, g, or t

SEQ ID NO: 180024 - DNA, 490 bp, Homo sapiens
  misc_feature: GYAE6OF02GR0N9.52.14.B03.1.454.CMB.1.raw
  modified_base (315)..(315): a, c, t, g, unknown or other
  misc_feature (315)..(315): n is a, c, g, or t
  modified_base (487)..(487): a, c, t, g, unknown or other
  misc_feature (487)..(487): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctataggagacagaatcaccatcacttgccgggcgagtcgagacattagcatgtatctgaattggtatcagcaaaaaccagggacagccccctaaaatcctgatcctcgatgcatccactttggaaacnggggtccatcaagttcagtggaagtggctcgtggacagtatttacttcacatcagcaggctgcagcctagaagacattgacaacatattactgtacaacagtatgatagtctccgctcacgtttcggacggggacaggtggaagatacgaagcgaatggtaggctgcacctntcg

SEQ ID NO: 180025 - DNA, 493 bp, Homo sapiens
  misc_feature: GYAE6OF02HJRDX.52.14.B03.1.454.CMB.1.raw
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctataaggcgtctagtttagaaagtggggtcccttcaaggttcagcgcagtggatctgggacagaattcactctcaccatcaacagcctgcagcctgatgatttgctaacttattactgccaacactataatcaattattctccgcctactttccgccctggaccagctagatatcggacgaactgtgctgcaccatctgtcttc

SEQ ID NO: 180026 - DNA, 505 bp, Homo sapiens
  misc_feature: GYAE6OF02HMCBC.52.14.B03.1.454.CMB.1.raw
  modified_base (273)..(273): a, c, t, g, unknown or other
  misc_feature (273)..(273): n is a, c, g, or t
  modified_base (324)..(324): a, c, t, g, unknown or other
  misc_feature (324)..(324): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtgttggcctggtatcagcagataccagggaaacncccctaaaactcctgatctataaggcgtctagttagaaagtgggtcccttnaaggttcagcggcagtggatctgggacagaattcactctcaccatcaacagcctgcacgcctgatgtatttgactaacttattactcgaccaacactatatcattacttctccgctacttcgccctggaccagctagatacgtcggacgaacgtgtcggctcgctaccactctcgtcttac

SEQ ID NO: 180027 - DNA, 510 bp, Homo sapiens
  misc_feature: GYAE6OF02I7BSC.52.14.B03.1.454.CMB.1.raw
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
  modified_base (465)..(465): a, c, t, g, unknown or other
  misc_feature (465)..(465): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagatataatagtgtgctggtatcagcagataccagggaaacgcccctaaaactcctagatctataaggcgtctaagtttagaaagtgggtcccttgaaggttcagcggcagtggatcgngggacagaattcactctcaccatcaacncgcctgcagcctgatgtatttgactaacttattactgacctaacactataatacatttacttctccgcctacttccgccctggaccagacgtanactagtcggaactagtgtagtctacgccaccgatccgtgttctac

SEQ ID NO: 180028 - DNA, 193 bp, Homo sapiens; identical to SEQ ID NO: 180020
  misc_feature: GYAE6OF02H18CL.52.14.B03.1.454.CMB.1.raw
  modified_base (192)..(193): a, c, t, g, unknown or other
  misc_feature (192)..(193): n is a, c, g, or t

SEQ ID NO: 180029 - DNA, 504 bp, Homo sapiens
  misc_feature: GYAE6OF02IX98Z.52.14.B03.1.454.CMB.1.raw
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (487)..(487): a, c, t, g, unknown or other
  misc_feature (487)..(487): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacgcccctaaactcctgatctataaggcgtctagtttagaagtgggtcccttnaaggttcagcggcagtggatcgtggacagaattcactctcaccatcaacngcctgccagcctgatgtatttgactaacttattactgaccaacactataatctattacttctccgtcctacttcgcccgtcggaccagctagatagtcggacacgtgtcggntgctaccatctgtcttc

SEQ ID NO: 180030 - DNA, 576 bp, Homo sapiens
  misc_feature: GYAE6OF02JUI3T.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagatatatagtgtgctggtatcagcagatacaggaagcccctaaactcctgatctataagcgtctagttagaagtggggtaccttacgaaggttcagacggcagtgatctgggacagaattcactctacactatcaacagcctgcacgcctagatgtatttgacctaacttcttaacgtcgaccctaaacattaactaattacctatttaacttcctacccgtacctaccgttttccggaccctacggtaacccaagtccgtaagtacttaacgtaccgggtaactaaccggttcggttaaccggccgtttaacggaccctaccgtacgttccgttacggttccctttaaccg

SEQ ID NO: 180031 - DNA, 510 bp, Homo sapiens
  misc_feature: GYAE6OF02FKXSF.52.14.B03.1.454.CMB.1.raw
  modified_base (326)..(326): a, c, t, g, unknown or other
  misc_feature (326)..(326): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaaactcctgatctataaggcgtctagtttagaaagtggggtcccttnaaggttcagcggcagtggatctgggacagaattcactctcaccatcaacagcctgcagcctgatgtattttgactaacttattactgaccaacactataatactattacttctccgtcctactttcgccctcggaccagctagactatcggacgtaacgtgtcgctcgcacctatctgtcttac

SEQ ID NO: 180032 - DNA, 582 bp, Homo sapiens
  misc_feature: GYAE6OF02JXRMO.52.14.B03.1.454.CMB.1.raw
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccaggaaagcccctaaactcctagatcataaggcgtactagtttagaaagtgggtcccttacgaaggttcagcggcagtggatctgggacagaattcactctcacatcaacagcctgcaagcctgacttgtatttgactaacttattacgtgacccaaataccttaataaatccgtaatttacttccgtacccggtcccttaacgttttcccgggaccccttagggaaccctaagtaccgtagtacttacggtaaccgggtaccaaacgttggttacgcgttacgaccctaccgtaacttccgttacgttacctttaccg

SEQ ID NO: 180033 - DNA, 270 bp, Homo sapiens
  misc_feature: GYAE6OF02JBDNQ.52.14.B03.1.454.CMB.1.raw
  modified_base (206)..(207): a, c, t, g, unknown or other
  misc_feature (206)..(207): n is a, c, g, or t
  modified_base (212)..(270): a, c, t, g, unknown or other
  misc_feature (212)..(270): n is a, c, g, or t
tcagcgcagtacgacacgaccggtgctcgatttagtgtgagtagttcgtcgggggtcgagcctccgaccaagggcccatcggtcgttccccctggcaccctcctccaagaggccacctcctcgggggcaccacgcggcccttgggctgccctggtcaaggactacttcctatacgactcgctgagcgggctggcaaggcgccatgnncgcgnnnnnnnnnnnnnnnnnnnnnnnnnnnnnnnnnnnnnnnnnnnnnnnnnnnnnnnnnnn

SEQ ID NO: 180034 - DNA, 527 bp, Homo sapiens
  misc_feature: GYAE6OF02ISWBV.52.14.B03.1.454.CMB.1.raw
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
  modified_base (514)..(514): a, c, t, g, unknown or other
  misc_feature (514)..(514): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaatagtggttgcctggtatcagcagataccagggaaagcccctaaatcctgatctataaggcgtctagtttagaaagtgggtccttcaaggttcagcggnagtggatctgggacagaattcactctcaccatcaacngcctgcagcctgatgatttgactaacttattactagaccaaactactaataatactactttattcctaccggtcctacgttttccggccctagggaccctaagcctagatacgtacgggaacgtaactggtcggctgccacctntcctggtcttacg

SEQ ID NO: 180035 - DNA, 523 bp, Homo sapiens
  misc_feature: GYAE6OF02HJQ0F.52.14.B03.1.454.CMB.1.raw
  modified_base (319)..(319): a, c, t, g, unknown or other
  misc_feature (319)..(319): n is a, c, g, or t
  modified_base (419)..(419): a, c, t, g, unknown or other
  misc_feature (419)..(419): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagaatataatagtgttgctggtatcagcagataccgagggaaacgcccctaaaactcctagatctataaggctactagttagaaagtgggtccttnaaggttcagtcgcagtggatgtaggacagaattcactctcaccatacaacagactgcagcctgatgtatttgactaacttattactgacctaacacttanaatcaatttactctaccgcctacgtttcgacccttaggacctaagctagacttagtacggacgtaactgtacggtctcggaccacctagtccttgtacttaccg

SEQ ID NO: 180036 - DNA, 607 bp, Homo sapiens
  misc_feature: GYAE6OF02J0CDK.52.14.B03.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagcgcagtacgacacgaccggtgctcgatttagtgtgagtagttccgcgggggaggtcgagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagatataatagtgtgctgtatcagcagataccgaggaacgcccctaaatcctgatctanaagcgtctaagttagaagttcgggtacccttgaaggttcaggcggacagtgatgaggacagtaatcactctcacctataccaactagcctgacacgtcctgtaagtcgtatttcgactaattacttacgtacacctaaacacttaataacttcgtaactttacgttcccgtacccgggtaccctttaaccggttttcccggacccgttacggggaaaccctaaggtaccttaggtaactttaccggaaccgggtaaccttaagttacggtcgtacgttacccgtaccggaaccctttaaccgttctttccggtcttttaacccg

SEQ ID NO: 180037 - DNA, 597 bp, Homo sapiens
  misc_feature: GYAE6OF02JNAQ0.52.14.B03.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagcgcagtacgacacgaccggtgctcgatttagtgtgagtagttccgcgggggaggtcgagacccacgtcaggacacagcatggacatgagggtcccgctcagctcctgggctcctgctgctctggctcccaggtgccaaatgtgacatccagatgacccagtctccttccaccctgtcctgcactctgtaggagacagacgtcaccatcgacttggcccgggccagtcagaatattaactaagtggttgacctggtancagcaganacgaagggaacacccctaactccgtnagtcctaagtacggngtactaggtttagaagtgggttcccttagaaggttcagcggtanaggtgactcgtgggaactagagttacnccgttcncgaccagtcaacacgcttgcagtcctggacttagtgtttacgactaaatttcttaactcgaactaacctactaaactattaacctatttacgttaccgtcccgtaacttaccgtttaccgtcccgttaagggaacctaggttaccagttacgtacgttaccggaagtaacgtggtccgtagtcgacgacctacttctaccggtttaccc

SEQ ID NO: 180038 - DNA, 799 bp, Homo sapiens
  misc_feature: GYAE6OF02HABYU.52.14.B03.1.454.CMB.1.raw
tcagcgcagtacgacacgaccggtgctcgatttagtgtgagtagttccggcggggggagtcagacccagtcaggacacagcatggacatgagggtccccgctcagctccgtggggctcctgctgctctggcctcccaggtgccaaatgtgacatccagatgacccagtctccttccaccctgtctgcatctggtaggagacagacgtcaccatcacttggcccgggccagtcagaatattaatagtggtgctggtatcagcagataccgagggaacgcccctaaaactcctagactctaagtaacgggcgttacgttaaggtttaaggaaagggtttcgggggttacccctttagtaaacgggtttccgaagggtccgggacgtaagggttagggtacttacgggtacgggggtaactaaggttaaactttccgtaacccgtttaccgtacccaaacccgtataacccgaaaccgtacggtacccgttacggaccgtaacgtcccgttaggtaacgttaggttttaacttttacgggtaaccctttaaaccgtttttaacgttaacccgttaccggtaaacccttaaacctaaccctttaaattaaaccttaccttaaatttttaaccgtttccccgttaccccgggtaacccctttaacccggttttccccgggtaccccggttacgggtaaacccgtaacgtaccgttaaggtaaccttacggttaaccgggaaccgttaaacggttcggtacggtccttacggacctaccctagttccgttcggttactttacccg

SEQ ID NO: 180039 - DNA, 624 bp, Homo sapiens
  misc_feature: GYAE6OF02HT91I.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttggccggcagtcagaatataatagtggttgctggtatcagcagactacgaagggaaacacccctaaactcctagatactaagtaaggcgttacttaagttagaaaggttcgggttacccttagtaaggttcaggcggacaggtggatcgtaggacagtaacttcactctacaccatacaacacgcctgccagcctagattgttatttcgacttaaactttacttacctacgacctaaactaacttaataaacttactaatttacttccgtacccccgtacttacccgttttccgggacccgttagggaacccttaagtccttaaggtacgtttaacggtaccggtaacgtaacgttcgggttacggaccgttacggacccaaccgttagttacccgttcggttaccttaccg

SEQ ID NO: 180040 - DNA, 573 bp, Homo sapiens
  misc_feature: GYAE6OF02IOJH1.52.14.B03.1.454.CMB.1.raw
  modified_base (537)..(537): a, c, t, g, unknown or other
  misc_feature (537)..(537): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgaccatccagatgacccagtctccttccaccctgtctgcatctgtaggagacagtagtcaccatctacttgccgggccagtcaagtaatataaatagtggttggccgtggtatccagcagactaccaggaaacgcccctaaactcctagactctagtaacggtccgtctagtttaacgaagtcgggtacccttgaaggtcaggtcggcagtcggatccgtagggacagaactttccacttactcctaaccctataccgaaacgcgccctacggaccaggcccctggaacttggtacttttcgaccttaaacgtttattaactcgtacctaactactataatctaatttacttcctccggtcctacgtttccggcctcgggaccagctagntacgtggaactatgtaggctcgctacatcttgtctc

SEQ ID NO: 180041 - DNA, 543 bp, Homo sapiens
  misc_feature: GYAE6OF02F2V0Z.52.14.B03.1.454.CMB.1.raw
  modified_base (374)..(374): a, c, t, g, unknown or other
  misc_feature (374)..(374): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatataatagtggttgctggtatcagcagataccgagggaaacgccccctaaactcctagatctaagtaaggctactagtttaagaaagtgggtcccttgaaggttcagcgcagtggatcgtggacagtattcactctcacatcaangcctgcagcctgatgtatttgactaactttattactcgtaccaactaactaactaatactaattacttccgtaccggtacctaccgtttccggaccctcggaaccaagtctagatacgtcggaacgtaacgtggtacggctagacctaccgtatccgttacgtcttacc

SEQ ID NO: 180042 - DNA, 194 bp, Homo sapiens; identical to SEQ ID NO: 179915
  misc_feature: GYAE6OF02HC44D.52.14.B03.1.454.CMB.1.raw
  modified_base (192)..(194): a, c, t, g, unknown or other
  misc_feature (192)..(194): n is a, c, g, or t

SEQ ID NO: 180043 - DNA, 648 bp, Homo sapiens
  misc_feature: GYAE6OF02IHAD0.52.14.B03.1.454.CMB.1.raw
  modified_base (351)..(351): a, c, t, g, unknown or other
  misc_feature (351)..(351): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccggccagtcagaatataataagtggtgcctggtatcagcagataaccgagggaaacgcccctaaacgtcctagactactaagtaaggctacgtaagtttagaaaggttcgggtaccttacgaaaggttcaggcgganacggtggactcgtaggggactaagtaattccgactcctacaaccctataacaacgacgtccctgaccacgcctagagttagtacttttacggacttaactttaacttactacgacctaaactaactaataacgtacttaacttaacttccgtacccgtacctacccgtttcgggaccccgttaggtaaccccgaagtaccgtaacgtacgttaacggtaaccggtaacggtaaaccgttggtaccgggtacccttacgaccgtaaccgtaccgtttacgttccgttacctttaccgg

SEQ ID NO: 180044 - DNA, 551 bp, Homo sapiens
  misc_feature: GYAE6OF02FL22J.52.14.B03.1.454.CMB.1.raw
  modified_base (363)..(363): a, c, t, g, unknown or other
  misc_feature (363)..(363): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagccccctaaactcctgatctatggttcatccatttgctgagtgggtcccatcaaggttcagtggcagtggatctgggacagaattcactcncaccatcaccagtctgcaggctggaggtattttgctaactttacttctgtacaactagtagttactacgtttcccctctaccttttccggcccttagggacctagtacgttggacttaacgtacaaaaccggtaacgttggtacggtcttacggaccctaaccctagtcccttaggttcctttacccg

SEQ ID NO: 180045 - DNA, 662 bp, Homo sapiens
  misc_feature: GYAE6OF02FZREV.52.14.B03.1.454.CMB.1.raw
  modified_base (200)..(200): a, c, t, g, unknown or other
  misc_feature (200)..(200): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggcctcccaggtgaccaaatgtgacatccagatcgacccagtcctccttccaccctgtctgcatctgtagganacagagtcaccatcacttcggccgggccagtcagaatataatagtggttgctggtatcagcagataccgaagggaaacacccctaaactcctagactactaagtaaggtcgttacgttaaggtttaaggaaacgggttcgggggttaccctttacgtaacgggtttcaggtccggactaggtggtatcggtagggaactaaggtaacttccactcctaccaacctataccaacacgtcctgaccacgcctagtattagttattttacgaccttaaactttacttaacctcgaaccctaaactaattaacttaaacttacttaactttaacttccgtacccgttacccttaccggttttcccggccccgttacgggaacctaacgtcgttaagacttacggtacccggaacgttaacgtggtacgacctacggacctaaccgtattccgttacgtttcttacc

SEQ ID NO: 180046 - DNA, 616 bp, Homo sapiens
  misc_feature: GYAE6OF02F6WEH.52.14.B03.1.454.CMB.1.raw
  modified_base (372)..(372): a, c, t, g, unknown or other
  misc_feature (372)..(372): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagaatattaataagtggtgcctggtatcagcagataccgagggaaacgcccctaaatcctagatctataaggcgtctaagtttagaaagttgggtaccttgaaggttcagcggcagtgatcgtggacagaatcactctcacatcaacncgcctgcagcctagatgtatttgactaactttattactgaccaactactaataactctaatttacttccgtcccggtaccctaaccgtttttccgggaccccgttacgggtaaaccctaacggtaccgttaacggtaattaaccggtttaaccggggaaccgttaaaccggttcgggttaccgggtaccttacgggaccctaaaccccgtaagtttacccgtttacggtttaccctttaacccg

SEQ ID NO: 180047 - DNA, 592 bp, Homo sapiens
  misc_feature: GYAE6OF02GG4MS.52.14.B03.1.454.CMB.1.raw
  modified_base (272)..(272): a, c, t, g, unknown or other
  misc_feature (272)..(272): n is a, c, g, or t
  modified_base (375)..(375): a, c, t, g, unknown or other
  misc_feature (375)..(375): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatataataagtgttgcctggtatcagcagataccagggaaacncccctaaaatcctagactctaataaggctctagtttagaagttgggtcccttgaaggttcagcggcagtgatcgtggacagattcactctacaccatccaacngcctgcagcctgacttgtatttcgactaacttattactcgaacctaacgtacttaataaactcttaatttacttacccgttccggaccttaccgttttccggacccgttacgggaaccctaaggtcctaagtacttacggtaccgggtaaccgtaaacgttcggtacgggtcctacgtacccgtaaccctagtttcccgttagttccctttaacccg

SEQ ID NO: 180048 - DNA, 522 bp, Homo sapiens
  misc_feature: GYAE6OF02GJUQO.52.14.B03.1.454.CMB.1.raw
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
tcagcgcagtacgacacgaccggtgctcgatttagtgtgagtagttccggcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagatataatagtggtgctggtatcagcagatacgagggaacncccctaatctgatctagtagctntagttagaaggtcgggtcctagaggtcagcgcagtgatcgtgganagtactcactctacacatcaacncgtctcgcacgctagnttagtatttcgactaacttattacgtctaccaactactaataatctaattacttccgtaccgtccttacgtttcccgccgttaggaacctagtctagactacggtcggaactacgtggngtctcgacncctactcgtcgtaccttc

SEQ ID NO: 180049 - DNA, 530 bp, Homo sapiens
  misc_feature: GYAE6OF02FHX9O.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacccatcacttgccgggccagtcagatattaataagtggttggcctggtatcagcagataccagggaaagccccctaaaactcctagatctataaggctctagtttagaaagtggggtcccttcaaggttcagcggcagtggatctggggacagaattcactctcaccatcaacagcctgcagcctgatgtattttgactaactttattactgaccaacactataatctaattattctccgtcctacgtttccggcccttagggacccaaggcctagactacgtcggacaacgttgtacggctcggaccacctatctcgttcttacc

SEQ ID NO: 180050 - DNA, 570 bp, Homo sapiens
  misc_feature: GYAE6OF02F1JOV.52.14.B03.1.454.CMB.1.raw
  modified_base (196)..(196): a, c, t, g, unknown or other
  misc_feature (196)..(196): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggccagtcagaatataataagtggttgctggtatcagcagataccagggaaacgcccctaaactcctagatactaagtaacggcgttacttaagtttaaggaaacggttcgggggttacccctttacgaaagggttcaggcggcaggtggatcgtgggacagtaacttcactctacacatacaacacgcctgcacgcctagatgtatttcgactaacttattactcgacctaactactataatctaattacttctccgtctacgtttccggcctgggaacaacgtctagaacttacgtacggaacgtaacgttggtacggctacgacctacctagtccttacgttccttacc

SEQ ID NO: 180051 - DNA, 196 bp, Homo sapiens
  misc_feature: GYAE6OF02G90QH.52.14.B03.1.454.CMB.1.raw
  modified_base (192)..(196): a, c, t, g, unknown or other
  misc_feature (192)..(196): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnn

SEQ ID NO: 180052 - DNA, 604 bp, Homo sapiens
  misc_feature: GYAE6OF02IVJQF.52.14.B03.1.454.CMB.1.raw
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagaatataatagtggtgctggtatcagcagataccaagggaaacncccctaaactcctgatctataaggcgtctagttagaagtgggtcccttnaaggttcagcgcagtgatcgtggacagaatcactctacaccataccaacacggcctgcacgcctgattgtatttcgacctaaactttattactacgtaccctaaactacttaaacgtaaattactaatttttaaccgttcccgttacccggtaccctttaccgttttcccgggtaccccgttaggggtaaacccaagtccttaagtaacttacggtaccggaacggtaaacgttggttacgggaccttacggacctaccctaagtttccgttagttcccgttaacc

SEQ ID NO: 180053 - DNA, 618 bp, Homo sapiens
  misc_feature: GYAE6OF02G95MD.52.14.B03.1.454.CMB.1.raw
  modified_base (274)..(274): a, c, t, g, unknown or other
  misc_feature (274)..(274): n is a, c, g, or t
  modified_base (368)..(368): a, c, t, g, unknown or other
  misc_feature (368)..(368): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacncccctaaactcctgatctataaggcgtctagttagaagtcgggtcctcgagttcagcgcagtgatctggacagaattcactctcaccatcaacngcctgcacgcctagatgattttgactaacttattactcgacctaaacgaactaattaaagtcctaatttaacttccgttaaccgggtaccctacgtttttcccgggaccccgttacgggtaaaccctaacggtacttacgtaacgttaacggtaaccggggttaaccgtaaaccgttgggttaccgggtacggttaccggtacctaaaccccggttaactttccgtttacgtttacccgttttaacccgg

SEQ ID NO: 180054 - DNA, 540 bp, Homo sapiens
  misc_feature: GYAE6OF02G0DON.52.14.B03.1.454.CMB.1.raw
  modified_base (324)..(324): a, c, t, g, unknown or other
  misc_feature (324)..(324): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatataataagtggttggcctggtatcagcagataccagggaaagcccctaaaactcctgatctataaggcgtctagtttagaaagtgggtcccttnaaggttcagcggcagtggatcgtgggacagaattcactctcaccatcaacacgcctgcagcctgatgtatttgactactttattactcgaccaatactataactctaattacttcctccggaccttaccgtttccgcccgttaggaaccaagtcttaagactacgtccggaacgtaaccgtggtacgctcgacctacccattcgttcgtccttacc

SEQ ID NO: 180055 - DNA, 595 bp, Homo sapiens
  misc_feature: GYAE6OF02I4ZKA.52.14.B03.1.454.CMB.1.raw
tcagcgcagtacgacacgaccggtgctcgatttagtgtgagtagttccgcgggggggagtcagacccagtcaggacacagcatggacatgagggtccccgctcagctcctggggctcctgctgctctggctctcaggtgccagatgtatcatccagatgacccagtctccatccctcctgtctgcatctataggagacagaatcaaccatcacttggccggcgagtcaggacattaacatgtatctagtaagttggtatcagacaaggaaaccgaagggaaacgaccccctaaatcctagactcctcgatcgacacttaccgtaagtttacggaaacgtacggggtacccagttacgtaaggttcgagtagggaacgtcggctcgtagggactagttattttacttcacctactcgacctagactcgcagtcctagaacgtattagttcgactaaactattaacttacgtacgtactaaactagtacgtagtaactaacttcccgttcctacttaccgttaccgttcgggaccggtacgggtaactagggggtacaggtactacgagtaacgacgtggttacgctacgacctacg

SEQ ID NO: 180056 - DNA, 554 bp, Homo sapiens
  misc_feature: GYAE6OF02HPS9J.52.14.B03.1.454.CMB.1.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (378)..(378): a, c, t, g, unknown or other
  misc_feature (378)..(378): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgaccaaatgtgacatccagatgacccagtctccttccaccctgtctgcatctgtaggagacagagtcaccatcacttggccggcagtcagaatattaanagtggtgctggtatnagcagatacgaggaacnccctaaactctagactctagtaaggctactaagtttagaaggtcgggtacccttagtaaacggttcaggcggacagtggatcgtgggacagtaactcactctacaaccntacaacgagcctgcacgctagatagtattcgactacttattactcaccaactataactatactaattcttacctccgtaccttacgttccgtccgtacggaacctacgtctaagactaacgtacggtacgtaacgtggtaccgtcgtacgaccaccgtataccgttactcttaccg

SEQ ID NO: 180057 - DNA, 611 bp, Homo sapiens
  misc_feature: GYAE6OF02JN69G.52.14.B03.1.454.CMB.1.raw
  modified_base (409)..(409): a, c, t, g, unknown or other
  misc_feature (409)..(409): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatataataagtggttggcctaggtatcagtcagataccgagggaaacgacccctaaaactcctgatactagtaagcgtataagtttagaaacgtgggttacccttcgaaggttacagtcgggcctaaggttggaattccgtaggggaaccagtaactttcacgttctacaacctatacaacncggacctacgcagacctggattagtaatttgaccttaacttagttacctagaccctaaacgtaccttataaacttcgtaatttacgttaccgacccggtacctaccggttttaccgcccgtaggtaccaagtacgttagacgttacgtccggaaccgtaactcggtcgactacgaccacctaacgtcgtacgttcctttaac

SEQ ID NO: 180058 - DNA, 575 bp, Homo sapiens
  misc_feature: GYAE6OF02GHPRH.52.14.B03.1.454.CMB.1.raw
  modified_base (154)..(154): a, c, t, g, unknown or other
  misc_feature (154)..(154): n is a, c, g, or t
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
  modified_base (535)..(535): a, c, t, g, unknown or other
  misc_feature (535)..(535): n is a, c, g, or t
tcagcgcagtacgacacgaccggtgctcgatttagtgtgagtagttccgtcgggggaggtcagacccagtcaggacacagcatggacatgaggtccccgctcagctcctgggctcctgctgctctggctccaggtgccaaatgtgacatccagntgacccagtctccttccacctgtctgacatctcgtagganacagagtcaccatcacttgccggcagtcagaatntaatagngtagctgatcagcagatacagggaaacnccctaaacgtcctagactcctaagtaacgcgtactaagtttagaaacggtgggtccttacgaaggttccaaggcggtcagttcggatcgtaggactagaattcacgtctcgaccatcaancgactagctacgcttacgatacgtatttcgactaacgttatactacgacctaacgaactataacgtaccttaatacttaaccgtcccgtaccgtacgttttaccgcctacgggtaaccagtacgtataacgtactacgggaacctaaacgtntaacggcgttcacggtaccttagcgttagtccttaaccgg

SEQ ID NO: 180059 - DNA, 602 bp, Homo sapiens
  misc_feature: GYAE6OF02GRNJ8.52.14.B03.1.454.CMB.1.raw
  modified_base (196)..(196): a, c, t, g, unknown or other
  misc_feature (196)..(196): n is a, c, g, or t
  modified_base (270)..(270): a, c, t, g, unknown or other
  misc_feature (270)..(270): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagaatataatagtggtgctggtatcagcagataccgaagggaaacncccctaaactcctagactactaagtaacggcgttactaagtttaaggaaacggttcggggtacccttagtaaacggttcaggcggacaggtcggatcgtagggacagtaacttcactctacacctactacaacgacgcctgactacgcctagattgttatttcgactaactttacttacacacctaactactaataatctaattacttccgtccggtaccttaccgtttccggacccgtagggaaccctaagtcctaacgtacttacggtccgggtaacgtaacgttggtcgtaccgtacgaccgtaaccgtcttcgttacgtccttaaccg

SEQ ID NO: 180060 - DNA, 621 bp, Homo sapiens
  misc_feature: GYAE6OF02IIPPL.52.14.B03.1.454.CMB.1.raw
tcagcgcagtacgacacgaccggtgctcgatttagtgtgagtagttccgcgggggggagtcagacccagtcaggacacagcatggacatgagggtccccgctcagctccgtggggctcctgctgctctggctcccaggtgccaaatgtgacatccagatgacccagtctccttccaccctgtctgcatctgtaggagacagagtcacatcacgttcggccgggcagtcagtaatattaataagtggttgcctggtatcagcagactaccgaggaaacgccctaaactcctgatactaagtaacggcttactaagtttagaacggttcggggtcccttagtaaggttcagcggcaggtgatcgtgggactagtacttcactcacaccatacacacgcctgacacgtcctagtattacgtatttcgactaatttacttactacgacctaaacttaactaataacttacgtaactttacgttacccgtcccggttacccttaccgtttcccggtacccgtacgggtaaccctaacgtacgttaagtacgttaacgtaacccgggtaacgtaacggttcggtacggtaccttacgaccctactacgttccgttgttacccttacc

SEQ ID NO: 180061 - DNA, 583 bp, Homo sapiens
  misc_feature: GYAE6OF02JH64K.52.14.B03.1.454.CMB.1.raw
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggtggcctggtatcagcagataccagggaacgcccctaaactctgatctanaagcgtctagtttagaagtgggtcccttnaaggttcagtcggctaggtggatcgtgggacaggaacttcactctacaccgatacaacagcctgcagcctagactagtatttcgactaactttattactgtaccctaacgaacttaataacgttactattacttccgtaccggtaccttacccgtttaccggtccccgttacggtaaccgtaacgtaccgtagtacgttacgtacggtaacggtaaaccgttcggtaggtcctcgtaccaccgtactcgttacgtctttaccg

SEQ ID NO: 180062 - DNA, 523 bp, Homo sapiens
  misc_feature: GYAE6OF02GTBUX.52.14.B03.1.454.CMB.1.raw
  modified_base (196)..(196): a, c, t, g, unknown or other
  misc_feature (196)..(196): n is a, c, g, or t
  modified_base (375)..(375): a, c, t, g, unknown or other
  misc_feature (375)..(375): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggcagtcagaatattaataagtggttgcctgtatcagcagataccagggaaacgcccctaaactcctagatctataaggctactagtttagaagtgggtaccttagaaggttcagcggacagtggatcgtggacagaattcactcacacatacaacngacctgcacgcctagattgtatttgactaacttattactcgaccaactactaataatctaattacttctaccgtcctacgtttccgcccgttaggaacctaagtctagatacgtcgacgtactgtagctcgctaccatcttgtcttcg

SEQ ID NO: 180063 - DNA, 771 bp, Homo sapiens
  misc_feature: GYAE6OF02F7UO8.52.14.B03.1.454.CMB.1.raw
tcagcgcagtacgacacgaccggtgctcgatttagtgtgagtagttccgcgggggggagtcagacccagtcaggacacagcatggacatgagggtccccgctcagctcctggggctcctgctgctctggcctcccgaggtgaccaaatgtgacatccagatcgacccagtcctccttaccaccctgtctgcatctggtaggagacagtacgtacaccctatcctacgttcggcccggggccagtacaagaattattaaataggtggttggcctggtatcagcaagactaaccgaacgggaaaccgtaccccctaaactcccgtagtacttacgtaagtaacgggtcgttacgtttaaggtttaaggaaacgggttccggggttaccctttacggtaagggtttcgacggtcggacgtaggttgggtacttacggtacggggaactaagtaacttaccactcctaccaaccctaacgtaccaaacgtccggtccctacggacctaacgtccgtagtagttacgttacgttttacgaaccttaaacgttttaacgttaccggtacaacccgtaaaccttaaacgttaaactttaaacctacttaacgttttaaccttccccggttacccggtacccgtttacccgttttacccgggaccccgttaacggggtaacccctaacggtaccttaagtaccgttaaccggtacgggtaaccgttaaccgttggtaccggtcttcggacctaccgtaccttcgttacgtcctttaccg

SEQ ID NO: 180064 - DNA, 202 bp, Homo sapiens
  misc_feature: GYAE6OF02GK2HD.52.14.B03.1.454.CMB.1.raw
  modified_base (192)..(202): a, c, t, g, unknown or other
  misc_feature (192)..(202): n is a, c, g, or t
tcagcgcagtacgacacgaccggtgctcgatttagtgtgagtagttccgcgggtcagcctccaccaagggcccatcggtcttccccctggcaccctcctccaagagcacctctgggggcacagcggccctgggctgcctggtcaaggactacttcctcgtactgcgctgagcgggctggcaaggcgcatagnnnnnnnnnnn

SEQ ID NO: 180065 - DNA, 658 bp, Homo sapiens
  misc_feature: GYAE6OF02IM5V7.52.14.B03.1.454.CMB.1.raw
  modified_base (369)..(370): a, c, t, g, unknown or other
  misc_feature (369)..(370): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
tcagcgcagtacgacacgaccggtgctcgatttagtgtgagtagttccgcgggggggagtcagacccagtcaggacacagcatggacatgagggtccccgctcagctccgtggggctcctgctgctctggctcccaggtgaccaaatgtgacatccagatcgacccagtcctccttccaccctgtctgcatctggtaggagacagagtacaccatctacgttcgccgggctagtcaagaattattaataaggtggttggcctaggtatcagcaagactaaccgagggaaacctacccctaaactccagtacttctaagtaaggcttactaaggtttaggaaacggttcggtccttagaaggtcaggcgnnggtgatcgaggacagtactcatctacactatacaacncgactgctacgtcctagtattacgttntttacgacttaactttacgttacgtacgtaaccctaaactaactaataattaccttaactttacgttacccgttacccggtacctttaacccgtttcccggtacccggtacggtaaacctagtacccgtagtaacgttaccggtaccgtaaccggtacgttacggtaccggttccgtacggtacccctaaccgttaccgttacgtttaccgttaccgtttaccc

SEQ ID NO: 180066 - DNA, 573 bp, Homo sapiens
  misc_feature: GYAE6OF02FUHOF.52.14.B03.1.454.CMB.1.raw
  modified_base (195)..(195): a, c, t, g, unknown or other
  misc_feature (195)..(195): n is a, c, g, or t
  modified_base (324)..(324): a, c, t, g, unknown or other
  misc_feature (324)..(324): n is a, c, g, or t
  modified_base (372)..(372): a, c, t, g, unknown or other
  misc_feature (372)..(372): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggccagtcagaatattaatagtggttgcctggtatcagcagataccgagggaaacgccccctaaactcctagatctataaggcgtctagtttagaagtgggtccttnaggttcagcgcagtgatcgtggacagattcactctacaccatccaacngtcctgcagcctagatgtattttcgactaactttattacctacgtaccaactactaataacttctaatttacttccgtccgtacctacgttttccggcccttacggggtaacccaagtccttagaacgttacgtaccgggaaaccgtaacgttggttaccggcttacggacctaacccgtattccttcggttactttaccg

SEQ ID NO: 180067 - DNA, 956 bp, Homo sapiens
  misc_feature: GYAE6OF02IE3JH.52.14.B03.1.454.CMB.1.raw
tcagcgcagtacgacacgaccggtgctcgatttagtgtgagtagttccgcggggggagtcagacccagtcaggacacagcatggacatgagggtccccgctcagctccgtggggctcctgctgctctgtctcccaggtgaccaaatgtgacatccagatcgacccagtcctccttccacctgtctgcatcgtgtaggagacaggacgtccacctatcctaacgttcgggcccgggtacctaacggtcaaggtaaattaacgtttaaagtaaagggttcggggtttcgggaccccgtttaggggtaactttccgaacgggtccaaggtaaccgttaacccggaaacggggggtaaaaaccgtacccccccgttaaaaaccttcccgttacggaaactttaccgttaacggttaaacggggtaccgtttaccgtttaaaggtttttaacgggaaaacggggtttcggggggtttaaccccctttacggttaaaacggggtttcccgtaagggccggggtaccgtaagggttcgggtacgtttaccgggtaaggggggaacctaaacgggttaaaactttcccgtaaaccgtttacctaaacccggaaccccttaagttaacccgaaaaccgtaccggtaccctttaggaccctaacgggtccccgttaagtacgttaggtttaacttttccgggaacctttaaccgttttaactttaaaccggtccgtaaccctaaaacgttaccttaaaattaaccttacttaaacgtttttaccttacccggtaccccggtaccgtttacccggtttttacccgggaccccgtaagggtaaccccgtaacgttaccttaagggtaccgtttacggaacccgggtaaccggttaaacgttcgggtacggtacccgtacggtacccgtaaacccgttactttaccgtttccggtacttttaacccccg

SEQ ID NO: 180068 - DNA, 525 bp, Homo sapiens
  misc_feature: GYAE6OF02F4F3R.52.14.B03.1.454.CMB.1.raw
  modified_base (519)..(519): a, c, t, g, unknown or other
  misc_feature (519)..(519): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacgcccctaaactcctagatctataaggctctaagtttagaaagtggggtcccttagaaggttcagcggcagtggatcgtagggacagaattcactctcaccataccaacagcctgcagccctgatgtatttgactaacttattactgacctaaacactattaactctaattacttctacccgtcctacctttcggccctagggaccagtctagatagtcggaacacgtgtcggctcgacaccatctnttctcc

SEQ ID NO: 180069 - DNA, 574 bp, Homo sapiens
  misc_feature: GYAE6OF02F8LLM.52.14.B03.1.454.CMB.1.raw
  modified_base (195)..(195): a, c, t, g, unknown or other
  misc_feature (195)..(195): n is a, c, g, or t
  modified_base (373)..(373): a, c, t, g, unknown or other
  misc_feature (373)..(373): n is a, c, g, or t
  modified_base (417)..(417): a, c, t, g, unknown or other
  misc_feature (417)..(417): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggccagtcagaatattaatagtggttgcctggtatcagcagataccgaggaaacgcccctaaatcctagatctataaggctatagtttaggaacgtggggtcccttgaaggttcagcggcagtgatcgtggacagtattcactctacacatacaacngcctagcacgcctgatagtatttacgacttaacttattaacgtnaccgtaaacctacttaataaactctaacttactttccgtccggtcccttacgtttccgggaccttacgggacctaacgtcttaggtactaacgtacgggtaacgaaccgttggttacggctaccgtacgtacccgtagttcttacgttacctttacc

SEQ ID NO: 180070 - DNA, 740 bp, Homo sapiens
  misc_feature: GYAE6OF02IKSCG.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtcttccttccaccctgtctgctatctggtaggagacagtacgtcacatcacgttcgccggggcctagcaagaaattattaaataaggttggttggtccgttaggtatcgagctaaggaataaccgaagggaaaccgtaccccctaaaaccgttcctagtacttactaagtaacggtacgttacgtttaagtttaaggtaaaagggttcggggttacccttacgtaaggttacgaaggtccgggagtaggtgggtaacgtcggtacggtaacgtaagttaactaccgtacctccgtaccaaccgtaacttaaccgtaaccgtacgtccgtaccgtacgacgttacccgtagtagtttggtaacttttcgaacttaaacgtttaactttacgtacgtaacccgtaaaccctaattaactaattactaattttaccttaccggtaccgtacccgtttaccgtttccggacccgttacgggacctaacgtcgtacgtacgtaacgtaccgggtaaccgtacggttaccgacgggtttaccccggtacgtaccttaacgtccgtttaccttaccgttaccg

SEQ ID NO: 180071 - DNA, 629 bp, Homo sapiens
  misc_feature: GYAE6OF02GV7ZJ.52.14.B03.1.454.CMB.1.raw
  modified_base (167)..(167): a, c, t, g, unknown or other
  misc_feature (167)..(167): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggcctcccaggtgaccaaatgtgacatcccagatcgacccngtcctcccttccacctgtctgcatctggtaggagacagacgtccacacgtcactcggccggccagtcagaataataatagtggttcgctggtatcagcagactaccgaaggaaccacccctaactccagtactactaagtaacggtcgttactaagtttaaggaaacgggttcgggttacccttacggtaacggttcgagtccgggtacaggtggtacgttcgtacgggaactaagtaacgttcctacttccgtacctaacccgatacccaaacgacgtacctacgacacgtcctagattgttaattcgaccttacttacttactacaacctaactactaatactactacttacttccgtaccgtacctaccgttcccgaccgtacggaaccgtaacgtacgtaatcgtacgtaacggtaacgtactcggtcgctacggtaccaccgtatcgtactcctccg

SEQ ID NO: 180072 - DNA, 745 bp, Homo sapiens
  misc_feature: GYAE6OF02J0ZER.52.14.B03.1.454.CMB.1.raw
  modified_base (704)..(704): a, c, t, g, unknown or other
  misc_feature (704)..(704): n is a, c, g, or t
tcagcgcagtacgacacgaccggtgctcgatttagtgtgagtagttccgcgggggaggtcagacccagtcaggacacagcatggacatgagggtcccgctcagctcctgggctcctgctgctctggctcccaggtgccaaatgtgacatccagatcgacccagtctccttccaccctgtctgacatctgtaggagacagactcaccatccgacgttggccggtcagtctaagatattaatagtggttgcctggtatcagcagtactacgaacgggaaacgcccctaaactccgtgatactagtaagtccgttacgttaagttttagaaacgggtttccgggggttaccctttacgaacgggttttacgacggtaccgggtaccgaggtcgggttaagtcccggttaggggaaccagggttaaacttcgtaaccgttcttcaaacccctattaaccaaacctacggtaacctggacctaacgtcccgttagtaacgttaggttacgttttaccggaactttaaaccgtttaactttaacccgtcggttaaccctaaacgtaaccttagttaaacttaccttaagttttaccgttaccgtacccggtaccctttaacccgttttccggtacccgttaaccggtaacgttacggtacccttagttaacgttaaccgaccgggttaacggtaacttcgggtacggttntaaccgtaccacccgttaacttcgttacgttacctttcccg

SEQ ID NO: 180073 - DNA, 625 bp, Homo sapiens
  misc_feature: GYAE6OF02HW3CJ.52.14.B03.1.454.CMB.1.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggcagtcagaatattaataagtggttgcctggtatcagcagataccaagggaaacncccctaaactcctagatctaagtaaggctcttaagttagaaaggttcgggtaccttgaaggttcaggcgngagtgatcgtagggacagtacttcactctacacctatacaacacgctgcacgtcctgtatgtatttacgacttaactttacttactacgacctaaataccttaataacttactaacgtttacttacccgtacccggtacctttaaccgtttcccgggacccgtacgggtaacctaacggtaccttaaggtaacttaaccggtaccgggtaaacctaacggttcgggttacggtaccgttacgtaccctaaccgttacgttcctttacggttacctttacccg

SEQ ID NO: 180074 - DNA, 611 bp, Homo sapiens
  misc_feature: GYAE6OF02JY40V.52.14.B03.1.454.CMB.1.raw
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (291)..(291): a, c, t, g, unknown or other
  misc_feature (291)..(291): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (585)..(585): a, c, t, g, unknown or other
  misc_feature (585)..(585): n is a, c, g, or t
tcagcgcagtacgacacgaccggtgctcgatttagtgtgagtagttccgcggggggaggtcagacccagtcaggacacagcatggacatgagggtcccgctcagctcctggggctcctgctgctctggctccaggtgccaaatgtagacatccagactgacccagtctccttccacncgtgtctgcactntggtaganacgagagtcacctanactcttggcccggctagtacagaattactaagtaagtggttcggacctggtatcaggacagtacacgagggtaaaccnccctaaacttcacgtattaccgataaaggcgtactaggttagaacggtcgggtcttacgagtcaaggcgagacgttgattcngggaacgngtaaatcgaccttntaccacatacaacgacgtactacgacgtacgtacgtagtacgtagttagtttacgtacttaacgtttacgtacgtacctaacctaactaactaacttactaacttacttacgtccgtacgtaccgttaccgttaccggtaccgtacgtaccgtacgtactagtacgtacgttaccgtacgtaacgtacgngtacgtacgtccacgtactctacgtc

SEQ ID NO: 180075 - DNA, 728 bp, Homo sapiens
  misc_feature: GYAE6OF02FPN6D.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgctatctgtaggagacagagtcaccatcactgccggcagtcagaatataatagtggtgctggtatcagcagactaaccgagggaaactacccctaaactcctagactctaagtaacggtcgtacttaaggttttaaggaaacggttcggggttacccctttagaaacgggtttcaaggtccgggtactaggtacggacgttcgtaggggaacaaggtaacttacctaccgtccgttacccaaccctaagttaacccaaaccgacgtacccgtacgacccacggtacctaggtagttaggttacttttacgaccttaaaccttttaacgttacctacgtaccctaaaacctacgttaaactaaacttacttaactttacgtttaccgtacccggttacccgttaccgttttcccgggtaccccgttacgggaaccctaacggtaccgtacgttaacgttacggttaccggggtaaccgtaccggttacggtaccgggttacgttacggccctaaaccgttacgttccgtttacgttacctttacccg

SEQ ID NO: 180076 - DNA, 615 bp, Homo sapiens
  misc_feature: GYAE6OF02GEZT6.52.14.B03.1.454.CMB.1.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (383)..(383): a, c, t, g, unknown or other
  misc_feature (383)..(383): n is a, c, g, or t
tcagcgcagtacgacacgaccggtgctcgatttagtgtgagtagttccgcgggggaggtcagacccagtcaggacacagcatggacatgagggtccccgctcagctcctgggctcctgctgctctggctcccaggtgaccaaatgtgacatccagatcgacccagtctcccttccaccctgtcctgactatctgtaggacgacaagcgtccacctatccacgttggccgggcagtcaagtaatattaatagtggttgcctgtatcagcanataccagggaactcccctaaatcanatacatagctntagttagagtcggtcctagagtnagcgnagtgatgtaggacagtactcacttcacacataccaagcctaccgtgacncgtcctagtactagttacttcgaacttatttactacgtaacacctaaactataatttaaccagtttaaaccttacgtttcccggttaacccgtccgtttaacccgttcccgggacccgggttacgtaacccggtaataccgttaagaccttacgggtaaccggtaaacgtaccgttagggttccgacggttaccgaccctaacttaggtcccgttttacgacttttaccccg

SEQ ID NO: 180077 - DNA, 666 bp, Homo sapiens
  misc_feature: GYAE6OF02I800L.52.14.B03.1.454.CMB.1.raw
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (526)..(526): a, c, t, g, unknown or other
  misc_feature (526)..(526): n is a, c, g, or t
tcagcgcagtacgacacgaccggtgctcgatttagtgtgagtagttccgcgggggggagtcagacccagtcaggacacacgcatggacatgagggtccccgctcagctccgtggggctcctgctgctctggctcccaggtcgccaaatgtgacatccagatcgacccagtctccttaccacctgtctgccatctagtaacggagactagactcaccatcgacttcggcccggacacgtcagtaactatttaagtaagtggttggccttggatcagacagtactacgacggaacgtacccctaactaccgtagtactacttacgtaacggtcttacgtaaggttttaacgaaaggttcccgggttaccctagtaacgggttccaacggtccgggctaaggtcggtaacgtccgttacgggaactaggtaaacgttcaacgttcacaacctagtacaaacgcncgtacncgacgccgtgtactggtatttacgactacgtttattacgactacgaaactccgttaaanacttcaacttttcgacccgttccggtcctttacgttacccggtaccgtccgggtaaacacgggttaccagtacctacggtacggtaacgttacgcggttaacgcgttaccacgtaacttcgttcctaggttccttaccgg

SEQ ID NO: 180078 - DNA, 632 bp, Homo sapiens
  misc_feature: GYAE6OF02FRT4X.52.14.B03.1.454.CMB.1.raw
  modified_base (125)..(125): a, c, t, g, unknown or other
  misc_feature (125)..(125): n is a, c, g, or t
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctntggctcccaggtgccaaatgtgacatccagatgacccagtctccttccaccctgtctgctatttgtaggagacagagtcaccatcactgccggcagtcagtatataataagtgtgcctgtatcngcagataccgagggaaacncccctaaactccagtatctaagtaggcgtacttaaggtttaagtaaaggtcggggtaccctttcgtaaggtttcgaaggtccggacaggttcggagtcgtagggacaagtattaccactctacactactccaacacgtcctgacctacgtccctaggtattacgttagttttcgtaacttaaacctttacttactacgtaccctaaactacttaataatccttaatttacgttcccttacccggtaccttaccgttttcccgggaccgttacgggtaaccctagtacttacggtactacgtacgggtaacgtaccgtgggttcgaccgtcgaccctacgtcttacgttcttccgttactacccg

SEQ ID NO: 180079 - DNA, 673 bp, Homo sapiens
  misc_feature: GYAE6OF02GEBXU.52.14.B03.1.454.CMB.1.raw
  modified_base (294)..(294): a, c, t, g, unknown or other
  misc_feature (294)..(294): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggcctcccaggtgccaaatgtgacatccagatcgacccagtcctcccttccacccctgtctgcatctgtaggagacagacgtcaccatcacttcggcccgggccaggtcaagtaaattattaaataaggtggttcggcctggtatcagcagataccgaagggaaacncccctaaactcctgactctaagtaaggcgtactaaggtttaagaaacgggttcggggttcccttacgtaaacggttcaacggcggtacaggtggtaactcggtaggggactaacggaacttccgactcctaccacctataccaacgtagtctacgcgacgcctagtaacttgtacttttcgaaccttaactttacttaacctcgtaaccctaaacttaacttaaacttaaacttacttaactttacgttccgtacccgttaccctaacccggttttcccggtacccgtacgggtaacctaacgtacccgttagacgttacggaccggtaaccgtaaggtcgggttacgcgttacgcctacctcgttcgttctcttaccg

SEQ ID NO: 180080 - DNA, 688 bp, Homo sapiens
  misc_feature: GYAE6OF02GIVXE.52.14.B03.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (387)..(387): a, c, t, g, unknown or other
  misc_feature (387)..(387): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtcctccttccaccctgtctcgctatcgtgtacgganacagacgtcaccatcacttcgccggcagtcaagaataattaanaagtggttacgcctaggtactcgagacagtactaccgaagggtaaaccgccccttaaacgtcctagacgtactaaacgtagggtcgttacgtaagtttaacggaacggttccgggttacccttacgaagggttcaggccgganaggtcgtagtcgtaggacagtacttcacgtactaccacctanaccaacnccgtaccgcgtacgcgttaccgtatgttacgtttacgttaacaccgtttacgttacttaccgacgaaacccgttaataacgttacttaacgttaccttaacgtttaccgttcccgttacccgtcctttaaccggtccggaacccgttcggaaaccgtacgtacgtacgttaggttaccggtaacccgggaattaccggttcggtaccgtaccgttgaacccctacgttacttcccgtagtaccctttaaccg

SEQ ID NO: 180081 - DNA, 663 bp, Homo sapiens
  misc_feature: GYAE6OF02IZ8DY.52.14.B03.1.454.CMB.1.raw
  modified_base (163)..(163): a, c, t, g, unknown or other
  misc_feature (163)..(163): n is a, c, g, or t
  modified_base (253)..(253): a, c, t, g, unknown or other
  misc_feature (253)..(253): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (390)..(390): a, c, t, g, unknown or other
  misc_feature (390)..(390): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccngtctccttccaccctgtctgcatcgtgtaggagacagacgtcacatcacgttcgccggcagtcagaactataagtagtggtcgctggtancagacagactacgaagggaacaccctaatcctgatctagtaacggtctatagtagaacggtcggtcctanaggttcaggcganaggtgactcggtaggaactagtaacttcgaccgttcactaacacttacgaaacncggtacctacggcaacgttcctaggtaacttggttaacgtttagacccttaaatttcgtaaccgttacgaccgttaaaactactttaaagtaacttacttacgttttaaccttacccggtacccgttaacccgtttaacgtttccccggtaccggttacggtaaacctaaggttcctaacggtaacgttacggtaacccgtaaccggttaacgcgggtttaccgcgtttaacccgacgttaacccgttacgttcgttaccggtccctttaccg

SEQ ID NO: 180082 - DNA, 623 bp, Homo sapiens
  misc_feature: GYAE6OF02H7LX8.52.14.B03.1.454.CMB.1.raw
  modified_base (203)..(203): a, c, t, g, unknown or other
  misc_feature (203)..(203): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
tcagcgcagtacgacacgaccggtgctcgatttagtgtgagtagttccggcggggggagtcagacccagtcaggacacagcatggacatgagggtccccgctcagctccgtggggctcctgctgctctggctcccaggtgaccaaatgtgacatccagatgaccctagtcctccttcccaccctgtctgctatcgtgtagganacagtgtacacatctatcgccggcagtcagaataataatagtgtcggctgatnagnagatacgaggaacncctaatcctagatactaagagtctacgttagttaagaacggttcgggtccttagtacgttcagcgacgtagcggtagcgttagggactagtacttacactacncgacactacactacgcgtacncgacgtacacgtattaggtatttacgtactaactttaacttacgtaccaccttaaacaacttaaataattaccgtaacttacgttaccctacccgttccttaccggtttacccggttacccgttaaccggaccggttaacaccttaagacgttaaccggttcggaaaccgtacgtccggtaccgtacgttacgacctacggttacttacgttacgttccttaaccg

SEQ ID NO: 180083 - DNA, 541 bp, Homo sapiens
  misc_feature: GYAE6OF02G5OE2.52.14.B03.1.454.CMB.1.raw
  modified_base (271)..(271): a, c, t, g, unknown or other
  misc_feature (271)..(271): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
  modified_base (489)..(489): a, c, t, g, unknown or other
  misc_feature (489)..(489): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagatataataagtggttggctggtatcagcagataccagggaaacncccctaaactcctgatctataggcgtctaagtttagaaaggttgggtcccttnaacggttcagcgacngtgatcgtggacagtactnactcncacctatcaacncnctgcacgctgatgtatttgctaacttattacncgaccaacactataactactaactttacttaccgtccgtacctaccgttttccgacccgttacgggaaccaagctaggtntacgtcggtaactaacgttggtacggctcgacctactacttcttcgttctcc

SEQ ID NO: 180084 - DNA, 796 bp, Homo sapiens
  misc_feature: GYAE6OF02G6K6K.52.14.B03.1.454.CMB.1.raw
tcagcgcagtacgacacgaccggtgctcgatttagtgtgagtagttccgcggggggagtcagacccgagtcaggacacagcatggacatgagggtccccgctcagctcctggggctcctgctgctctggctccaggtgccaaatgtgacatccagatcgacccagtctccttccaccctgtctgcatctgtacggagtacagtacgtccaaccactcgtaaccttcggacccgggaccctaggtactaagtaaagttaagttaaagtaacggttgggtttacggccttaggttaactcgagccaagaactaaccgaacgggtaaaccgacccccttaaacgtcccgtagtaacttaccgtaagtaacggtccggttacgttaaggtttaacggaaaacggttcggggttaccccttaagtaacgtttccgagggtccggacgtaggtcggtaacttccggtaggggaactaacggtaaactttccgaaccgttccttaaccggaacctacttaacccgaacgtaccgcgttacgacgtaaccggtcccttaagtagttaccggttaatttcggtaaccttaaacgtttacgttactaaccggtacctaaaactaaccgttaactaaacggttactaacgttttaacctccggttaaccccgtccgtttaaccggttcccgacccggttacggtaacccgtattaccgttacggaacgtttaccggtaaccgggtaaccttaacgtggtacccggtacgtaccgtaccaaaccgttcgttaccgtacttaccctacg

SEQ ID NO: 180085 - DNA, 816 bp, Homo sapiens
  misc_feature: GYAE6OF02FGGPV.52.14.B03.1.454.CMB.1.raw
  modified_base (196)..(196): a, c, t, g, unknown or other
  misc_feature (196)..(196): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccgaggtgaccaaatgtgacatccagatcgacccagtctcctccacctgtctgcatctagagganacgagtacgtccacctatccacgttccggcccgggacaggtaccaagtaattaacgtttaagtaaggttggggttcgaccttagggtaactccgaaggcctaacgtaccgtaaccggaaacggggtaaacctcccccttaaatccgtagtacttacgtaacgttaaggtcttaacgttaaggtttaaacggaaaccggtttccggggttaaccttaacggacgggtttaccaacgggtccggtacgtaacgggtagtaccgttacgggtaacgggaaactaacgttaaccgttaaccgaccctttaccgtaaaccctaaccgtacttaaccggaacccgtacgtacccgtaggacctacggtacgtaacgttacgttacggttaccttttaacggaaccctttaaacgtttaccgttaaaccgtaccgtaaaccctaaaccttaactaacctttaaccttaacttaactttacccgttacccgttaacccggtacccgtttaaccgtttcccggaccgttaacggacctaacgtacgtacgtaacgtacggtaccggtaacgtaccggttacgtaccgacgttacgtacccaacggttcctacgttcgttacccttaccg

SEQ ID NO: 180086 - DNA, 584 bp, Homo sapiens
  misc_feature: GYAE6OF02IUDR9.52.14.B03.1.454.CMB.1.raw
  modified_base (273)..(273): a, c, t, g, unknown or other
  misc_feature (273)..(273): n is a, c, g, or t
  modified_base (356)..(356): a, c, t, g, unknown or other
  misc_feature (356)..(356): n is a, c, g, or t
  modified_base (409)..(409): a, c, t, g, unknown or other
  misc_feature (409)..(409): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagacgtcaccatcacttgccggcagtcagatataatagtggttgcctggtatcagcagactaccgaagggaaacncccctaaactcctgattctaagtaaggcgttacttaaggtttaagaaaggtcggggttcccttacgtaaggttcaaggcgganagtggatcgtaggacagtaattccactctacaccactcgaactgcctagcacncctagattgtatttcacttaactttattactacgacccaaatacttaataactactatttacttcccgtaccgtacccttacgttccgtacccgaggaccctaagtactagattaccggaacggtaccgtaagtggtacgcgtcgaccaccgttacttaccgtcgttcctacccg

SEQ ID NO: 180087 - DNA, 746 bp, Homo sapiens
  misc_feature: GYAE6OF02F0W6Q.52.14.B03.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttcgccggccagtcagaatataanaagtggtgcctgtatcagcagataccgagggaaacncccctaaactcctantactagtaagcgtatagtttaagaaggtcggggtacccttagtaacggttcaaggtcggactacggtggaacttcgtagggaactaagtaaatttccgaacttaccgtaccctaacctaacgttaaccgaacgtacgtacccgttacggacccgtaacggtccccttaggttaacgttaggttaacgttttacggaacctttaaacttttaaagtttacctaccgtaaacccttaaacccgttaaactttaaacttaaaccgttaccttaaacgtttttacctttaccccggtttaccccggggtaacccctttacggggtttttcccccgggaacccgtttacgggaacccttaaacgggacctttacgtaacttaaccggtacgggtaaacccgttaacggtaggtttccggaccgttacgtaaccgaccttaacgttcgttacggtttcccttaccg

SEQ ID NO: 180088 - DNA, 817 bp, Homo sapiens
  misc_feature: GYAE6OF02INDED.52.14.B03.1.454.CMB.1.raw
  modified_base (546)..(546): a, c, t, g, unknown or other
  misc_feature (546)..(546): n is a, c, g, or t
tcagcgcagtacgacacgaccggtgctcgatttagtgtgagtagttccgcggggggagtcagacccagtcaggacacagcatggacatgagggtccccgctcagctccgtggggcctcctgctgctctggcctccaggtgccaaatggtgacatccagactcgacccagtcctcccttccacccgtgtctacgcatcgtgtaggacgacagacgtcaacactcacgttcgccggcagtcagtaatattaagagttggttacgtcctaggtactcgagtacaagactaacccgaagggtaacctaccccctaaacgttcctaggtaacttacgttaaggttaaccgggtccgttaacgtttaacggtttaacgggtaaacggtttccggggttaacccccttttaagggtaaacgggtttccgaaacgggtcccggtaaggtacgggtttacggtaacgtttaccggtaacggggaacctaacggttaaaactttacccgtacgtttaccacccgtaacctacgtaaccaaccgtacgtcccgttanacccgtaccggtactggtaagtttacgttcgtttacgaccctttaaagttacgttccgtaaccgtaacctaacttacgtaacttaagttaccttaacggtttcttaccccggtaccggttacccttaacggtttacccccgacgggtttaacgggaaccccttaaggtccgggttaataaccgggtcggtttaaacccgggagtttaccggttacgggttaccggaccttaccgggacctaaccgttaccgtttctcccgttactacccgg

SEQ ID NO: 180089 - DNA, 829 bp, Homo sapiens
  misc_feature: GYAE6OF02I57V5.52.14.B03.1.454.CMB.1.raw
  modified_base (198)..(198): a, c, t, g, unknown or other
  misc_feature (198)..(198): n is a, c, g, or t
tcagcgcagtacgacacgaccggtgctcgatttagtgtgagtagttccgcggggggagtcagacccagtcaggacacagcatggacatgagggtccccgctcagctcctgggctcctgctgctctaggctccaggtcgaccaatgtgacatccagtatcgacctagtctcctccacctgtctgctatcgtgtagaganacgagtacacatcctacgtcggccggtaccagtcaagtaattactaacgtaggtgttcgctaggtactcgagtacgagtaacgtaccgaacgggtaaacctccccgttaaacttcccgtagtaacgttaccgtaaacggtaacggttccgttaacggttaacggttttaacgggaaaacgggtttcccggggttaacccttttaacgggtaaaccggtttacgaccgggtacggtaacgtaggtttacggtaccgttaacgggtacgggtaaccgttaacggttaacttaacgtacccgtacgtttaccgaaccgttacgttaaaccgacgtacccggtacgtaccgtacctagggtaccttaacgtacggtttacgtttaacggttactaaccgttaaatttccgttaacgttaccgtaaccttaacgtaacttaaccgtaagttacttaaacgttcccgttaacgtacccgttaacccgttcgtttaccggtacccgtaaacggttcccgtaaagtcccggttaagtacggtttaaccgaacgggtttaacccttaagggttaccgacgtttaacccggtatcccgtaaaccgtttcggtttaacccgttacgtccctttttaaaccgg

SEQ ID NO: 180090 - DNA, 645 bp, Homo sapiens
  misc_feature: GYAE6OF02JM11R.52.14.B03.1.454.CMB.1.raw
  modified_base (345)..(345): a, c, t, g, unknown or other
  misc_feature (345)..(345): n is a, c, g, or t
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
  modified_base (538)..(538): a, c, t, g, unknown or other
  misc_feature (538)..(538): n is a, c, g, or t
  modified_base (582)..(582): a, c, t, g, unknown or other
  misc_feature (582)..(582): n is a, c, g, or t
tcagcgcagtacgacacgaccggtgctcgatttagtgtgagtagttccgcgggggagtcagacccagtcaggacacagcatggacatgagggtccccgctcagctccgtgggctcctgctgctctggcctcccgaggtcgacctaaatgtgacatccagactcgaccctgtcctcccttccaccctgtctgctatctgaggagacagacgtcactatctacgtcgccggacctagtcaagtaataacgttaaagtaggttcggttggtccgtaggttatacgagacctaagactaccggaagggtaaaccaccccgttaactccgtagtactacgtaataccggnttaacgttaaggttaagacgggttccgggtacccttaggtacggttacgaaggccggtactaggtgccttaggtaggactaaacgttctccgacctctacgacctanaccgaatccnccgtanaccgtacgtcgtatagttactactttcgaattaaccgttattacgtacaccgtaactataactattactntacccgttcacgttacccgtaccgttccgacgtacggaccgtanacgtgactacggtaccgaatcgtacgtcgacctcgtaccacggtatccgtacgttcctaaccg

SEQ ID NO: 180091 - DNA, 801 bp, Homo sapiens
  misc_feature: GYAE6OF02H54SU.52.14.B03.1.454.CMB.1.raw
tcagcgcagtacgacacgaccggtgctcgatttagtgtgagtagttccgcggggggagtcagacccagtcaggacacagcatggacatgacgggtccccgctcagctccgtgggctcctgctgctctggcctcccaggtcgaccaaatggtagaccatccagatcgacccagtcctccttccaccctgtctgcatcgtagtaggagacagacgtccaacctatctacgttcggcccgggtacagtcaagtaattaattaagtaaggttcggtcggaccgttaggtactacgaggacgaagtaacgtaacccggaaacgggtaaaccctacccccgttaaaaccgttccgtacgtaacgttaacgttaaacggtaaccgggtaccgttaacgtttaaagggtttaacggtaaaaccggggttttccggggttaacccctttaaccggtaaacggtttaccggaacggggccgggttacggaacgggttacgggtacgtttacggggaacggtaaacggtaaacggttaaacgtaccgtcccttaccgtaaccgtaaccctaacgttaaccgaaacccgtcgtaccgtacgtacccgtacggtaccgtacgtaagttacgttacgtttaacgtacttaacgtttaacgtactacgtaacctaaacgtacttaataactactttattacctaccgtcccgtaccgttccgtttcgaccgtacggaacttacgtacacgttacacggtcgtaacgtacgtcgttacgccgtacgaccgtaacttcgttacgttccgttattcccg

SEQ ID NO: 180092 - DNA, 774 bp, Homo sapiens
  misc_feature: GYAE6OF02FJ009.52.14.B03.1.454.CMB.1.raw
  modified_base (143)..(143): a, c, t, g, unknown or other
  misc_feature (143)..(143): n is a, c, g, or t
tcagcgcagtacgacacgaccggtgctcgatttagtgtgagtagttccgcgggggggagtcagacccagtcaggacacagcatggacatgagggtccccgctcagctccgtggggctcctgctgctctggcctcccgaggtanacctaaatggtagactatccagatacgaccctagtcctcccttccaccctgtctgactatctaggtaggagacgagtacgtacacctatcctacgttcggacccgggactagtcaagtaagttaattaagttaaggttgggttacggccgttaggtaactacgagacaacgtaacgtaaccggaaacgggtaaccgtaccccttaactccgtagtactactaacggtacggtcgttagtttaaggtttaaggtaacgggttccgggttaccttacggtaacggttcgacgggtcggtacgtagggttacgacgttcggtacgggaaactacgtaacgttacctactacctaccaacctactaaccgactcgtaccgtaggcctacgtactagtacgttagttacttacgacctttacttaactacgtacctaacaacttactaaactacgttacttaacgtttacctacccgtacccgtttaccggttaccccgtttacccgggtacccggttaaccggtaaccgttaacggtaccgtaacggttaacttaccgggtaaccggttacggtacggttccggaccggtgtacccaccgttaccttacggtaccctttacgttaccttacccgg

SEQ ID NO: 180093 - DNA, 784 bp, Homo sapiens
  misc_feature: GYAE6OF02JR4QN.52.14.B03.1.454.CMB.1.raw
  modified_base (386)..(386): a, c, t, g, unknown or other
  misc_feature (386)..(386): n is a, c, g, or t
tcagcgcagtacgacacgaccggtgctcgatttagtgtgagtagttccgcggggggagtcagacccagtcaggacacagcatggacatgagggtccccgctcagctccgtggggctcctgctgctctggctccaggtgccaaatgtgacatccagatgacccagtcttccttccacccttgtctagcatccgtgtaggagacaggagtccaaccatctacgttcggccggccagtcaagtaatattaataggtggtcgctggtatcgagcagtacgtacgacggaacgtacccctaaatcctagacttactaagtacgtcgtcgttagttaagaacggttcgggtacccttagaacgttcgaggtcggtactaggtgacgttacgngggactagtacttactacgtcctactaaccgtatacactaccggcttagacgtaccgtaccgttgtacttaggttactttacgaacctttaaacgtttacttaaccgtacgtaacccttaaacgtaacgttaaacttaccgttactttaacgttttaaccgtttcccggtaacccccgggtttaacctttcccggggtttaaccccggtttaccccggtaaaccggggttaaaccccgttaaacggggtcccttaaaacgtaccgttttaaaccggtaaccggggttaaccccgtttaacccgggttaacgggtacccgggttttacctacccgggttaaacccgttaaccccggttacgttttacccgggtttacccgttaccggtttttaaccccg

SEQ ID NO: 180094 - DNA, 630 bp, Homo sapiens
  misc_feature: GYAE6OF02JKP4N.52.14.B03.1.454.CMB.1.raw
  modified_base (423)..(423): a, c, t, g, unknown or other
  misc_feature (423)..(423): n is a, c, g, or t
tcagcgcagtacgacacgaccggtgctcgatttagtgtgagtagttccgcggggggaggtcagacccagtcaggacacagcatggacatgagggtccccgctcagctcctggggctcctgctgctctggctcccaggtgccaatgtgacatccagatgacccagtctccttccacctgtctgctatcttagtaggaactacagagtccaccagttcactgcccgggcagtcagatattagtagtgtgctggtatcagcatataccgaggaaacgccctaaactcctcgtactctaagtaggtcgttactaggtttagtaaacggttcgggttaccctttggaacgggtttcaggtacggacgtggtaggacttcgtagggtacagtaacttcgactcgtaccactactactaacgcgtaaccncgacacgtccgtgtaatagtattttagaccgtaatttacttacgaccgtacctaaaccgtaattaactacttacgtactttacttaccgtccgtacctcgtttaccgtcccgttaacggacccgtaataccgtacgtacgtaacgttccggaacgttacgtcggtacgttacgtacgccttaaccgtacgtccgttattccttaccg

SEQ ID NO: 180095 - DNA, 758 bp, Homo sapiens
  misc_feature: GYAE6OF02GAL2D.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccaggtgaccaaatgtgacatccaagatcgaccctagtcctcccttcccaccctgtctgctatctggtaggacgacagagtccaaccatccacgttcggcccgggccagtcaagtaattaacgttaatacggtggttcgccgtaggtatcagcaagactaaccgaaggtaaaccgacccccttaaactcccgtagtacgttactaacgtaacggtaccgttacgttaacggtttaaggtaaacggttcgggttaccccttaagtaacgggttcacggtcggtacgtaggttacggtacgtcgtacggaactagtaacttacaccttcctaccgacctacgtaccaaacgtcgtccgcgacgtacgccgtagtattacggttaacgtttcgaacctaaaccttttacgttacctaaccgtaaccctaaaccgttaacgttaaacttaaccttactttaaccttaccgtttcccggtaacccgttacccgtttaccgggttcccgtaccccggtaaacggtaaaccgtactacccggttaggacctttaacggtaacccgggtaacgttacgttaccgggtgttaccgtacgtacccgtacttaccggtactttccggtaccctttccg

SEQ ID NO: 180096 - DNA, 762 bp, Homo sapiens
  misc_feature: GYAE6OF02HFEBT.52.14.B03.1.454.CMB.1.raw
  modified_base (261)..(261): a, c, t, g, unknown or other
  misc_feature (261)..(261): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctccaggtgaccaatgtgacatccagatcgaccagtctcctcacctgtctgcatcgtggtaggagacagagtccacctatctacgttcgccggcagtcagaatattaatagttggtgtctgtatgagcaganacgaggaaccgccctaaactccgtagtactcgtaacgtaacggcgttacttaaggttaaggtaaacggttccggggttacccttaggtaacggtttacgaacgggtcggtaacgtagggtacggacttacgggtaggaacgtaacggtaacttaccgaccttacctaccgtaaccgtacgtaactaacgtacgaccgtcgacgtagtacccgtagtacgtttaacgtactttaacggacctttaaacgtttaactacgtaaccttaaccgaaaccttacttaaacttaaacgtttccttaaacgtttacctacccggtttacccgttacccgggtttaaccgttttccgggaacccggttaaccggtaaccgtaaacgttaccttacgggttaaacgttaccggtaaaccggggttaacctaagggtttccgggttacggaacctttacccggaacccggttaccttaacgggttccgtttaccgtttaccgttaacccgg

SEQ ID NO: 180097 - DNA, 195 bp, Homo sapiens; identical to SEQ ID NO: 179939
  misc_feature: GYAE6OF02FSVMB.52.14.B03.1.454.CMB.1.raw
  modified_base (192)..(195): a, c, t, g, unknown or other
  misc_feature (192)..(195): n is a, c, g, or t

SEQ ID NO: 180098 - DNA, 782 bp, Homo sapiens
  misc_feature: GYAE6OF02JY9VI.52.14.B03.1.454.CMB.1.raw
  modified_base (740)..(740): a, c, t, g, unknown or other
  misc_feature (740)..(740): n is a, c, g, or t
  modified_base (761)..(761): a, c, t, g, unknown or other
  misc_feature (761)..(761): n is a, c, g, or t
tcagcgcagtacgacacgaccggtgctcgatttagtgtgagtagttccgcgggggagtcagacccagtcaggacacagcatggacatgaggtccccgctcagctccgtgggctcctgctgctctggctccgaggtgtaccaatgtgacatccagatcgacctagtctccttccacctgtctacgctactcgttagtaggacgactagtacgtccaacgtactcctacgttcggacccgggtaccaacgttaccgtaagtaatttaaagtttaaacgtaagtttcggtttaccgggttacgttacggttaacttaccgtaaggccaaggtaacgtaacccggaacggggtaaacctacccccgttaaaaccgtccgtacgtaacgtacgtaagttaaccgggtcgtttaacgttaacggtttaagggaaacggtttccggggttacccttaaggtaaccggttacgaacgggtacggtctaagggttaccggtaacttccgggttaagggaaccgtaaggttaaccttccgtaaccgttacctacccgtaaccgtaattaacccgaagtacccgtacgtcggtaccgaacgtccctaaggtattcgtttaacgttacgtaacctttacgttaataccgttacaccttaacgtactattaacgtactacgttcctacggtccgaacttcccggtttacgccgtacgactagacgtatacgtagtccggaactggttaaccgngttccgacctacggttaaccnctttacgttcgtctttacccg

SEQ ID NO: 180099 - DNA, 871 bp, Homo sapiens
  misc_feature: GYAE6OF02GM3X6.52.14.B03.1.454.CMB.1.raw
tcagcgcagtacgacacgaccggtgctcgatttagtgtgagtagttccgcggggggacgtcagacccagtcaggacacagcatgggacatgagggtccccgctcagctcctggggcctcctgctgctctggctcccgaggtcgaccaaatgtagacatccagatcgaccagtctcctccacctgtctcgctatctaggtaggacgacgagacgtaccaacctatacctacgttcgggacccgggacctaagtcgaaagtaattaacgttaaagttaagggttcgggtttacggtccgttagggtaacttacgaacggtactaacggtaactaaacccggaaacgggggtaaacccgtacccccttaaaacgttcccgtaggtaactacgttaaacgtaaccgggtccgtttacgttaaggtttaaacggaaacgggtttccggggtttaccccttaaggtaaaccgggtttcgaaccgggtccggacgtaacggtacgggtaaccttcgggtaacggggtaactaacgtaacgttccgaaccttccgtaacctaaccctaacgttacccaaaccgtacgtacccgttacgccgttaacgtaccgtagtaactttacgtttaactttcgtaacttaaaccgtttagttaacccgtaacgtaaccttaaaccgtaaacttaaacttaacctttaccgttaaacgtttacccgttaacccgtacccggttaacccgttacccgtttacccgggtaacccggttaacggaaacctaacgtaacgttaaccgtagtttaacccggaaccggtaaaccggtacgttcggtaccgaacttacgacctaaaccgttagttccgttacttaccttacccg

SEQ ID NO: 180100 - DNA, 636 bp, Homo sapiens
  misc_feature: GYAE6OF02GBN4V.52.14.B03.1.454.CMB.1.raw
  modified_base (100)..(100): a, c, t, g, unknown or other
  misc_feature (100)..(100): n is a, c, g, or t
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (265)..(265): a, c, t, g, unknown or other
  misc_feature (265)..(265): n is a, c, g, or t
  modified_base (582)..(582): a, c, t, g, unknown or other
  misc_feature (582)..(582): n is a, c, g, or t
tcagcgcagtacgacacgaccggtgctcgatttagtgtgagtagttccgcggggggagtcagacccagtcaggacacagcatggacatgagggtccccgntcagctcctggggctcctgctgctctggctcccaggtgccaaatcgtgacatccagatgacccagtctccttccaccctgtctgctatctgtaggnacagagtcaccatcacttgccggcagtcanatataanagtgtgctgtatcagcagactacgaggaaacnccctaaactccagactctagtaacgtcgtctaagtttaaggaaagtcggggttacccttacgtaaggttcaggcggctaggtggagtcgtagggactaaggtaacttcacgtctacgaccactacgaacacgtcctacgacacgtcctagtaacgttgttactttcggaacttaactttagttaaccgttcaaccgtaaacctacttaataacttcgtaaactttacgtttccgtacccggtaccttaccggtttaccgtacccgtaggtaacccgtaagtccgtagtacttaacggtaaccggtaaccggttaacncgggttaccgtacgtcgtacccgtaacgtacgttaccgttacgttccttaaccg

SEQ ID NO: 180101 - DNA, 798 bp, Homo sapiens
  misc_feature: GYAE6OF02F9DNR.52.14.B03.1.454.CMB.1.raw
tcagcgcagtacgacacgaccggtgctcgatttagtgtgagtagttccgcggggggagtcagacccagtcaggacacagcatggacatgacgggtccccgctcagctcctggggcctcctgctgctctggcctcccgaggtcgaccaattgtcgacactccagtatcgacccagttccttcccttccacccttgtcctgctatcgtgaggtacacagacgtaccaccgatcgtacgtcggcccggcacgtcgaagtaattaacgttaagtaggttcgggttcggaccttaggtacgtctacgacgtaacggtaacctaacccgggaaacgggtaacccgtacccccttaaaactccggttacgactttaccgaaggttaacggaccgtttacgtttaacggttaacgggtaaaccgggtttccgggttcccttttaaccgaaagggtttaccggaggtaccggtaagtaacggtagggttacgtacgggtcgggtaaccgtaagtaacgttccgtaaccttccgtacctactacgttacccgaactaccgtccgtaaccgtaccgccggtaacgtcgttaccgttaggtttactttacgtacctaaaccgttcgttacctacgtaacaaccttactaacttactagttacttacgtccgtacccgtctttcccggttacggtaccccgtacgggtaacctacggtgttacgtaacgtttaccgggtacgtaacggtcccggttagtcccggaccgttacgaacccgttacgtacgttcccgttagttcccgttaaccg

SEQ ID NO: 180102 - DNA, 868 bp, Homo sapiens
  misc_feature: GYAE6OF02IRAZJ.52.14.B03.1.454.CMB.1.raw
  modified_base (101)..(101): a, c, t, g, unknown or other
  misc_feature (101)..(101): n is a, c, g, or t
tcagcgcagtacgacacgaccggtgctcgatttagtgtgagtagttccgcgggggggagtcagacccagtcaggacacagcatggacatgagggtccccgntcagctcctggggctcctgctgctctggctcccaggtcaccaaatgtgacatccagatcgaccagtcctcccttccaccctgtctgctatcgtaggtaggacgtacaggacgtccaacctagtacctacgttcgggacccgggacctaggtacaagtaaattaattaagtaaggttgggttcggtaccgttaggtactcgagacgagtaactaccggaacgggaaaaccgtcccccttaaaaccgtccgttagtaacttacgttaacggtaacgggtaccgttttacttaaggtttaaacgggtaaacgggtttcccgggtttaccccttttaaggtaacgggtttaccggacgggtccggtacgttaacgggtcgggttaacttaccgggggtaacgggtaacctaaaagggtttaaccgttttacccgaaccggttttacccgaaccttaaaaccccgttaacgttaacccgtaaaacgtaccccggtaacccgttacgggaacccgtaacggtacccggttacggtaagttacgtttaagtttaccgtaacttaaccgtttaacgttaccgtaaccgtaaccctaaacgttaacgtaacttaaaccgttacttaacgtttaccgttacccgttacccgtccgtttaccgtttcccgggtacccgttacggtaacctaagtacgttacgacgttacggtaaccggtaaccggtaacggtcgttacggtacttcggaactaccgtactcgttacgttcttaacccg

SEQ ID NO: 180103 - DNA, 744 bp, Homo sapiens
  misc_feature: GYAE6OF02FG5VI.52.14.B03.1.454.CMB.1.raw
  modified_base (284)..(284): a, c, t, g, unknown or other
  misc_feature (284)..(284): n is a, c, g, or t
tcagcgcagtacgacacgaccggtgctcgatttagtgtgagtagttccgcggggggagtcagacccagtcaggacacagcatggacatgagggtccccgctcagctcctggggctcctgctgctctggctcccaggtgccaaatgtgacatccagatcgaccctagtcctccttccaccctgtctgccatctgtaggagacagagtcaccatccacttcggccggcagtcagtaatattaagaggtggttggcctggtatcagcagactaccgaaggggtaacnccccgtaaactcccgtagactacctaataaacgggctacgttaacggtttaaggaaaacgggttgggggtcccctttagaacggtttcaacggccgggtactaggtcggtaagtcggtaggggtacaggtaacgtttccaacttccgtacctaaacccattaaccgaaaccaccgtccgttacgacacggtaccgtacgaattacggtaattttacgtactaaacgtttactttcctacggtaaccctaaacgtaaacttacgtaacttacgttaacctttaacgttacccgtacccgggtacccttaaccggttttccccgcccgggttaacgggaaacccttaacggtaccggtttaaccacgttaaccggtaacgggttaacggaaaccccgttaggtccgggtaccttaccggacctaaacccgtaccgtaggtttacccgtttccgtttaaaccc

SEQ ID NO: 180104 - DNA, 703 bp, Homo sapiens
  misc_feature: GYAE6OF02GIOQ0.52.14.B03.1.454.CMB.1.raw
tcagcgcagtacgacacgaccggtgctcgatttagtgtgagtagttccgcggggggagtcagacccagtcaggacacagcatggacatgagggtccccgctcagctccgtggggctcctgctgctctggcctcccaggtgccaaatgtcgacatccagatcgacccagtcctcccttccaccctgtctgcatctggtaggagacagactcaccatcctactcggcccggtacagtcaaggtaattaagttaagtaagttggtcgacgttaggactcagctaagactacgaacgggaaacgtacccctaaacgtccgtagtactacgtagtaacggtctacgttaaggttaacgaaggttcgggtaccttacgtaaggttcgaggcggtacgtaggtagacgtcgtaggaactaagtaacgtcaactctaccgaactatacccaaacgcgtaccgtacgacacggtacctaggtacttacgttaagtttacgaacccgtttaagtttaacttaccgtaacgtaccaaaacgtaccttaaataaccgttacttatttaccggttcccgtaacccggttccttaccggtttccggaccccgttacggaaccgttaacgtaccgtacgtaacgtaccggtaacggaccttaacggtacgtggtaccctacggtacctaaccgttcgtttaccttacgttacttaccc

SEQ ID NO: 180105 - DNA, 808 bp, Homo sapiens
  misc_feature: GYAE6OF02JFZVE.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccgaggtgacctaaagtgtgacatccgagtatcgaccctagtcctccttccgaccctgtctgacattcgtgtaggagacagacgtaccacctatcctacgttcggccccgggacctaaggtaccaaggtaacttaagttaagtaagttaggttcggtccgttagggtactcgagtacgtaacgtacgtaaccggaacggggtaaacctaaccccttaaacgttcccgttacgtaactttaccgtaagttaacgggtccgtttaacgttaacggttttaaacgggtaaacgggtttccggggttaccctttaacgggtaacggtttaccgaacggccggtagtacggttacggtaacgttcggtaacggggtaactaaagttaacgtttaccctaccgttaccgttaacccaccgttaaccgtaacaaaccgtcggtaaccctcgtaaccgtacgccgttaggttacgttaagtttacttaccgtaacctttaacgtttacgtaaccggtcttaaacccaactttaacccgttattaaccgttactttaatttaccgttcccgtacccggtctttaccggttcccgtccggtacggtaaccacgttacgtacgtactaccgggtaacggtacgttactcggaccgttgtccgaacctcttaagtccttacgtctaccg

SEQ ID NO: 180106 - DNA, 846 bp, Homo sapiens
  misc_feature: GYAE6OF02F1XWR.52.14.B03.1.454.CMB.1.raw
  modified_base (126)..(126): a, c, t, g, unknown or other
  misc_feature (126)..(126): n is a, c, g, or t
tcagcgcagtacgacacgaccggtgctcgatttagtgtgagtagttccgcgggggggagtcagacccagtcaggacacagcatggacatgagggtccccgctcagctcgtggggctcctgctgctntggcctcccaggtgaccaaatgtgacactccagatcgacccagtctcccttccacctgtctgctactctagtaggacgacgagacgtacacctatctacgtcggccgggaccagtcaagtaattaattaaacgtaggttaggttcggtaccgtaggttataccgtaggtacgactaacgtaaccgggaacgggtaaaaccgacccccttaaatcccgttacggtacttacctaaagggttaaccggtacggttaacggtttaacggtttaaacggggtaacgggttttccccgggggttaacctttaccggtaagggtttacccggaggtacccggggtacgtaaggggttacggtaagttaccggggtagggtaaaccttaacggtaaactttacccgtaacccttcgttaacccaacccgtaactaacccgtaaaccgtcgtacccgtcggaacgtaccgtaccgttaacgttacgttacgttaacttttacggaacctttaacgttttaacgttacccgtagttaaccccaaaccttaaacgttttaccaactttaccgtttactttaacccggttcccgtttaccgtccccttaccggttacccgtacccggtaacggtaaccgtaacgttaccgttacgtaacggtacctaacccgggtaggtacgttacggcgtcgtacgtaccgtacgtacctttccgttagttccttaaccc

SEQ ID NO: 180107 - DNA, 751 bp, Homo sapiens
  misc_feature: GYAE6OF02G2V3G.52.14.B03.1.454.CMB.1.raw
tcagcgcagtacgacacgaccggtgctcgatttagtgtgagtagttccgcgggggggagtcagacccagtcaggacacagcatggacatgagggtccccgctcagctcctggggctcctgctgctcgtggctcccaggtgacctaaatgtgacatccagatcgaccctagtcctcccttcccgaccctgtactgcatcgtgtaaggagacaggacgtacaacctatacctacgttcggacccgggacaagtacgaaagtaaattaagttaaagtaaaggttggttacggaccgttaggtaactagaagtacaagtaacgtaaccgaacggggaaaactacccccttaaaacgtccgtagtaactaccgttaagtaaacgggtccgttacgttaaaggttaacgggtaaacgggttcgggttaccccttaagtaaacgggttcaacggccggtagtaacggttaggacttacgggtaaggaactaaagtaacttaccgtaacctacctacgaacctataaccaaaccgcgaccgtagacacgtacctaggacttagtactttacggaccttaaacttagttacctacgtaacctaaactacgtaataactacgttaactttaccttaccgtaccggaccgttaccgttaccgggaccttaacggaaccgtaagagttacgtaacgtacggtaacggaacgtaacggtgtacggtaccttagacccgttaccgattccgtacgtctttacccg

SEQ ID NO: 180108 - DNA, 629 bp, Homo sapiens
  misc_feature: GYAE6OF02GU3RR.52.14.B03.1.454.CMB.1.raw
  modified_base (360)..(360): a, c, t, g, unknown or other
  misc_feature (360)..(360): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtgccaaatgtgacatccagatgacccagtctccttccactctgtctgcatctgtaggagacagagtcaccatcactgccggcagtcagaatataatagtggttgctggatcagcagataccgaagggaaacgacccctaaactcgtagatactaagtaacggctacgttaagtttaagaaaggttcggggtacccttagaaggttcaggcggacagtgatcgngggaacagaacttcactctaccacctataccaacacgcctagactacgcctaggattgttaactttacgaccttaaactttattaaccgtcgtaacctaaacgtacttaaagtaacttacttaacgtttacttacccgttacccggtacctttaacccggtttcccggacccgttaacggggaacctaaggtacccgttaagtaaccgttaacgtacccgggaaactaaccggtggttacggcttagaccctaactcgtacttcgtacc

SEQ ID NO: 180109 - DNA, 706 bp, Homo sapiens
  misc_feature: GYAE6OF02IO15Z.52.14.B03.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (478)..(478): a, c, t, g, unknown or other
  misc_feature (478)..(478): n is a, c, g, or t
tcagcgcagtacgacacgaccggtgctcgatttagtgtgagtagttccgcgggggggagtcagacccagtcaggacacagcatggacatgagggtcccccgctcagctcctggggctcctgctgctctggccccctaggtcgactaaactgtgtacactccagtatcgacctacgtcctccttcccgacccttntccgtnctactcgtaggtaggacgacgtagtacgtccaactatcctacgtccggcccggactacgtacaagtaactaattaagtaaggttggttcggtacttaggtactacacggtacaaacgtagtaaaccgacgggtaaaccgtacccctaaccgttactacgaatacctaaggtaacgtcgtacgtttaataggtaacggtccggggtacttaacgttagttcacggacgtacgtaaggtcgtacgcggtttaggaacgactttaaacggctacccttacnccaaccgtatacctaaccgctacgcgtacaagccttagactaggttattacgaacttaacttacttaactacgtaacctaacgtacctaaagtataaccgttacttactaccgttaccctccgttacttaccgggtccgtaccggtaaactacgaccgtaagtacttcgtacggaaacgtaccgtagtccgaacgtccgaccgtatagttcctacttcggtcctacgg

SEQ ID NO: 180110 - DNA, 853 bp, Homo sapiens
  misc_feature: GYAE6OF02GBRWJ.52.14.B03.1.454.CMB.1.raw
tcagcgcagtacgacacgaccggtgctcgatttagtgtgagtagttccgcggggggagtcagacccagtcaggacacagcatggacatgagggtccccgctcagctcctggggctcctgctgctctggctcccgaggtgaccaaagtgtgacatccagactcgacccagtcctcccttccaccctgtctgctactcgtaggtaggacgtacgagacgtcaccgtactctacgttacggcccgggtaccagtcaaggtaatttaacgttaaagtaaggttcggggtttacgggtaccccgttagggttaacttaccggtaacgtaccgaacggtaaccgttaaccgggaaacgggaaaaccggtaaccccccttaaaacgttcccgtaacggtacttaaccgtaagttaaccggggtcttaaccggtttaaaggttttaaagggtaaaaccggttccgggggttacccctttacggtaacgggtttaccgaggtacgggtacgaacggtttcgggtaacgttcggtacgggtaactaacggttacttaaccgcttacgtaccctacctacgttaaccaacgtaccgtcctacgaccggtacgtacccgtgtaacgtttgttaacgtttacgaccttaaacgttctttaacggtaccaacgtaaccgtaaacttataacgttactaacttaacttcccggtttacccgtacgtttaccccggtttccgggaaccctaaccgggtaacctaaccgtacggttaactacgttacggtaacccggaaaccgttcggtaacggttccggtacgtaccgtacccgtaaccgtaccgttccgtttaccggttaacctcccg

SEQ ID NO: 180111 - DNA, 852 bp, Homo sapiens
  misc_feature: GYAE6OF02J0E9H.52.14.B03.1.454.CMB.1.raw
  modified_base (162)..(162): a, c, t, g, unknown or other
  misc_feature (162)..(162): n is a, c, g, or t
  modified_base (202)..(202): a, c, t, g, unknown or other
  misc_feature (202)..(202): n is a, c, g, or t
tcagcgcagtacgacacgaccggtgctcgatttagtgtgagtagttccgcgggggagtcagacccagtcaggacacagcatggacatgagggtccccgctcagctcctggggctcctgctgctctggctccaggtgccaaatggtgacatccagatgacccngtcctccttccaccctgtctgcagtctgtaggagacaggngtcaccatcacttggccggtccagtcagaattataactagttggttgacctggtatcgacgtcaagactaaccgagggaaaccgtaccccgtaaactccctaggtactcgtaacgtaacggtacggtttaccttaaagggtttacggaaaaagggttccgggggttaccccttttaacggtaaacggggttttacccagggttaccccgggtaacggtaaccgggtttacgggtaaaccctttcgggggtaccggggttaaaaccgtaacggttaaaaccggtttcctaaaccggtttccccgtttaaaccaccccgggtaaaacttaaccccggaaaccgtttaaccggaacccttttcgggacctaaacccgttcgaacgttcggtttacggtttaaccttttaaccgggtaacttaaccgtttaaactttacccggtaacgttaccccgtaaacttaaccgtaactttaacccgggttattaaggtttaacccttacccgggttttacccgtacccttaaccgttttcccgaccggtttacggtaccccaaaagggttccgttaacgaacggttaccgtaacggtaaccggtaacgttcgtccgggtactacccgaacgttacctatttaccgccgttttagacccc

SEQ ID NO: 180112 - DNA, 794 bp, Homo sapiens
  misc_feature: GYAE6OF02FK9X9.52.14.B03.1.454.CMB.1.raw
  modified_base (139)..(139): a, c, t, g, unknown or other
  misc_feature (139)..(139): n is a, c, g, or t
  modified_base (197)..(197): a, c, t, g, unknown or other
  misc_feature (197)..(197): n is a, c, g, or t
tcagcgcagtacgacacgaccggtgctcgatttagtgtgagtagttccgcgggggggagtcagacccagtcaggacacagcatggacatgagggtccccgctcagctcctggggctcctgctgctctggctcccaggtnaccaaatgtgacatccagatgacccagtcctccttccacctgtctgcatctgtagganacagacgtacaccatcctacgttcggcccgggccagtacaagtaattaattaagtaaggttggttcggtccgttaggtactcgagacgaagacgtaaccgaacggggaaaccgtacccccctaaatcccgtagtactacgtaagtaacggtcttacttaaggtttaaggaaacgggttcggggttacccttacgtaacgggttccaaggccggtacgacggttacggacgttcggtagggtaacgaacggttaacttaccgaccttaacctaccctaaacccgactaaccaaccgtacgtcccgtacgaccgtaacgtaccgttacgtaagttacgtttacgttttaacggaaccgttaaacttttacgttaaccgtaaccctaacctaaaccttaacttaaacttaaccgttactttaacttaccgtttaccccgtacccggttacccttacccggtttacccgtacccggtaacgggaaccgtaaccgtacgttaacgtaacggtaaccggttaaccgggaaccgttaacggttcgggtacgttacccgtacgtaaccctacccgttaacgtccgtttaccgtttaccttacccg

SEQ ID NO: 180113 - DNA, 500 bp, Homo sapiens
  misc_feature: GYAE6OF01A0XU7.26.37.D04.1.454.CMB.1.raw
  modified_base (203)..(203): a, c, t, g, unknown or other
  misc_feature (203)..(203): n is a, c, g, or t
  modified_base (475)..(475): a, c, t, g, unknown or other
  misc_feature (475)..(475): n is a, c, g, or t
  modified_base (489)..(489): a, c, t, g, unknown or other
  misc_feature (489)..(489): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactcccaggctcctcatttatgctgcatccaccagggcccactggtatcccagccaggttcagtggcagtgggtctgggacagagttcactctcacatcagcagcctgcagtctgaagtattgtgtctaatttattactgtacagctaatataatacctggcctccgctcactttcggcggaggaccgtaggttgagtntacgaaacgactgngctcgctccta

SEQ ID NO: 180114 - DNA, 488 bp, Homo sapiens
  misc_feature: GYAE6OF01AI8FL.26.37.D04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaagngtcaccctntcctgcaggggccagtcagagtgttagtcgcggctttagcctggtaccagcagacacctgggcagactcccaggctcctcatttatgctgcatccaccaggccactggtatcccagccaggttcagtggcagtgggtctgggacagagttcactctcaccatcagcagcctgcagtctgaagattgtgcaatttattactgtcagcaatataatactggcctcgctcactttcggcggagggaccaaggttgagatcaaacgatgtggctgcncntc

SEQ ID NO: 180115 - DNA, 510 bp, Homo sapiens
  misc_feature: GYAE6OF01ESOPH.26.37.D04.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (372)..(372): a, c, t, g, unknown or other
  misc_feature (372)..(372): n is a, c, g, or t
  modified_base (505)..(505): a, c, t, g, unknown or other
  misc_feature (505)..(505): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactcccaggcctcctcatttangctgcatccaccagggccactggtactcccagccaggttcagtggcagtgggtctgggacagagttcactctcaccntcagcagcctgcagtctgaagattgtgactaatttatactgtacagcaattataactacctggccctccgctcacttcgggcgtagggaccaagggttcgagtactacgaaacgatggtggctaggcctacgnttccg

SEQ ID NO: 180116 - DNA, 516 bp, Homo sapiens
  misc_feature: GYAE6OF01C5X0F.26.37.D04.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (394)..(394): a, c, t, g, unknown or other
  misc_feature (394)..(394): n is a, c, g, or t
  modified_base (513)..(513): a, c, t, g, unknown or other
  misc_feature (513)..(513): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactccaggctcctcatttangctgcatcccacagggccactggtactcccagccaggttcagtggcagtggtctgggacagtagttcactctcaccatcagcagcctgcagtctagaagtnttgtgtactaatttattactgtcagtctaaatataactaccgtgccttcgctcgtacgtttcgggacggtacggaccgtaaggttcgagactacgaaacgactgtcggtactgcacgtntcg

SEQ ID NO: 180117 - DNA, 519 bp, Homo sapiens
  misc_feature: GYAE6OF01BQXCC.26.37.D04.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
  modified_base (485)..(485): a, c, t, g, unknown or other
  misc_feature (485)..(485): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttagtcgcggcttagcctggtaccagcagacacctgggcagacctcccaggcctcctcatttangctgcatccaccgngggccagtggtactcccagccaggttcagtggcaggtggtctgggacagtacgttcactctcaccntcagcagcctgctagtctagaagtattgtagtactaattttatactgtacagactaatataactaccgtcggcccttcgctctacgttcggacggtacggacctaggtnaagactcgaaacgtcgtgtcgctagcctctgtcg

SEQ ID NO: 180118 - DNA, 710 bp, Homo sapiens
  misc_feature: GYAE6OF01BQ4ZR.26.37.D04.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgttagtcgcggcttagcctggtaccagcagacaccgtgggcagacctccaggcctcctctatttancgctgccatccaccgagggcccacgttggtactccccgagccgtaggttccaggtgggctagggttcgggtcgtgggaactaggtacgtttccaacttcctaccaccgtatccaggacctacggaccgttcgacgtacgttacgtacggtaaagttacgtttaggttacgtacctttaaagtttttacttacgtttacggtacctaaggtacctaaagtttaacttaaacgttacccgttccgggtaccccttacccggtaccgttacccgttaacccggttttccggggaccggggttaaccgggggaaaccccgttaaggggttacgaaacggttaacgttaacccgtaaaaaccgggtaccgttacgggttacgggtacccgttacgggtaccctaacccggtacg

SEQ ID NO: 180119 - DNA, 521 bp, Homo sapiens
  misc_feature: GYAE6OF01CG2JR.26.37.D04.1.454.CMB.1.raw
  modified_base (200)..(200): a, c, t, g, unknown or other
  misc_feature (200)..(200): n is a, c, g, or t
  modified_base (300)..(300): a, c, t, g, unknown or other
  misc_feature (300)..(300): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactcccaggctcctcatctacggaacntccgaaccggccactggcatcccagacaggttcagtggcagtgggtctgagacagacttcactctcactatcagacagactggagtcctagtaagtatttgctagtgtaattactgtacagctagtatgtctaccgtactactttcccgttgtactttcggccgagggacctaagctaggtactatacaaacgtaactgtaggtactacgacactgtctcg

SEQ ID NO: 180120 - DNA, 779 bp, Homo sapiens
  misc_feature: GYAE6OF01E6FCF.26.37.D04.1.454.CMB.1.raw
tcagagactatactcacgaccggtgctcgatttagtagcatactgttgggtttgggggaggaactgctcagttaggacccagccggaaccatggaagccccagcgcagcttctcttcctcctgctactctggctccagataccacgtggagaaatagtgatgacgcagtctccacgcccacctgtctgtcgtcgtaccgaagggaacacgtccaccctctccgtgcgacgggcctagtcgaggtagttgttacggtccggcggtccgttacggccgttacggtaaccagaccgaacgaccgaccggtcggggaccacgtaccctccgacggtcctaccttactagttttacgcgtccgtacgacctaaccgttacccgaaccggtaccgggtacccttaccggttaccggtaacccgtacccggacggtaccggttacggttaccgtaagggtccgggtacggttaggggttcgggttaccggtacgggtaacctacggttaccgtttacccgtaacccgttccctaacccgaaccgttaccgtaccccgaaccgtaccggtccgtacgtaccgttacggtttaacgtaacggttaattttacgttacgacgttacgttaacttaacgttcgtacgtactagtaaacttagttaacgtacgtttcgcgttccgttccggttacgggtaccggggacgactagtcggtaaggtaccgtacgtaccgaacgttcggtcggtaccgcctacgacctaccgtttgttcccgttcgtttacccg

SEQ ID NO: 180121 - DNA, 621 bp, Homo sapiens
  misc_feature: GYAE6OF01BJRRL.26.37.D04.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (615)..(615): a, c, t, g, unknown or other
  misc_feature (615)..(615): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaaggggaaancgtccaccctctcctgcgagggccagtcagagtgttagtcgcggtcttagcctggtaccagcagacaccgtgggcagacctccgaggcctcctctatttancgctgccatcccaccgagggccagtggtactcccagcctaggtcaggtcgcaggtgggtctgggactaggtactttcacttcgtacaccgtatccgagccacggtcctaggaccgagttccgtaagaaacggttagttcggtaagtaccttaaattttacgtacgtggtaccaagtactaaagttaactaaaccgttacccgtcggtcccttaccgcttaccgtacggtttcccgggagggaaccggtaaccgtagggtttaggaacgtaactaccgaaaacgtacgttcggacggtacctacgacccncgtaac

SEQ ID NO: 180122 - DNA, 544 bp, Homo sapiens
  misc_feature: GYAE6OF01AOMIH.26.37.D04.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggctttagcctggtaccagcagacacctgggcagactccaggctcctcatttangctgcatccaccagggccacgtggtactcccagccaggttcaggtggcaggtgggtctgggacagagttcactctcacatcagcagcctgcagtctgaanttgngactaatttatactgtacagcaattataactacccgtggcccttccggctaccgtacgtttacgggccggtaagggtacccgtaagggtttcgaacggtataccgaaaacggtaacgttcggtaggacctggaccctacgtacg

SEQ ID NO: 180123 - DNA, 501 bp, Homo sapiens
  misc_feature: GYAE6OF01EWAD6.26.37.D04.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttagtcgcggcttagcctggtaccagcagacacctgggcagactccacggctcctcntttatgctgcatccaccagggccacgtggtatcccagcccaggttcagtggcagtgggtctgggacagagttcactctcaccatcagcagcctgcagtctgaatattgagctatttattactagttcagctaatataatacctgccttccgctctacgttcggcggtaggacctaggtagagactcgaaacgactgtagatgcgacta

SEQ ID NO: 180124 - DNA, 654 bp, Homo sapiens
  misc_feature: GYAE6OF01CDPEH.26.37.D04.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtcctccgaaggggaaancgtccaccctctccngcagggccagtcagagtgttagtcgcgtcttagcctggtaccagcagacacgtgggacacgacctcccgaggcctcctactatttangctgaccactcccaaccgacgggcccagtcggtacctccccgaggtcccgtagggttccaggttcggacgtagggttcgggtcgtaggggaactaggttacgttaccacgttcgtacccaaccgtactaccgacgccgacgtcccgtagaccgtacgttcgtaaggtaagttagttcgtagttaactttaaagttttacttacgttacgtactaagtaactaaattaacgttaacctaccgtacggtccctaccgtcttaccgtacgtttcgggacggtaacggtaacgtaagggtcgaagtacgtaacgaaaccggtacgtacggtcgtactacgacctacgtgttcg

SEQ ID NO: 180125 - DNA, 523 bp, Homo sapiens
  misc_feature: GYAE6OF01ACPDK.26.37.D04.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtcggtgtctccaggggaaangtcaccctctcctgcagggccagtcagagtgttagtcgcggcttagcctggtaccagcagacacctgggcagactccaggctcctcatttangctgcatcccaccagggcccacgtggtactcccagccaggttcagtggcagtgggtctgggacngagttcactctcaccatcagtacgcctgcagtctagaagtattgtgactaatttattactgtcagactaatataactacctgcctccgctctacgtttcggacggtacggaccgtaggttgagtactacgaaacgtacgtggtaggctcgacacctctcgtgttac

SEQ ID NO: 180126 - DNA, 510 bp, Homo sapiens
  misc_feature: GYAE6OF01A96BF.26.37.D04.1.454.CMB.1.raw
  modified_base (204)..(204): a, c, t, g, unknown or other
  misc_feature (204)..(204): n is a, c, g, or t
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagatattaccggaaaaataatgatgactcagtctccaggcaccctgtctgtgtctccaggggaaagngtcaccctctcctgcagggccagtcagagtgttagtaacaacttagcctggtaccagcagaaacctggccaggctcccaggctcctcatctctggtgcatccaccagggccactggtatcccggccagattcagtggcaggggtctgggacagaatcactctcaccatcaccagcctgcagtctagaagtattttgcgtagtctaattactgtcagacaatataatactggctctcgttcgggcggggtaccaggctggangtacgacgaatggngtntgcaccgntctntcttcactctcccgcc

SEQ ID NO: 180127 - DNA, 573 bp, Homo sapiens
  misc_feature: GYAE6OF01DWY5M.26.37.D04.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccacctgtctgtgtctccgaggggaaanagtcaccctctcctgcagggccagtcagagtgttagcgcggtcttagcctggtaccagcagacacgtgggcagactccaggctcctctatttangctgcatcccacgagggccagtggtactcccagccaggttcaggtggctaggtcggtctagggacaggacgtccactcctacaccatcagcacgcctgctagtctaggaagtattgtagtacttaattttacttacgtgtactaagtactaaattaattaacttaccgtcggtcccttccgtacttacgtaccggtttccgggacgggtacgggtaaccgtaagggttacgaagtactacgaaaacgtacgtaggtacgtactacgactacctgttcg

SEQ ID NO: 180128 - DNA, 575 bp, Homo sapiens
  misc_feature: GYAE6OF01C0W50.26.37.D04.1.454.CMB.1.raw
  modified_base (201)..(201): a, c, t, g, unknown or other
  misc_feature (201)..(201): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactcccaggctcctctatttatgctgcatccacgaggccactggtactcccagccaggttcagtggctaggtggtctgggacaggtagttcactctaccacatcagcacgcctgcagtcgtagaacgtattgtagtacgtaatttattactgtacagtactaaatattaactaccgtggcccttccggtcttaccgtaccgtttacgggaccgggtaacggggtaaccgtaagggttcgaaggtacgttaaccgaaacggtaacgtcggttacgggacctaggacctacccgtagttaccg

SEQ ID NO: 180129 - DNA, 563 bp, Homo sapiens
  misc_feature: GYAE6OF01EYWOI.26.37.D04.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (409)..(409): a, c, t, g, unknown or other
  misc_feature (409)..(409): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaangtccaccctctcctgcagggccagtcagagtgttagtcgcggcttagcctggtaccagcagacacctgggcagactccaggctcctcatttangctgcatccacagggccacgtggtactccccgagccctaggttcagtggctaggtgggtctgggacaggtagttcactctacaccatcacgtcagcctgctagtctagaagnttgtgtactaatttattactgtacagtacaattactaataccgtggcccttccgctctaccgtttcgggacgggtaacgggtaccgtaagggttagaacgtaacgtaacgaaaaccggtacgttacgggttacgaccgtcggtaccaccgtacg

SEQ ID NO: 180130 - DNA, 506 bp, Homo sapiens
  misc_feature: GYAE6OF01EN56B.26.37.D04.1.454.CMB.1.raw
  modified_base (203)..(203): a, c, t, g, unknown or other
  misc_feature (203)..(203): n is a, c, g, or t
  modified_base (441)..(441): a, c, t, g, unknown or other
  misc_feature (441)..(441): n is a, c, g, or t
  modified_base (503)..(503): a, c, t, g, unknown or other
  misc_feature (503)..(503): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactccaggctcctcatttatgctgcatccaccagggccactggtactcccagcccaggttcagtggcagtgggtctgggacagagttcactctcaccatcaacagcctgcagtctagtaagtattttgctagtttattactgtcagtcagtatcatgactggccnctcaccgttcggaccaagggaccacggacgtaggagtattaaacgactggtcgctagcaccngtc

SEQ ID NO: 180131 - DNA, 498 bp, Homo sapiens
  misc_feature: GYAE6OF01AKV5W.26.37.D04.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
  modified_base (495)..(495): a, c, t, g, unknown or other
  misc_feature (495)..(495): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacacctgggcagactcccaggctcctcatttangctgcatccaccagggccactggtactcccagccaggttcagtggcagtggtctgggacagagttcactctcaccatcagcagcctgcagtctgaagtattgtgctaatttatactgtcagctaatataactacctggcctcgctcacgttcggcggacgggaccaaggttcgagatcgaaacgtactgtggctgcacgtntcg

SEQ ID NO: 180132 - DNA, 565 bp, Homo sapiens
  misc_feature: GYAE6OF01BSFDX.26.37.D04.1.454.CMB.1.raw
  modified_base (296)..(296): a, c, t, g, unknown or other
  misc_feature (296)..(296): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttagtcgcggcttagcctggtaccagcagacacctgggcagactcccaggctcctcatttangctgcatccaccagggccacgtggtactccccgagccgtaggttcaggtcggcaggtgggtctgggacaggacgttcactctacaccatcagcacgcctgctagtcgtagaagtattgtgtacttaatttacttacgtgtacagactaattaataacttaccgtggtcccttccgtctaccgtaccgtttcgggacgggtacgggaaccgtaagggttcgaagtacgtaccgaaacgtacgttcggtcggtctagacctacctgttccg

SEQ ID NO: 180133 - DNA, 687 bp, Homo sapiens
  misc_feature: GYAE6OF01C0ZFB.26.37.D04.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagagactatactcacgaccggtgctcgatttagtagcatactgttgggtttgggggaggaactgctcagttaggacccagccggaaccatggaacgccccagcgcagcttctcttcctcctgctactctggctcccagataccactggagaaatagtgatgacgcagtctccagccaccctgtctgtgtctccgaggggaaanagtcaccctctcctgcagggccagtcagagtgttacgtcgcggtcttagccgtggtaccagcagacaccgtgggcagactccaggctcctctatttangctgcactccaccgnggccctagtggtacncccgagtccgtaaggttcaggtcgggactagggttcgggtactggggaacctggtaacgtttccaacgttcctacaccctatcgacgcgacgtccctgtaccacggttcgaaggtaagtacgtttaggtacgttaacttaacgttttacgttacccgttaggtacctaaagtaccctaaattaaccgtttaaacccgttcccggttaccggttaccccttcggtacccgttacccgtttacccggtttaccggggaaccggttaaccggggtaacccgttaaggggttacgaacggtaaccgttaaaccggaaaacggttcggtacggtacggtacctcgtccgtaacttaccg

SEQ ID NO: 180134 - DNA, 747 bp, Homo sapiens
  misc_feature: GYAE6OF01BUAQR.26.37.D04.1.454.CMB.1.raw
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctccagataccactggaagaaatagtgatgacgcagtctccagccaccctgtctgtgtctccgaaggggaaagngtccaccctctccttcgagggccagtcagagtgtagcgcggcttagctggaccngcagacncgtggcagcctccaggctcctntatttangctgcactccacgacgggcctacgtggtacctcccgagcccgtagggttccaggtcggcgtaggttcggggtcgtggggaactaggtacgttccacttcctaccaacctagtaccgacggccacggtcccgttaggacccgtaggttccgtaaggtaaacggttacgtttacgggtacgttaacctttaaaagttttttacgttaaccgttcggttaactaaacggtaacttaaaactttaacgttaaacccgtacccggtttaccgggtacccctttacccgggacctttacccggtacccggttttaccgggggaacccggggtaaaccgggggtaacccgtttaaacgggggttcgtaaaacgggtaaccgttaaaccggtaaaacccggttaacgttaggggttacccgtaccggttaccgaccccgttaaacgttcgtttacccgg

SEQ ID NO: 180135 - DNA, 605 bp, Homo sapiens
  misc_feature: GYAE6OF01DQCBK.26.37.D04.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (375)..(375): a, c, t, g, unknown or other
  misc_feature (375)..(375): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagcccaccctgtctgtgtctccgaggggaaangtccaccctctcctgcagggccagtcagagtgtagtcgcggcttagcctggtaccagcagacaccgtgggcagacctccaggcctcctcatttangctgcactcccacagggccactggtactcccagccaggttcagtgcaggtggtctgggacagagttcactctacaccntcagcagcctgctagtctaggtaacgtatttgagtacttaaagttttacttactgtacagtaactaattaactaacttacccgtgggtaccccttccggtacttaccgtaaccggttttccggggaccgggtaaacgggaacccgtaaggggtttaccgaagtaacgtaaccgaaaaccggtaaccgttcgggtacgggtacttacggcccttaaaccgtgtttacccgg

SEQ ID NO: 180136 - DNA, 591 bp, Homo sapiens
  misc_feature: GYAE6OF01BTRXD.26.37.D04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
  modified_base (417)..(417): a, c, t, g, unknown or other
  misc_feature (417)..(417): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccacctgtctgtgtctccgaggggaaangtccaccctntcctgcagggccagtcagagtgttagtcgcggcttagcctggtaccagcagacaccgtgggcagacctcccgaggtcctcctntattttangcctgccactcccgacgagggccctagtggtactcccgagcctagggttcaggtcggcaggtgggtctgggactggtacgttcactctcaccntcagcagctgcagtctagaagtnttgtgtacttaatttactactgtacagtactaaataataacgtaccgtcggacccttccgaccttacgtaccggtttcgggaccggtaacgggtacccgtaagggttcgaaggtacgtaaccgaaaccggtacgttacggtacgggtaccttacggacctaaccgtcgttaccg

SEQ ID NO: 180137 - DNA, 554 bp, Homo sapiens
  misc_feature: GYAE6OF01BS0CA.26.37.D04.1.454.CMB.1.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttagcgcggcttagcctggtaccagcagacacctgggcagactcccaggctctcatttangctgcatccaccagggccactggtactcccagccaggttcagtgcagtggtcngagacagacttcactctcactatcagcagactggacgctagaagtattttgctagttgtattacgtgtacagtacagttatcgtacttaccttcttacgtttcccggtagttaccgttttcggacccggtacggggtacccaaggtccgtaggtaacttaacgtaccgtaaaacgtacgttaggtacggtactcggacctaccgtacg

SEQ ID NO: 180138 - DNA, 531 bp, Homo sapiens
  misc_feature: GYAE6OF01BUIWD.26.37.D04.1.454.CMB.1.raw
  modified_base (203)..(203): a, c, t, g, unknown or other
  misc_feature (203)..(203): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacacctgggcagactcccaggctcctcatttatgctgcatccaccagggccactggtactcccagccaggttcagtggcaggtgggtctgggacagagttcactctcacatcagcagcctgcagtctagaagtattgtcgactaattttatacttgtcagactaatactaataccgtggccctccgctcgtacgtttcgggccgggtaaggaccctaagttggttagacgtaactaccgaaaacgtacgtggtaggctggcctaaccg

SEQ ID NO: 180139 - DNA, 602 bp, Homo sapiens
  misc_feature: GYAE6OF01CCBQX.26.37.D04.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (428)..(428): a, c, t, g, unknown or other
  misc_feature (428)..(428): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttagtcgcggcttagcctggtaccagcagacaccgtgggcagacctcccaggctctcatttangctgcatccacgngggccagtggtactcccgagccctaggttccaggtggctaggtcggtcgtggggaactaggtacgttccgacttcgtaccacctatcacgcacgcctgctagtctaggaagtgtttcgngtacttaattttacgttactgtacaagtactaaattaactaactaccgttcggcccttacgaccttcgttaccggtttcgggaccgggtaacgggtaacccgtaagggttacgaagtacgtaaccgaaacggtaacgttcggtacggtacctacgaccgtaccgtacgttaccg

SEQ ID NO: 180140 - DNA, 633 bp, Homo sapiens
  misc_feature: GYAE6OF01DQPO0.26.37.D04.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
  modified_base (389)..(389): a, c, t, g, unknown or other
  misc_feature (389)..(389): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttagtcgcggcttagcctggtaccagcagacaccgtgggcagacctcccgaggcctcctctatttancgctgcatcccaccgagggccacgtggtactcccgagccaggttcaggtggctaggtgggtctgggacaggtagttcactctacaccntacagcagcctgcagtctagaagtattgtagtacttaattttattacttgtacaagtacttaaataacttaacgttacccgtcggtacccttacccgtaccttacccggttaaccggtttccgggaccggggtaaacgggtaacccggttaaaggggtttacggaacggttaacgttaacccgaaaaaccgggtaaacgttcggggttaacggtcccgtaaggccctaaacccgttcgttcccg

SEQ ID NO: 180141 - DNA, 595 bp, Homo sapiens
  misc_feature: GYAE6OF01EKCAR.26.37.D04.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggaagaaatagtgatgacgcagtctccagcccaccctgtctgtgtctccgaggggaaangtccaccctctcctgcagggccagtcagagttgttagcgcggcttagcctggtaccagcagacaccgtgggcacgacctcccgaggcctcctctatttangctgcactcccacgngggcccacgtggtactcccgagccctaggttccaggtcggactagggtcgggtctgggacaggtacgttccacttctacgacctatcgagcacgcctgactagtcgtagaagtnttggntactaattttatacctgtaccaagtactaaattaactaaccgtaccgtcggtaccttccgtactaccgttacgttccgggacggtaacgggaaccctaagggttcgaaggtactaaccggaaacgtacttaggtcggacctagacctactaggttcc

SEQ ID NO: 180142 - DNA, 590 bp, Homo sapiens
  misc_feature: GYAE6OF01BZSS0.26.37.D04.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgtagtcgcggcttagcctggtaccagcagacaccgtgggcagacctcccaggcctcctcatttangctgccatcccaaccgagggccaagtggtactcccgagcctaggttcaggtggacgaggttgggtcgtggggaacaggtacgttcacttctacaccatcagcacgcctgcagtctagaagtattgtgtacttaattttatacgttgtacagtactaaataattaacgtaccgttcgtccctccgtacttaccgtacggtttccgggacgggtaccgggtaaccgtaagggttacggaagtaactaccggtaaaaccgtacgttacggttcgggactacgaccctacctagttccg

SEQ ID NO: 180143 - DNA, 910 bp, Homo sapiens
  misc_feature: GYAE6OF01CCST1.26.37.D04.1.454.CMB.1.raw
  modified_base (203)..(203): a, c, t, g, unknown or other
  misc_feature (203)..(203): n is a, c, g, or t
  modified_base (225)..(226): a, c, t, g, unknown or other
  misc_feature (225)..(226): n is a, c, g, or t
  modified_base (259)..(259): a, c, t, g, unknown or other
  misc_feature (259)..(259): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagcgacnnagtgttgtcgcggcgtagtcgtcgtacgtacgngacgacgacctacggcgacacgtccctcggacgtcctctactttatttagctcgtcgactaccgtacccaacgggtaccgacccgttaggttacgtacccctaccgaccgtaccggtttcgtacggtacgggtcggaacggttcggggtttcggttacgtaacggaacgtaacgtaccgtttacctaaccttaccctttaccaaccttaacgttacgtaccggaccgtaacggtaacgggttacgggtaacgacccgttacggttaaaggttaacgtttttacgtttacggaacggttttacggttaacgttttttaaccgtttacggtttaccgttaacgggaaccgttaaaccgtttaacgggtttaacgttaccccgttttaaaccccgttttaccccgtttaacggtttttaaccccccgggtttttcccgggttttaacggttttttaaccccggggggtttacccccggaaaacccggggggggggtttaaaacccccggtaaacggttacccggtttaaacgggggttttaagttaaaaccccggttttaaaccgtaaaaaaccccggggttaaaaaccgggtttttacccggggttacggggttaacccggttaccccgggttaacccttaaaaccccccggg

SEQ ID NO: 180144 - DNA, 685 bp, Homo sapiens
  misc_feature: GYAE6OF01DBYYX.26.37.D04.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggcctcccagataccactggagaaatagtgatgacgcagtctccagccaccctgtctgtgtctccgaggggaaangtccaccctctcctgcagggccagtcagagtgtagtcgcggtcttagcctggtaccagcagacacctgggcagacctccgaggctccgtactatttancgctgcaactcccaccgacgggccacgtggtacctcccagacctaggttcaggtggcgaggttggggtaccgtggggaacaggtacgttccgaacttcgtacaaccctataccgacgtccaacgtccccgttagcccgttaacgtaccgttaggaaagtacgtttaggacgttaaccctttaaagttttttaaccgttaacgttcggtaacctaaggtaaaccttaaagttaaaccgttaaacttaaccccgttcggtaccccttcccggtaccttacccgttaacccggtttcggggaccgggtaaccgggaacccgttaaggggttagaacggtaacgtaaccgaaaacggtacgttggtacggctacgcctaccgtacg

SEQ ID NO: 180145 - DNA, 713 bp, Homo sapiens
  misc_feature: GYAE6OF01C7KM1.26.37.D04.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
tcagagactatactcacgaccggtgctcgatttagtagcatactgttgggtttggggggaactgctcagttaggacccagccggaaccatggaagccccagcgcagcttctcttcctctgctactctggctcccagataccactggagaaatagtgatgacgcagtctccagcccaccctgtctgtgtctccgaggggaaanacgtccaccctctcctgcagggccagtcagagtgttagtcgcggcttagcctggtaccagcagacaccgtgggcagacctcccgaggtcctcctntattttangcttcgcctactcccaacgtacgggccctagttcggtaactccccgaaggtccctaagggtttccaagggttcggacctagggttcgggtacgtggggaaacctaggtaacgtttccaacgttccgtaccaaccgtataccgaacgtccgaacggtcccctaggacccgtaaggttccgtaagggaaacgttagtttacggtacggtaacctttaaagtttttacttaccgtgttaaccaagtaacctaaatttaactaaacgttcccgtcgggtaccccttaccggtaccttaccggtaccggtttaccggggacgggaaccgggttaaccgtaagggttacgaaacggttacgtaaccgtaaaacggtacttcgggtacggaccttagacccctaacgtagttccg

SEQ ID NO: 180146 - DNA, 942 bp, Homo sapiens
  misc_feature: GYAE6OF01DW0TW.26.37.D04.1.454.CMB.1.raw
  modified_base (200)..(200): a, c, t, g, unknown or other
  misc_feature (200)..(200): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccacctgtctgtgtctccgaagggaaancgtccaccctctcctgcgacgggccagtcagagttgtagtcgcgtcttacgcctaggtaccagcagaccaccgtgggccacggacctcccgaggtcctcgttcacgtcgtacggtgcctactcccgaaccgacgggcccacgtccggtaccctcccccggacgtacgggttcacgggttcggaccgtagggtcgggggttccgtagggggtaaccggtacgtttcccgaaccgttccgtacccgtaacccgtaacgttaccgaaccggtacccgtaaccggtcccgttacgggacccgttaaccgggtttaccgttaacgggttaaaacggtttacgtttttaaccgggttaaccgttttaaaggtttttttaacgtttaacccgtttacgggttaaccccgtaaaggtaaacccgtttaaaacggtttaaaaaccgtttaaaaaacccggttccgggttaacccccggtttaacccggggtttaaccggggttaaaccccgggggttttaacccggggtaaaccccgggttaaaaacgggggttaaaccccgggttaaaaaggggggttaaaccggtaaaaaacggttaaacccgggtaaaaaaccggttaaaacccgggtttacggggttaaccgggttaccggttacggtaaaccccggttaacccgttaaacgtttaccggtttaccgttttaaccgtttacccgttaaacccgttttccccgtacccgttaaacccg

SEQ ID NO: 180147 - DNA, 553 bp, Homo sapiens
  misc_feature: GYAE6OF01BM8CV.26.37.D04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttagtcgcggtcttagcctggtaccagcagacacctgggcagactcccaggctcctcatttangctgcatccaccgaggccagtgtactccagcctaggttcagtggcaggtggtctgggacaggagttcactctcactatcacgcacgcctgctagtcgtagtaagtagttgtactacttaatttattactgtcaatactaatattaacgtaccgtcggtcctccgcttaccgtacgtttcgggacggtacgggaccgttagggtcgagtaacgtaccgaaacgtacgttcggtacggtactcggactaacgtgttaccg

SEQ ID NO: 180148 - DNA, 760 bp, Homo sapiens
  misc_feature: GYAE6OF01B5QKV.26.37.D04.1.454.CMB.1.raw
  modified_base (203)..(203): a, c, t, g, unknown or other
  misc_feature (203)..(203): n is a, c, g, or t
  modified_base (348)..(348): a, c, t, g, unknown or other
  misc_feature (348)..(348): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagcccaccctgtctgtgtccgtcccggggaaancgcccaccctctcctgcagggccagtcaggagttgttggcagactaacgttagcctaggtaaccaacgagaaaacccgtgggccaggcctcccgagcttctcatcgtacggtgacactcccaccgacggcccacgttcggtaccnccccgcctaggttccaggtcggcgtaggtcggtcgtgggacggattccaccgtctaccaccgatacgacgcctaacggtcccgtagaccgtacgttcgttaacggtaacgtttaagttttcgaaccgtttaacggttttaacttacgttgttaccgtaagtacgtaaacgtttaaacttaaaaccggtcggtaccccgttaccgggtaccggttaaccgggtttacccgggaaccggtaaaccggggtaaccggtaaacggggttaacggtaaacgttaacccggtaaaaacggttaaccgttacggttaccgggtaccgtaacggacccttaacccggttaacttccgtttaccgttacccgttaccttacccgtttaccccttacccccggtacccttacgtttaacccg

SEQ ID NO: 180149 - DNA, 611 bp, Homo sapiens
  misc_feature: GYAE6OF01AR6NQ.26.37.D04.1.454.CMB.1.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (424)..(424): a, c, t, g, unknown or other
  misc_feature (424)..(424): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtccaccctctcctgcaggggccagtcagagtgttagtcgcggcttagcctggtaccagcagacaccgtgggcagacctccgaggctcctnatttatgctgcatcccacgacgggcccagtggtactccccagccctaggttcaggtcggcgtaggtcgggtctgggactagtacgttcactctacaccgatccgagtcacgcctgctagtcgtaggaagtnttcggtagtacttaaatttattactcgtactagaactaattaacgttaactaccgttcggcccttaccgtctaccgtaccgtttcggggacgggtaaccgggtaccttaaggggttcgaggtaacgtaacccgtaaaacggtacccgttagggtacggtaccgttacgaccctaccgtaagttcccg

SEQ ID NO: 180150 - DNA, 494 bp, Homo sapiens
  misc_feature: GYAE6OF01DP36E.26.37.D04.1.454.CMB.1.raw
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
  modified_base (485)..(485): a, c, t, g, unknown or other
  misc_feature (485)..(485): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccatctcctgtcggccgtcagagtattagcagcaacttagcctggcaccagcagaaacctgggcaggctccaggctctcatctttgatgcgtccacaggcactgttccagccaggttcagtgcagtgcgtctgcganagagttcactctcacatcaacngcctgcagtctagaagtactttgctagtttatacttgtanagtctagtagtacatcgactggccnctcaccttcggaccgagggacacgacgtggaagacttaaacgactgtcgactnacgcagtcg

SEQ ID NO: 180151 - DNA, 257 bp, Homo sapiens
  misc_feature: GYAE6OF01DCI50.26.37.D04.1.454.CMB.1.raw
  modified_base (255)..(257): a, c, t, g, unknown or other
  misc_feature (255)..(257): n is a, c, g, or t
tcagagactatactcacgaccggtgctcgatttagtagcatactgttgggtttgggagatcatgagggtgtccactacatgggcgtctggggcaaagggaccacggttatcgtctcctcagcctccaccaagggccatcggtcttcccctggcaccctcctccaagagcacctcgtgggggcacagcggccctgggctgcctggtcaaggactacttccagtatagtctctgagcgggctggcaaggcgcatagnnn

SEQ ID NO: 180152 - DNA, 528 bp, Homo sapiens
  misc_feature: GYAE6OF01DNNM4.26.37.D04.1.454.CMB.1.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (415)..(415): a, c, t, g, unknown or other
  misc_feature (415)..(415): n is a, c, g, or t
  modified_base (446)..(446): a, c, t, g, unknown or other
  misc_feature (446)..(446): n is a, c, g, or t
  modified_base (520)..(520): a, c, t, g, unknown or other
  misc_feature (520)..(520): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagcccaccctgtctgtgtctccgaggggaaangtccaccctctcctgcagggccagtcagagtgttagcgcggcttagcctggtaccagcagacaccgtgggcagactcccaggcctcctntatttangctgcatcccaccgagggcctacgtggtactcccagccaggttcaggcggcaggtggactcgtgggacaggtacttcactctacaactatacgagcagcctgcagtcctgagtntttcgactacttatactgccagctatatatnacttacctatccgacgttcgggaccgggacacggtacgtaacggaaactaacggtacgtggtcgctcgacactntcttgtcc

SEQ ID NO: 180153 - DNA, 618 bp, Homo sapiens
  misc_feature: GYAE6OF01C1VO9.26.37.D04.1.454.CMB.1.raw
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtcgtgggggaggcgtggtccaggccgtggggggtccctgacgactctcctgtgcagcctctggattccacctttcacgtacctacgccatgcacgtgatccgcagctcgaggcgaagggctaggngtgggngcttcttatatcatagtgaatggaagtaatgaaactagttacgcacgtactccggtaggaacgggcctatccaccgttcacgaagacgtacaacttaccgaaagacgaccaacgtattcgtttactagaactaaacgttagaaaccgagtacccgtaggacggtaaggttaggaacgggtaccggtacggggttgttaccgtttagttttcggtggttcggcggtacgggtacgggttcccggggtagggtacgggggttcgtacccgtaaaccgg

SEQ ID NO: 180154 - DNA, 577 bp, Homo sapiens
  misc_feature: GYAE6OF01DXBJS.26.37.D04.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (423)..(423): a, c, t, g, unknown or other
  misc_feature (423)..(423): n is a, c, g, or t
  modified_base (573)..(573): a, c, t, g, unknown or other
  misc_feature (573)..(573): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagcccaccctgtctgtgtctccgaggggaaangtccaccctctcctgcagggccagtcagagtgttagtcgcggtcttagcctggtaccagcagaccaccgtgggcagacctcccgaggtcctcctctatttangctgcactcccacgngggccagtggactcccaggtccaggttcaggtcggctaggtgggtctgggacaggtacgttcactcgtcacctatcagcacgcctgcgtagtctagtaacgtnttgtacgtacttaattttacttactgtacaagtactaaagtaactaactccgtcggtccctccgtctccgtacggtttcgggacgggacggtaacgtagggtacgaagtacgtacgaaacgtcgtacggtcggtacctacgaccaccgtnttcg

SEQ ID NO: 180155 - DNA, 857 bp, Homo sapiens
  misc_feature: GYAE6OF01C3M6A.26.37.D04.1.454.CMB.1.raw
  modified_base (148)..(148): a, c, t, g, unknown or other
  misc_feature (148)..(148): n is a, c, g, or t
  modified_base (208)..(208): a, c, t, g, unknown or other
  misc_feature (208)..(208): n is a, c, g, or t
tcagagactatactcacgaccggtgctcgatttagtagcatactgttgggtttgggggaactgctcagttaggacccagccggaaccatggaagccccagctcagcttctcttcctcctgctactctggctcccagattccaccgganactagttttgttttgacacagtctccgagcccacccttgtctttgctccgaaggggaaangcccaccctgtccgtgcgacgggccaagtccagacgttgttggcagctacgttacgcctaggtaccaacgaagtaaaccctggacccaggtcctacccgaggtcctccgtcaactctagtgagtacggaccagtacccgaaacgacgggacccacgttggacctaacgttccccgaaggtcccgtaagggtttcacggttcggacgtaaggttcgtaacggttaccgttacggggaaacttaacggtaccgttttaccgaaccgtttcctaaccgtaaccctagttaccgtaccgaccgtaaaccgtacccgttaaacggaccgtaacccgttaaggttaaacgtttaaccgttttttacggaacccttttaacgttttttaaccgttttaaccgttacggtaacccgttaacggtacccgtaacggtaacccggttaacggaaacccgttaaaccgggttacccggtaccccgtttaccgttaacccgttaacccggtttttaccgggggaccggggttaaccggggtaacccggtaaacgggggtacggtaacgtaacggtacccgtaaagggtacccggtaaacgttacgggttacggtaccggttaccggtaaccgtaacccgttacgttcccgttcgttacccg

SEQ ID NO: 180156 - DNA, 633 bp, Homo sapiens
  misc_feature: GYAE6OF01DRHEM.26.37.D04.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (588)..(588): a, c, t, g, unknown or other
  misc_feature (588)..(588): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagcccaccctgtctgtgtctccgaggggaangtccaccctctcctgcgagggccagtcagagtgttagtcgcggtcttagccgtggtaccagcagaccacgtggcagacctcccgaggcctccgtactattttancgtacctgctactacccgaccggacgggccctaacgttcggtacctccccgacggtccgtagggtttccagggttcggacgtagggttcgggtcgtacggggaactaggttacgttccacgttccgtaccaaccgtatccgacgaccacgtcctgaccgtagtcgtagtaagtcgttgtacgtacgtttaatttacttacgtgtacaagtactaaattactaactccgtcgtccctccgtctacgttcggttcgggaccggaacgggtaccgtagggtanaaggtactaacgaaacggtacgtggtcgacgtcgacctacgtacg

SEQ ID NO: 180157 - DNA, 686 bp, Homo sapiens
  misc_feature: GYAE6OF01BQZZ8.26.37.D04.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcgagggccagtcagagtgttagtcgcggcttagcctggtaccaacagacaccgtgggcagacctccgaggtcctcctctatttcngtctgccactcccgaccgacgggcctacgtcggtactccccgaagccgtaggttcgaggtcggcgtagggtcggggtctaggggactaggtacgttaccacttctaccgaacctataccgacgaccacgtcccgtagacgtaagttcgtaaggtaagttagttcgtagtaacgtttaattttacgtacgtacgtacaagtactaaagttaacgttaaccgtacccgtcgggtaccccttcggacctttaccgtaccggtttccggggaaccgggtaaccgggtaacccgtaaaggggttaccgaacggtaaacgtaaccggaaaaccggttaacgttcgggtaccggttacgtacggtaacccgtaacttaccgttcgttaaccg

SEQ ID NO: 180158 - DNA, 536 bp, Homo sapiens
  misc_feature: GYAE6OF01E0EO9.26.37.D04.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (524)..(524): a, c, t, g, unknown or other
  misc_feature (524)..(524): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgtagtcgcggcttagcctggtaccagcagacacctgggcagactccaggctcctcatttangctgcatccaccagggccacgtggtactcccagccaggttcagtggcaggtgggtctggggacaggtagttcactctccacatcagcagcctgcagtctagaagtattggtcgtacttaatttacttacgttcgtcagactaaatataactacctcggtaccttccgctctacgtttcggacgggtaaggaccgtaggttgaacgtatacgaaacgtactggtacggntcgccacctacg

SEQ ID NO: 180159 - DNA, 839 bp, Homo sapiens
  misc_feature: GYAE6OF01BZRCV.26.37.D04.1.454.CMB.1.raw
tcagagactatactcacgaccggtgctcgatttagtagcatactgttgggtttgggagctcgtgggagaggagcccagcactggaagtcgccggtgtttccattcggtgatcagcactgaacacagagactcaccatggagtttggctgagtcgttgggttttcctcgttgcttcgttttaagaggtcgtccagtgtcaggagcgaggtagtggagtcggtgggggaggcgtggtccgaggtccggttcggggggtcccctggacgtaccttccgtccgtggtcgcgacgtcccttcgttacggtactttaccctacccgtttaccgaaccggttaacccctaaccggccctaacgttcggacccgtaaccgttacgggtacctcccccggaccggtacggtcccgtacccggaaggggaccggaaacgggggtcttaagggtacgggttggggttcgtaccgtttactttaatactactaagttagtaggtaagtaaggaaagttaagtagaaactacgttaccgacgtaacgtaccgtaccggtaggtaaccgggtaccgtaacgttacccgaacccgttcctaaccgaaaggtaacgtaaaccttaacgttaaccgaaacgtacgaccgtaacgttagtttcgttacgtacgaaactaaacgtacgtaaaccctacggtaccgttaagggtacgtaaggttacggaaacgggtaaccggttacggggtttacttaccggtttaagttttcggtccgggttacggtcccgggtaacgggttccgggggtttacccgggggttagggttacccggggttaccgttacccgtaaacggg

SEQ ID NO: 180160 - DNA, 707 bp, Homo sapiens
  misc_feature: GYAE6OF01B12YJ.26.37.D04.1.454.CMB.1.raw
  modified_base (309)..(309): a, c, t, g, unknown or other
  misc_feature (309)..(309): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtcgtctccgaggggaaagagtccaccctctcctgcagggccagtcagagtgttagtcgcggcttacgccgtggtaccagcgagaccaccgtgggcacgacctcccgaggcctcctcatttangctgcatccacgacggccacgtggtacctcccagccaggttcaggtcggacgtaggtgggtcgtaggggaactaggtacgtttccacgttcctaccaccgtatccgaggtccacgtcccgtgacctaaggttcaggtaagtatttggtagtaccgtttaaattttacgttaaccttgtacaacgtacgtaaaacttaagttaaaccgtacccgttacggtccccttacccggttacttacccgttaaccgggtttcccggggtaaaccggggtaacgggggttaaacccctaaaggggtttacggaaaccggttaaacgttaacccggtaaaaaacccggttacgttacgggtacccggttaacccgttacgggtaacccctaaccggtttaaaccgg

SEQ ID NO: 180161 - DNA, 629 bp, Homo sapiens
  misc_feature: GYAE6OF01CUSD9.26.37.D04.1.454.CMB.1.raw
  modified_base (182)..(182): a, c, t, g, unknown or other
  misc_feature (182)..(182): n is a, c, g, or t
  modified_base (272)..(272): a, c, t, g, unknown or other
  misc_feature (272)..(272): n is a, c, g, or t
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgcttcttttaagnggtgtccagtgtcaggagcaggtagtggagtcgtgggggagcggtggtccaggccgtggggggtccctgacgactctcctgtgcagcctntggattccaccttcaacgttacccacgcctatcgcacgtggactcccgccaggcctccgaggcgaagggctaggaggtgggtgctcttatatcatatgagtggaatatagaaacattacgcaagacgtaccgtaggagggcctacttccgaccgtctccaagtacactaacttacgaaagacgactaacgacttgttttactagaacctaaagtacgaacacgtccgtaggacgtaggttaggaacgggtaccgtacggggttacgttaccgttaagttttccggtggtttccggccgggtacgggtacgggttacccggggggttagggtacgggggttcgtcccggttaaaccgg

SEQ ID NO: 180162 - DNA, 577 bp, Homo sapiens
  misc_feature: GYAE6OF01CLQ6B.26.37.D04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (295)..(295): a, c, t, g, unknown or other
  misc_feature (295)..(295): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagngtgttagtcgcggcttagccttggtaccagcagacacctgggcagactcccaggctcctcatttangctgcatcccacgagggccatggtactcccagccaggttcagtggctaggtgggtctgggacagtacgttcactctacaccatcagcagcctgcagtctagaagtattgtagtactaatttacttacgtgtacagtactaattataactaccgtacggtcctccgtcttaccgtaccgtttccgggaccggtacgggtaccgtaagggttacggaaggtaacgttaaccgaaacggtaacgttacggtacggtaccgttacggacctaaccgtagttacccg

SEQ ID NO: 180163 - DNA, 670 bp, Homo sapiens
  misc_feature: GYAE6OF01AX7LC.26.37.D04.1.454.CMB.1.raw
  modified_base (201)..(201): a, c, t, g, unknown or other
  misc_feature (201)..(201): n is a, c, g, or t
  modified_base (331)..(331): a, c, t, g, unknown or other
  misc_feature (331)..(331): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccacctgtctgtgtctcgagggaaancgtcacctctcctgcagggccagtcagagttgttagtcgcggtcttagcctggtaccagcagacaccgtgggcacgacctcccgaggtcctccttctattttacgtcgctcgacctacgtacccaaccgngggcccctaacgttggtaacctccccgagccctagggtttcaggtggactagggtcggtccgtaggggacttaggtgttcgaactcctacgaacccatcacgcacgtctacgctaggtcgtaacgtagtaagttgtacgtacgttaacttttagttactagttacgacgtaactaattaacgttaacgtttacccgttaaccggttccccgttacccgtacgtttacccgttaccggttttacccggggacggtaaaccgggtaaccggtaacgggttagaaacgttaccgtaaaccgaaacgttacgtcggtacggtaccgttacggaccgtcgtacg

SEQ ID NO: 180164 - DNA, 626 bp, Homo sapiens
  misc_feature: GYAE6OF01EWJIO.26.37.D04.1.454.CMB.1.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccacctgtctgtgtctacgaggggaaanagtccaccctctcctgcagggcccagtcagagttgtagtcgcggcttaggcctggtaccagcagaccnccgtgggcagacctccgaggcctccgtntatttanggctgctactcccgacgaggccacggttgactccgagccgtaggttcaggttcggactagggtgggtctagggacctaggtacgttcactcgtaccacgatcgacgtccagcccttagcctaagtcgagaagtagttcgtacgtacttaaattttcgtacgttacgtacaaggtacctaaattacgttaaccgttacccgtcggtccccttaccggacttaccgtaacggtttcccgggggaacgggtacgtaacccggtaaggttcggaagttaaaccgtacgaaacggtccgtggtacgactaccgaacgtactacgg

SEQ ID NO: 180165 - DNA, 614 bp, Homo sapiens
  misc_feature: GYAE6OF01E3ST1.26.37.D04.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaaggggaaanagtccaccctctcctgcagggccagtcagagtgttagtcgcggtcttagcctggtaccagcagacaccgtgggcacgacctccaggtcctcctctatttangctgctactccaccgagggccacgtggtactcccagcctaggttcaggtggcgtaggtgggtcgtagggacaggtacgttcacgtctacaccatcacgcacgcctgctagtcgtagaatagttgtagtacttaagttttacttacgtcgttacaaggtactaaattacgtaaacttacccggtcgtccccttaccgtcttaccgtcggtttaccggggacgggtaacggggtaacgtaacgggttagaacggtaacgtaaccgtaaaaccggtacgtaggttacggaccttacggcccaaccgttacg

SEQ ID NO: 180166 - DNA, 606 bp, Homo sapiens
  misc_feature: GYAE6OF01BDDZ2.26.37.D04.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
tcagagactatactcacgaccggtgctcgatttagtagcatactgttgggtttgggggaactgctcagttaggacccagccggaaccatggaagccccagcgcatcttctcttcctcctgctactctggctcccagataccactggagaaatagtgatgacgcagtctccagccacctgtctgtgtctccgaggggaaangtcaccctctcctgcagggccagtcagagtgttagtcgcggtcttagcctggtaccagcagacaccgtgggcagacctccaggtctcctcatttancgctgcactccaccgngggccctagtggtactcccgagccgtagggttcaggtcggaccagggttcgggtactcggggaactaggtacgtttccaccttccgtaccacgtatccgacgcacgcctgctacgtcgtagaagtgttacgtagtacttaagtttacttactagtacacgtataattaacttaactaccgtcgtcccttccgtcctaccgtaccggtttcgggacggtaaccgggtaacgtaggtacggtaagaactaaccgaaacgtacgttacggtcggacgtagacctaccgtcgttaccg

SEQ ID NO: 180167 - DNA, 718 bp, Homo sapiens
  misc_feature: GYAE6OF01D3JQX.26.37.D04.1.454.CMB.1.raw
  modified_base (708)..(708): a, c, t, g, unknown or other
  misc_feature (708)..(708): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaagcgtcaccctctcctgcgagggccagtcagtagtgttagcggcggtcttagcctaggtaccagcaagaccaccgtgggaccacgacctcccgaggtcctacctctattttagcgctcgccactcccgaaccgacgggcctacgtacggtactccccgagtaccgtacggttacgaggttcggacgtagggttcgggtacgtagggggacctagggtacgtttaccacttaccgtaccgaacccgtataccgaacggtaccgtacggtacccgtacggtaccgtacgggttaccttaagggtaaaacgttagtttacgtacggttaactttaacgtttttaacgttaacgttacgtacgtaacgtaactaaattaacgttaaccgttaccgttacggtcccttaccgtcccgttaccgtaccggtttcgggaccggggtaacggtaacccggtaagggttacgaaggtaaccgtaacgtaaacgtacgttcgggtacgtccgtacncgtaccgtac

SEQ ID NO: 180168 - DNA, 582 bp, Homo sapiens
  misc_feature: GYAE6OF01EXEW4.26.37.D04.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccacctgtctgtgtctcgaggggaaangtccaccctctcctgcagggccagtcagagtgttagcgcggtcttagcctggtaccagcagacaccgtgggcagacctcccaggcctcctctatttacncgtctgcactcccacgacgggccagtggtactcccgagcctaggttcaggtcggctaggtgggtcgtgggacagtcgttacncgtctaccgaccatcacgcagcctagcagtcgtacgaagtattgtagtacttaacgtttacttacgtgtaccaagtctaaagttaactaaccgtaccgttacggtaccctccgtacttccgtacggtttccggacggtaacggacgtaaggtacgagtacgtaacgaaacgtaacgtggtacgtacgacgtcgactacg

SEQ ID NO: 180169 - DNA, 587 bp, Homo sapiens
  misc_feature: GYAE6OF01BHI6A.26.37.D04.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (581)..(581): a, c, t, g, unknown or other
  misc_feature (581)..(581): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttagtcgcggctttagcctggtaccagcagacaccgtgggcagactcccgaggctcctcatttangctgcatccacagggccagtcggtactcccgagccaggttcaggtggcaggtcgggtctgggactaggtacgttccgacttcgtaccactaatccgaagccaagtcccgtgactagttcctagaagtagtttgtacgtacttaaatttttacgtacttgtacctaagtacaaattaacgtaactaccgtcggtacctccgtactcgtaccgtttcgggacggtacggaccgtaagggttcgaagtacttacgaaacgtacgttggtacggctacgcctacgtnttaccg

SEQ ID NO: 180170 - DNA, 627 bp, Homo sapiens
  misc_feature: GYAE6OF01BVC77.26.37.D04.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (616)..(616): a, c, t, g, unknown or other
  misc_feature (616)..(616): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggaagaaatagtgatgacgcagtctccagccaccctgtctgtgtctcgaaggggaangtccacctctcctgcgagggccagtcagtagtgttacgtcggcggtcttagccgtggtaccngcagacaccgtgggcagcctccgaggcctctntatttngctgcatccacgaggccacgtcggtactcccgagtccgtaggttcgaggttcggacgtagggttcgggtcgtaggggaacctaggtacgttccaacttcctaccgaactactacgacgccacgtcccgtgaccgtagttccgtaggaaacgttgtttcgggttactaactttaaagttttacgtacttgtactaagtactaaagttacttaacgtccgtacggtcccttacgtaccttcgtaccggttacgggaccggtagggtaactagggttaagacgtaacgtacgaaacggtgtcgtacggactacgacnccgttgtcccg

SEQ ID NO: 180171 - DNA, 596 bp, Homo sapiens
  misc_feature: GYAE6OF01EO88G.26.37.D04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (302)..(302): a, c, t, g, unknown or other
  misc_feature (302)..(302): n is a, c, g, or t
  modified_base (460)..(460): a, c, t, g, unknown or other
  misc_feature (460)..(460): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagcccaccctgtctgtgtctccgaggggaaangtccaccctctcctgcagggccagtcagngtgtagcgcggcttagcctggtaccagcagacaccgtgggcagacctcccgaggcctcctctatttangctgctactcccaccgagggccctacgttcgggtaactccccgaaggtcccgtaaggtttccagggttcgggccgtaagggttcggggtacgtacggggactaggtacgttaccacgttcctaccactatcacgccacgtcctgctagtctagaagtnttgtagtacttaatttacgtctgtacagtactaatataacgtaccgtgccctccgtctacgtcgttacgggacggtaacggtacgtaagggttgaacgtactaacgaaacgtagtggtacgctacgacctacgtcg

SEQ ID NO: 180172 - DNA, 624 bp, Homo sapiens
  misc_feature: GYAE6OF01EA36O.26.37.D04.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (521)..(521): a, c, t, g, unknown or other
  misc_feature (521)..(521): n is a, c, g, or t
  modified_base (607)..(607): a, c, t, g, unknown or other
  misc_feature (607)..(607): n is a, c, g, or t
tcagagactatactcacgaccggtgctcgatttagtagcatactgttggggtttgggggaggaactgctcagttaggacccagccggaaccatggaagccccagcgcagcttctcttcctcctgctactctggctcccagataccactggagaaatagtgatgacgcagtctccagcccacctgtctgtntctcgaaggggaaanacgtccaccctctcctgcagggccagtcagngtgttagcgcggtcttagcctggtaccagcagacaccgtgggcacgacctcccaggcctcctnatttangctgcactccaccgaggccacgtggtactcccgagcccgtaggttcgagtcggactgggtcgggtcgagggactaggtccgttactacctaccgtccaacctataccgacgtaccacgtcccgtgacctacgttcgtaaggaacgttatttcggtactaacttaaattttacttacgtgtcaagtactaatattaaccttacgtcgtcccgtaccncgttaccgtaggttaccgggacgggtaccgggaacgttaagggtacgagtaaaccgtaacgtaaacggaacgttcgggtaccggtntaccacccgtaaccgtg

SEQ ID NO: 180173 - DNA, 862 bp, Homo sapiens
  misc_feature: GYAE6OF01DIIZ5.26.37.D04.1.454.CMB.1.raw
  modified_base (174)..(174): a, c, t, g, unknown or other
  misc_feature (174)..(174): n is a, c, g, or t
tcagagactatactcacgaccggtgctcgatttagtagcatactgttgggtttgggggaactgctcagttaggacccagccggaaccatggaacgccccagcgcagcttctcttcctcctgctactctggcctcccagactaccacgtggaagaaatagtgatgacgcagtccnccacgccacctgtctgtcgtcctacggaaggggaaactcgtacccacccttctccgtgaccgacgggtccaaggtaccgaggtaggttggttacggccggtacggtcttacggccgttacgggtaccacgacgaacgccgaaccggtgggaccaacgtacccgtacccgacggtccttacccgttagttaacgttttcgcggtccttcgaacctaccgtccccgaaccggtacgggccccgttaagttaccgggtacctaccccgaacggtcccgttaaggggttttccgaacgggtcggggtacgttaacgggggttacgggttccggtaacggggtaacgtacggttaaccgttacccgtaccccgttactacccaacgttaacgccgtacggaacccgtcggtcccgtacgtaacggtaacgttaccggtaaagggtaaacgttacgggtttacgacggtttaaacttttaaacgttttacgttaacgttacggtaacaaacggttaacttaagttaaaccttaccggttaccccgttaccgtacccgttaccggttaccttacccggttaaccgggttaccggggacggtaaccggtaaccggttaggtaaccgtaagtaaacccgtaacgggtaaaccgttacggtacggtaccgtactaccggtaaccctacgtggttaccg

SEQ ID NO: 180174 - DNA, 636 bp, Homo sapiens
  misc_feature: GYAE6OF01D9YYE.26.37.D04.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (410)..(410): a, c, t, g, unknown or other
  misc_feature (410)..(410): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaancgtccaccctctcctgcgagggccagtcagtagtgttagcgcggcttagcctggtaccagcagacaccgtgggcagacctccaggcctctctatttngctgccatcccacgcggcctacgtggtactcccgagtcccgtaggttcgaggtcggcgtaggtgggtcgtagggacctagtacgttccacttcgaccacctataccgaacncgtcctcgcgagttcgtaagtaacgttactttgactaggttacttagtttacctgtacgacgtactaattacgttaaacttcgtggttaccctttacgttccgggtttaccggggacccggggtacctaacggtccggttacgggaacgttaccgtaaccgtaacccgttaacggtcggttacggtctaccggtaccttaaccgtattcgttcgttcccgttaccg

SEQ ID NO: 180175 - DNA, 606 bp, Homo sapiens
  misc_feature: GYAE6OF01A1BDF.26.37.D04.1.454.CMB.1.raw
  modified_base (208)..(208): a, c, t, g, unknown or other
  misc_feature (208)..(208): n is a, c, g, or t
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (593)..(593): a, c, t, g, unknown or other
  misc_feature (593)..(593): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggcctcccagataccactggagaaatagtgatgacgcagtcctccagcccaccctgtctgtgtcctccgaggggaaangtccaccctctcctgcagggccagtcagagtgttagcgcggtcttagcctggaccngcagacaccgtgggcacgacctccccgaggtcctcctacgtattttacgngcctgcctactacccgaccgacgggccctacgttggtacctcccgagcccgtaggttcaggtcggctaggggttcgggtcgtaggggacagtacgtcactcncacntcagcacgctgctggtctaggaagtgttcgatacgtttaatttgtacgttgactagacttaattaacttaaccttaccgtcgtccctaccggtcttaccgttacgttccgggaacgggtacggtaaccgtagggttacgaacgtactaaccggtaaagtcgttcggtacgacncgtacctcgtacg

SEQ ID NO: 180176 - DNA, 911 bp, Homo sapiens
  misc_feature: GYAE6OF01B8Y33.26.37.D04.1.454.CMB.1.raw
tcagagactatactcacgaccggtgctcgatttagtagcatactgttgggtttggggagctctgggagaggagcccagcactggaagtcgccggtgtttccattcggtgatcagcactgaacacagaggactcaccagtggaggtttgggctgagtcgtttgggttttcctcgttgtctttacgttttaaggaggtcgtccagttgtacgaggagcgagggtaggtgggtaggtcggtggggggaggtcggtcgggtccgacgggtccgggttcggggggtccctaggacgtaccgttccgtccgtggtcgccgtacgtcccgttacgtcgggtactttcccgtaccgtttaccgaaccggttacccctacggcccctaagttcggcctaaccggttcggaaccttccccggacccgtaacggggtccctacccggaacggggtaaccgggtaaacgggggtccgtttaaggggtacggggttcgggggttaccggttacctttaaccgtttaaagttaccgttacgttaaagtttaggtaacgggttaaaggttaaagggtaaaagtttaacgtaaccggtaaacgttaacggtttaaaccgaccgtaacgggttaccgttacccggggtaaggggaaccgggttcccgtaactttccccgggaacccgttacccgtaaccgaaggttaaccgaaacccttaacgtaacccgaaaaggtcgtacccgtaaaggttcgtttacgtttacgaacgaacgtaaacgtacggtaaccgtacggtccgtaagggtacgtacgggttgggaaccggtaccggttcgggttaccttactttagttcggtacggtaccgtccgggtacgggtttacggggtccgggttaggggtaaccggttccgcccgttaaacggg

SEQ ID NO: 180177 - DNA, 594 bp, Homo sapiens
  misc_feature: GYAE6OF01A5YMG.26.37.D04.1.454.CMB.1.raw
  modified_base (344)..(344): a, c, t, g, unknown or other
  misc_feature (344)..(344): n is a, c, g, or t
  modified_base (460)..(460): a, c, t, g, unknown or other
  misc_feature (460)..(460): n is a, c, g, or t
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagcgtggtttcgtcgttagctctttaagaggtgtccagtgtcaggagcaggtagtggagtcgtgggggaggcgtggtccaggccgtggggggtccctgagactctcctgtgcagcctctggattcaccttcagtacctacgccatgcactggatccgcaggctccgaggcagggctagagtgggtgctcttantcatatcgataggaagtaagtacgaactagttacgctagacctccggtagaacgggcctaattccacccgttcaccgagacgactaacttaccaagacgacacgtattggtttacnggactaaagtacggaaccagtacctaggaagtggttacggaggaccgtacggggttctacgtttacgtttcgtagtccggtaacggtccgggtacgggttccggggtagggtacggggttccgtccgtaaacgg

SEQ ID NO: 180178 - DNA, 576 bp, Homo sapiens
  misc_feature: GYAE6OF01CDBYE.26.37.D04.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (572)..(572): a, c, t, g, unknown or other
  misc_feature (572)..(572): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgtagtcgcggtcttagcctggtaccagcagaccaccgtgggcagactcccgaggcctcctcatttancgctgcactcccaccgagggcctacgtggtactccccgagcctaagggttcaggtcggcgtagggtcgggtctaggggacaggtacgttccacttctccaccatcagcacgtcctgctagtctagaagtattgtgtacttaatttatactgtacagtactaatactaactaccgtcgtacctccgtcttcctacggtttccgggacggtacgggaccgtaagggttcgaagtaacgtacgaaacggtacgtcggtacggactagcctaccgtnttcg

SEQ ID NO: 180179 - DNA, 770 bp, Homo sapiens
  misc_feature: GYAE6OF01EHB1Q.26.37.D04.1.454.CMB.1.raw
  modified_base (324)..(324): a, c, t, g, unknown or other
  misc_feature (324)..(324): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtcctccagcccaccctgtctgtgtctccgaagggaagcgtccaccctctcctgcgacgggccagtcaggagttgttagtcgcggtcttacgccgtcggtaccagcagaccaccgtgggacacgtaccgtcccgaggtcctcccttactattttacncgtctcgactactacccgaccggacggacctacgtcggtacctcccgagtccgtacggttcgacggtcggacgtaggtcgggtacgtacgggacgtaggttacgttaccgacttcctaccacgtactacgagaccgaccgtccgtacgtcgtaacgtcgtaaggtaacgtttagtttcggtaacgttaaacctttttaaagttttaccgttacgtttacgtacgtaacggttaaaccttaaaagtttaaccgttaaacccgtttcccggttacccggtacccccgttcccggttaccctttacccgggttaaccgggtttcccggggaacggggttaaaccgggtaacccgggttaaagggtttaacggaaacgttaacgttaaacccggaaaaccggttacggttacgggtaccggtaacgttacccgaaccgttaccgtaaccg

SEQ ID NO: 180180 - DNA, 654 bp, Homo sapiens
  misc_feature: GYAE6OF01DGFTT.26.37.D04.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggaagaaatagtgatggacgcagtctccagccacctgtctgtgtctcgaggggaanctcacctncctgcagggccagtcagagtgttagcgcgtcttacgctaggtaccagcagaccacgtgggacacgacctccgacgcctcctntaatttcgctnacnctccacgaggtccagtgacctccagtcagttcgagtggctagggtcggtacgagggactaggttacgtcctaactcctaaccaactacgttaccgacgaccgtacggtcccgtacgtaccgtaacggttacgttaaacggtaagtttacggttttacgacgtttaacgttactttaacgtttaaccgttacgtaacgtacgtaacgttaacttagtttaaacgttccgtacggttaccgttcgtttaccggggttccggggaacgggtaccgtacgtaccggtaggtaacgtacgaaccgtaacgtcgttcggtaggtaccgtcggacctaccgtagttcttccggtac

SEQ ID NO: 180181 - DNA, 718 bp, Homo sapiens
  misc_feature: GYAE6OF01B9CFE.26.37.D04.1.454.CMB.1.raw
  modified_base (203)..(203): a, c, t, g, unknown or other
  misc_feature (203)..(203): n is a, c, g, or t
  modified_base (330)..(330): a, c, t, g, unknown or other
  misc_feature (330)..(330): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatgtgatgacgcagtctccagccaccctgtctgtgtctccgaagggaaangtccaccctctcctgcacgggccaagtcaggtacgtggttagtcgcggctttagccgtggtaccagacaagaccgaccgtggggcctaacgaacctccccgaaggtcccttacctcttaaagttttncggccttagacctaacgtccccaacggtacgggccctaacgttcgggtactccccgaagtccgtacggtttcaaggtcgggactagggttcggtacgtagggacaaggtcgtttaccgactccttacaaccgtntacacgcaacgtccngtacgtacgtcgtaagaagttgttagtacgtacgttaaacttttacgttaacgttagtaaccgtaagtaactaaacttaacgttaaaccgttaccgttaccggtcccttacccgtccttaccggttaccggttaccgggaccggggtaacgggtaacccgttaaagggttacggaaacgtaacgtaaacccggaaaaggtacgttacggtacggtacgacgtaaccgtaccgttaacgg

SEQ ID NO: 180182 - DNA, 746 bp, Homo sapiens
  misc_feature: GYAE6OF01C7285.26.37.D04.1.454.CMB.1.raw
  modified_base (211)..(211): a, c, t, g, unknown or other
  misc_feature (211)..(211): n is a, c, g, or t
  modified_base (324)..(324): a, c, t, g, unknown or other
  misc_feature (324)..(324): n is a, c, g, or t
  modified_base (368)..(368): a, c, t, g, unknown or other
  misc_feature (368)..(368): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggcctcccagactaccactggaagaaatagtgatgacgcagtcctccagcccacctgtcctgtcgtctaccggagggaaancgtccaccctctcctgcgacgggccagtcagtgttgttacgtcggcggtcttacgcctaggtaccaggcaacgaccgacgtgggacacgacctccgacgtctcctactatttncgctcgacacctccgaccgacgggtaccctacggtacggtaccncccgtacggaccgtaggttcgaggtcggtacggtcgggttcgggtcggacgggtaacgtaggttacgttccaaccgttccgtaacctaaccgtacgtacgacgacgtaccgtcctacggtacgtacgtaacgttaaggtaacggttagtttacggtaacgttaactttaagttttaaccgtttacgttacgttaccgaacgtaactaaacgttacgttaaaccgttacccgttaccggtccccgttaccgtccgttaacccgttaccggtttaccggggaacccggttaacgggtaaacccggttaagggttacgaacggttaaccgtaaaccggtaacgtaacggttcggtacggtcgtaccgtaccgtaacgttcg

SEQ ID NO: 180183 - DNA, 891 bp, Homo sapiens
  misc_feature: GYAE6OF01CAV9H.26.37.D04.1.454.CMB.1.raw
tcagagactatactcacgaccggtgctcgatttagtagcatactgttgggtttggggagctctgggagaggagcccagcactggaagtcgccggtgtttccattcggtgatcagcactgaacacagaggactcacagtggtaggttgggctgagtcgttgggttttcctcgttgtcgttacgttttaaggaggttgtccgaggttgtacgagggagcgtaagggtaggtggaggttcgggtaggggggtacggcggttcgggtcccgacgggtcccgggttcgggggggttccctagggacgtaccttccgtccgtggtcgcgacgtcctcgtggtacttctaccttcacgtaccgtacgcctatcgactacgtcggactcccgaccgacggtcctacggacggacggaacgggcgtagggtaggtgggtcgtactttacttaagtactacgaattagtagtaaggttaacggaaagttaaacgtacgaaaccgttaagttaaccggacgtaacggtacccgttacgggtaacgggtaacgggtacccgttacttacccgtaccccggtacttaccggaaaacggtaacgtaaacccgttaaaccgttaacccgaaagggtacgtacgtaaaccggttagtttaaccggtttaccgaacgtaaacgtaaaacggtaaccgtaaacgtaacggaccgttaagggaaacggttacgggttaaacggggtaaaccgtccggggttaacgggtttaccgttttaccggtttttaaggtttccgggttcgggttacccgggtcgggtttaaacccgggggggttaccggggttttaaccccggggggacgggggtttacccggggttaaacccggtttaaccccggtaaaccgggg

SEQ ID NO: 180184 - DNA, 643 bp, Homo sapiens
  misc_feature: GYAE6OF01EMLSL.26.37.D04.1.454.CMB.1.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (343)..(343): a, c, t, g, unknown or other
  misc_feature (343)..(343): n is a, c, g, or t
  modified_base (394)..(394): a, c, t, g, unknown or other
  misc_feature (394)..(394): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctccagataccatggagaaatagtgatgacgcagtctccagcccaccctgtctgtgtctccgaaggggaancgtccaccctctcctgcgagggccagtcagtagtgttacgcgcggtcttagccgtggaccagcagacnccgtggcagacctccgngtcctcctgtatttagcgctcgacactcccgaccgacggccctacgtcggtaccncccgaggtcccgtaggttacgaggtcggacgtagggtgggtcgtacggganacggtcgttccacttcaccactactacgacgacacgtcgtcgtacgtacgtagtagtaagtacgttgtacttaactttaatttacttacgtgtacgtaacgtaactaattactaacgttaccgtccgtcccgttccgtacgttccgtacggttaccggggaccggtaaccggttaccggtaagggttacggaacgtaacgttaaccgtaaacgttcgtacggtacggtaccgtacgaccgtacgttacg

SEQ ID NO: 180185 - DNA, 739 bp, Homo sapiens
  misc_feature: GYAE6OF01A87TP.26.37.D04.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaaggggaaangtccaccctctcctgcagggccagtcagtagtgttagcgcggtcttagcctggtaccagcagaccaccgtgggcagcctcccgaggcctcctntatttagcggctgcactcccgaccgagggccacgtcggtactcccgagtaccgtaggttccaggttcggactagggttcgggtcgtagggactaggtacgtttccgaaccttccgtaccgaaccctagtaccgacgtaccgtacgtcccgtagtaccgtacgttcgtaaggtaagtaacgtttcggtacgttaacttaaacgttttttaacgtaccgttacgttaccgaacgttaactaaacgtttaaacgttaaccgttacccggttaccggtacccctttacccggtacctttaccggttaacccgggtttaccggggaaccggggtaacgggtaaaccccggttaaaggggttaccgaacgggttaacctaaacccggtaaaaccgggtaccgttacggggtacggtaccgttaccgggaccttacccgtagtttacccg

SEQ ID NO: 180186 - DNA, 723 bp, Homo sapiens
  misc_feature: GYAE6OF01B0M0F.26.37.D04.1.454.CMB.1.raw
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagtcttgggtttttcctcgttgtcttcttttaagaggtgtccagtgtcaggagcaggtagtggagtcgtgggggaggcgtggtccagccggtcgggggtccctgagtacctcgtccgtgtgcacgcctcgtggtacttccgacctttcaacgttaccctaccgcctatcggactacgtggactcccggccgacggcctaccgaggacgaacgggtctaggacggtgggtcggtcttacgttagtactcaagtagtagtagtaggtaaagttaatacgtaaacgttagttaaccgacaacgtacgtaccggtaggtaaaccgggtccgtacttaccgacccgttcaccgaagtaacgacctaaacgttaccgaagtacgactaacgttaacttggtttacctagaacctaaagtacgaaacctacgtaccgtaggagtaacggttacggaaagggtaccggttaaacgggtttcgttaccgttttacgtttacggttggtaccggtaccgggtaccgggttacgggggtttcccggggtaggggttaccgggttaccggtacccgttaaacgg

SEQ ID NO: 180187 - DNA, 690 bp, Homo sapiens
  misc_feature: GYAE6OF01EHK1H.26.37.D04.1.454.CMB.1.raw
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
  modified_base (312)..(312): a, c, t, g, unknown or other
  misc_feature (312)..(312): n is a, c, g, or t
  modified_base (686)..(686): a, c, t, g, unknown or other
  misc_feature (686)..(686): n is a, c, g, or t
tcagagactatactcacgaccggtgctcgatttagtagcatactgttgggtttggggggaactgctcagttaggacccagccggaaccatggaacgccccagcgcagcttctcttcctcctgctactctggctcccagactaccactgggaagaaatgtgatgacgcagtcctccagcccaccctntcgtgtgtctacgaaggggaancgtccaccctctcctgacgacggcaagtcagagttgttacgtcgcgtcttagccgtaggtaccagcaacgacgaccgtggacacgcctcccgacgccttacctnttatttagcgcttcgcctactcccgacccgtacggccctacgtacggttaccacccgacggtccgtaggttacgaggtggacgtaggggttcgggtcgtacgggacgtagtaaccgtccaccttccaccgtactacgtcgaacgtccgtacgtccgttcgacgttacgtacgtaaggttaactaggtttacgtaacggttaactttaacttttacgttacgtacgtaccgaagttaactaaacgttaacttaacccgttaccgtacccgtaccgtcccgttacgttaccgttaccggttcgggtacggtaacggtacgtaggtacgaataacgtaccggtaaacgtcgtacgtcgtaccgtactctaaccggtnttcg

SEQ ID NO: 180188 - DNA, 621 bp, Homo sapiens
  misc_feature: GYAE6OF01BOJVW.26.37.D04.1.454.CMB.1.raw
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagcttgggttttcctcgttgctcttttaagaggtgtccagtgtcaggagcaggtagtggagtcgtgggggaggcggtggtccaggccgtgggggtccctgagactctcctgtgcagcctcgtggtacttccaccttcaacgtaccctacgccatcgcacgtggacctcccggcacggcctccgaggcgaagggctaggaggtgggtgctcttatatcatatgtagtaggtaagtaatagaactattacgacgtacgtaccgtcggtaggaacgggcctagttccgacccgttctccgaagacgtaactaacttaccgaagtcgactacgttattcgttactagaactaaagtcgaaacctgtaccgtagacggtaggttaggaacggtaccgtaacgggtcgttacgttgttcggttgtcggacggtcggtacggggttcggggtaggtacggggtccgtcccggtaacg

SEQ ID NO: 180189 - DNA, 858 bp, Homo sapiens
  misc_feature: GYAE6OF01A5578.26.37.D04.1.454.CMB.1.raw
  modified_base (515)..(515): a, c, t, g, unknown or other
  misc_feature (515)..(515): n is a, c, g, or t
tcagagactatactcacgaccggtgctcgatttagtagcatactgttgggtttggggtgatcaggactcctcagttcaccttctcacaatgaggctccctgctcagctccgtggggctgctaatgctcgtgggtcccagggtccaggtggggatgttgtgatgactcagtcctccgctcctccctcgcccgtctacccttggacgacggcggccctacatcctctgcaggtctagcagctccgtacgtacagagtggacgtacgggaacctaccgtccgtagtaaccgtaggtacttaccgagacgaggaaccggacccgaacggtaccccgaacccgtacccgggacggtacccgtaaccgtttaaactttaaacggtaaaacgttacgttttaacggttaaacggttaccggggtaccggttttaccccggggtaccctaaacggacgtaaacgttacgttaccggaacggtacgggaccggttacgggtaacgggtaccggacggttaccgnggtttaacgttaccggtttacgaaccgtcggttaaacggaacggttaacgtacggtaacgggtcgggtaaacgggggttacggggaaccgggtaggtaacggggtcggtaaggtttcggggttaacgttttcgggtttaacgtttaacgttcggtccgtacggttaggtaacgttaggtttacctacggttacgggtaccgggtcgggttaaccgggttaccggttaaccggggaaccggtaaacggggaaaccggttaaacgggggtaacgaaaaccgtaaacggtaaccggttaaagggcggttacggaacgtaggtaaccctaaccgtttaggttacccg

SEQ ID NO: 180190 - DNA, 733 bp, Homo sapiens
  misc_feature: GYAE6OF01C393T.26.37.D04.1.454.CMB.1.raw
  modified_base (205)..(205): a, c, t, g, unknown or other
  misc_feature (205)..(205): n is a, c, g, or t
tcagagactatactcacgaccggtgctcgatttagtagcatactgttgggtttgggggaggaactgctcagttaggacccatccggaaccatggaagccccagcgcagcttctcttcctcctgctactctggcctcccagataccactggagaaatagtgatgacgcagtctcagccaccctgtctgtgtcctccgaggggaaancgtccaccctctcctgcgacgggccagtcagtagttgttacgtcgcggtcttacggccgtggtaccagcaacgaccgaccgtggggaccaacggtacctccccgaggtcccttcctcttatttactcgctgacctactcccgaacggacgggaccctacgtcggccaaccgtcccgacgtacccgtaggttccgaagggtcgggaccgtaggtacggtaacggttccggtacggggaacctacggtaccctttacaccttcctaccaacctactccgaacgtacgacgtaccgtacggacgtaccgtaggtaacgttcgttttacgtaccttaacttttacgtttacgtcggttacgtacggtacgtaaggtaccgtacgtaccgtacgttccggtacccttcgttccggttaacccggtttcggggaccgggtaaccggggtaaccggtacgggggtacggaacggtacgtacggtaacggaaccggttacggttacgggtaccggttacgccggtaccgtaacccg

SEQ ID NO: 180191 - DNA, 645 bp, Homo sapiens
  misc_feature: GYAE6OF01B3CIR.26.37.D04.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
tcagagactatactcacgaccggtgctcgatttagtagcatactgttgggtttgggggaactgctcagttaggacccagccggaaccatggaacgccccagcgcagcttctcttcctctgctactctggcctcccagactaccactggaagaaatgtgatgacgcagtctccacgcccacctgtcctagtcgtcgtacggaagggaaancgtccacctcgtcngcgaggctagtcgagtagttgtacgcgcgtctacgctacggacagcacgacncgtggacagacctcgagctcctatattancgctcgacacctaccgacggcggaccacgtcgtaccncccgagccgtaggtactaggtgtaccgagggttcgggtacgacggggtacaggttactaccgtacttaccgacacctatccggaacgcgacgtccgagtactcggtacgtaaggtaacttaggttctagttaagtttaacttttacgtacgtcgttaacaacgtaacgtaattaacgttaccgtaaccgtccgtaccctcgttaccgttaccggttacggttacgggaccggtaacggtaacgttagggtaacgaacgtaacgttaaccgaagtagtcggtacgacctacgactcgtgttaccg

SEQ ID NO: 180192 - DNA, 933 bp, Homo sapiens
  misc_feature: GYAE6OF01EEBVA.26.37.D04.1.454.CMB.1.raw
  modified_base (269)..(269): a, c, t, g, unknown or other
  misc_feature (269)..(269): n is a, c, g, or t
tcagagactatactcacgaccggtgctcgatttagtagcatactggttggggttgggggaggaactgctcaggttaggacccgagccggaaccatggaacgccccagcgcagcttctcttcctcctgctactctggcctacccagactacccacgtggaaacggtaaatacggtgagtacggaccgcgtagtccctaccgacgccctaccgtggtcttggtcgtccgtaccgggaaaggggtaaacgtcctacccgacccctcgtccgnggaccgacgggtccagtacgtaaggtcgttggtacggtccggtcggttactacgtcgtacggtaaaccgcaaccgtaacggtaaccgtccggttacgggaccaacgtacccctacccggaacggttccccgtacccgttatttaaacggttcggtcccgaccgttaccgacctaccccgggtaccctaaaccgggtacgttcccgtaaggtacccggttaaccccgcggaaaccggttcccgggttaggttaccggaggtccggtaacggtgggtcgggtacggaacggtaacgtcggttaccctacgtaacccggtcaaccccgtaggttacacccggacgaaacccgttggtcccgacggtaccgttaacgtacggtaaaggtaaacccggtttgttcggaaaccggttttaacttttaacggtttaacggttaccggtaccttaagttaaaccggtaactttaaaccgggtttaaaaccttacccgggtcccggtttaaaccgttaccccggttacgtttaccccgggttaggggtttaaccccgggtagggggaaacccgggtaaaccggggtacgtttaaaggggtaccggaaacttaaaccggaaacgggtaacggtaccggtttcggaggtacccctccggtccttacgttaacccg

SEQ ID NO: 180193 - DNA, 821 bp, Homo sapiens
  misc_feature: GYAE6OF01BA4CK.26.37.D04.1.454.CMB.1.raw
  modified_base (200)..(200): a, c, t, g, unknown or other
  misc_feature (200)..(200): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctcgaggggaanagtccaccctctcctgcagggccagtcagtagtgttacgtcggcggtcgttacgcctggtaccagcacgaccaccgtgggcacgtacctccgaggtccttacctctaagtttatcgcttcggacctacgtcccgaaccggacggtccctacgtcggtacctcccgaacgtccgtaggttacgacggtcggtcgtaagggttcgggtacgtacgggtaactaagggttacgtttaccaccgtttaccacctaaccgtacgtaccgaaccggtccgaacgttccgtacggtacgtaacggttacgtacggtaaagttacgtttagggttaaccgttaacttttaaacgtttttaccgttaacgttacggtaacctaacggtaacttaaaacgtttaaccgtttaaacccggttcccggttaaccggttaccccttacccggttaccgtttaaccccggtttaccgggtttacccgggggaaccggggttaacccgggtaaaaccggtttaacgggttacggtaaacccggttaaacggttaaaccccggtaaaccggtacggtttaccgggttaacgggtaccgttaaccgggaaccctttaacccggtagtttttaaccccg

SEQ ID NO: 180194 - DNA, 803 bp, Homo sapiens
  misc_feature: GYAE6OF01AE3P4.26.37.D04.1.454.CMB.1.raw
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttagtcgcgcttagcctggtaccagcagaccaccgtgggcagacctcccaggcctccctctatttatcgctgccactcccaccgagggtcccacgttcggtactccccgacgccgtaggtttcaggttcggacgtacgggttcggggttaccgtaggggtaacctaaggtaggtttacccaaccgtttcctacccgtaaccctacgttaccgaacggccgaaccggtcccgttacggccgtaacggttaccgttaaggggaaacgtttagttttcggtttacggtacctttaaaacgtttttaacgtttaacccgttaggttacccgtaacggtaaccttaaacttaaaccgtttaaaccgtttaccccggttaccggtacccccgtttcccggtacccgtttacccgttaacccggtttttacccggggacccggggttaaacgggggttaaaccccggtaaaggggtttaccggaaggttaaaccgtaacccggtaaaaaccgggtaacccggtttacgggttccgggtacccgtacggtaccccgtaaacccgttacgtttacccgg

SEQ ID NO: 180195 - DNA, 201 bp, Homo sapiens
  misc_feature: GYAE6OF01BWH20.26.37.D04.1.454.CMB.1.raw
  modified_base (132)..(132): a, c, t, g, unknown or other
  misc_feature (132)..(132): n is a, c, g, or t
  modified_base (178)..(201): a, c, t, g, unknown or other
  misc_feature (178)..(201): n is a, c, g, or t
tcagagactatactcacgaccggtgctcgatttagtagcatactgttgggtttgggggagaactgctcagttaggacccagccggaacatggaacgccccagcgcagtcttctcttcctcctgactacgtcncgcctaccgatactaccagtaggaagaattgagatacgacgctatnnnnnnnnnnnnnnnnnnnnnnnn

SEQ ID NO: 180196 - DNA, 803 bp, Homo sapiens
  misc_feature: GYAE6OF01B383C.26.37.D04.1.454.CMB.1.raw
  modified_base (210)..(210): a, c, t, g, unknown or other
  misc_feature (210)..(210): n is a, c, g, or t
tcagagactatactcacgaccggtgctcgatttagtagcatactgttgggtttgggggaactgctcagttaggacccagccggaaccatggaagccccagcgcagcttctcttcctcctgctactctggcctcccagactaccacgtggaagaaatggtgatgacgcagtcctccagcccacctgtctgtgtcctaccggaaggggaaancgtccaccccttcgtccgtgacggacgggccaagtcgaggtagttgttacggccggcggtctttacggccgtacggtacacgacacgaccgaccgtgggacacgacctaccgacggtccttaccgtactagttttacgcgtcgtacgacctaccgtacccgaaccggacggaccctacgttacggtacctaccccgagtcccgtaaggttcgaggtacgcgtagggtggtaccgtagggacgtacgtacgtcctaccttacgacctaccgtaatcgtaaccgcgtaccggtactacggactaacggttccgtaaggtaaacgttacggtttgtaacggttaacttttaacgttttaacgtttcgtaacgttaccgaaattaacggttaaactttaacgttaaaccccgtccggtttaaccgtccccgttaccgttaaccggttacccggttaccgggtttacccggggaaaccgggttacgggtaaaccgggttaacgggttacggtaaaccgtaccggttaaaaccggttaaaccggttaggttccggtaacgggtaccttaaccggaccttacccgttaaggttttccccg

SEQ ID NO: 180197 - DNA, 668 bp, Homo sapiens
  misc_feature: GYAE6OF01EI0JC.26.37.D04.1.454.CMB.1.raw
  modified_base (204)..(204): a, c, t, g, unknown or other
  misc_feature (204)..(204): n is a, c, g, or t
  modified_base (322)..(322): a, c, t, g, unknown or other
  misc_feature (322)..(322): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggaagaaatgtgatgacgcagtctccagccaccctgtctgtgtctaccgaaggggaaanacgtccaccctctcctgcgacgggccagtcgagtagttgttacgtcgcggtcgttacgtccgtacggtaccacgacacgaccgaccgtgggaccacgacctacccgaggtccctaccnctaatctagtgtacgtacgctacgtaccgaacggacggaccaggtcggccaccgtccgacggccgttaggtcgaggtcggatacggtagtacggtcggagggactagttccttacctaccgtcctacctacgtaaccgtcacgacgacgtacgtacgaccgtactacgtaacttcgtttacgttactttactttacttcgtcgtaccgacgacgtacgtacggtactacgtaccgttctccttacgtccgttacgggttacccgggagggtacggtacgggtagggtacgtaaggtcgtaacggtaacggtaacggtacgtacggtacgtcgtacgcccgttaacg

SEQ ID NO: 180198 - DNA, 264 bp, Homo sapiens
  misc_feature: GYAE6OF01D4BNP.26.37.D04.1.454.CMB.1.raw
  modified_base (259)..(264): a, c, t, g, unknown or other
  misc_feature (259)..(264): n is a, c, g, or t
tcagagactatactcacgaccggtgctcgatttagtagcatactgttgggtttgggagatcatgagggtgtccactacatgggcgtctggggcaaagggaccacggttatcgtctcctcagcctccaccaagggcccatcggtcttccccctggcaccctcctccaagagcacctcgtgggggcacagcggccctgggctgcctggtcaaggactacttccagtatagtctctggaggcgggctggcaaggcgcatagnnnnnn

SEQ ID NO: 180199 - DNA, 642 bp, Homo sapiens
  misc_feature: GYAE6OF01EH1OD.26.37.D04.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccagtgganaatgtgatgacgcagtctccagccacctgtctgtgtctccgaggggaancgtccaccctcctcctcgcgacgggaccagtcgagagttagttacggtcgcggtacttacgcgttcggacacgacaacgacgccgtggcacgtaccnccgacggtcctaccgtcttatttcgacgtcgtacgaccgtacctacccgacccggacggtccctaccgttacgaccttacccgacgtccgtagggttaccgaggtcggacgtacgggtggtcgtaagggtactacgtacgttcacctcgtacaccatcgaacgtcacgtcgacgtanacgtctagagttagttntacgtattaatttagttcgtagtaccgagtaacgtaattacgtacgtaccgtaccgtccctacgtacctacggtacgtcgggaacggtacggtaacgtacggtagaaggtcgtaaacgaaccggtcgtacgcgtaacgtctaccgtgtacc

SEQ ID NO: 180200 - DNA, 753 bp, Homo sapiens
  misc_feature: GYAE6OF01EUFFG.26.37.D04.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (746)..(746): a, c, t, g, unknown or other
  misc_feature (746)..(746): n is a, c, g, or t
tcagagactatactcacgaccggtgctcgatttagtagcatactgttgggtttggggggaactgctcagttaggacccagccggaaccatgggagcccccagcgcagcttctcttcctcctgcctactctggctcccagataccactggaagaaatgtgatgacgcagtctccagcccaccctgtctgtgtctaccggagggaaancgtccaccctctccngcgagggccagtacagtaggtgttacgtcgcggtacttacgccgtggtaccagcacgaccaccgngggacacgacctcccgaggtcctaccgtatagtttancgctcgcacnccgacgacggcctacgtggtacctcccgagtccgtaacggttcgaacggtcggtacgtagggttcgggtacggtacgggaactacggttaccgttaacccgtacctttacccgtaccaaccccgttaagtacccgaacggtcccgtaaccggtccccgtacggtaccgttacggttaacggtaacggtaaggttaacgttttggtaccgttaaaccgttttaaagttttacgttaacgttagtaacccgtaagtaacttaacgtttaaacgttaccgttacccggtacgtccccttccggtacctttacggttacccggttacgggaaccggtaaaccggtaacgggtaaggttcgaacggtaacgtaaaccgtaaacgtagttacggtacgcgtaacccgactaacccgttnttacccg

SEQ ID NO: 180201 - DNA, 828 bp, Homo sapiens
  misc_feature: GYAE6OF01BCN10.26.37.D04.1.454.CMB.1.raw
  modified_base (205)..(205): a, c, t, g, unknown or other
  misc_feature (205)..(205): n is a, c, g, or t
tcagagactatactcacgaccggtgctcgatttagtagcatactgttgggtttggggggaactgctcagttaggacccagccggaaccatggaagccccagcgcagcttctcttcctcctgctctctggcctcccagactaccactggaagaaatagtgatgacgcagtctccacgccaccctgtctgtgtcctcgaagggaagngtccaccctctccgtgcgacgggccagtcagtagtgttaggtcgcggtcttacgccgtaggtaccagaccaagaccgtaccgtgggacacgacctcccgaggtcctccgtactagttttagcgtcctagacctccgtacccgacggacgggtaccctaggttacgtaacctcccgaaggacccggttacggttacgacggttgggccgttaggggtccgggttaccggaggggtaaaccgttaggtacgtttaccaccgtttacccgtactaaccctagtaaccgacggcaacgtccccgtagtaccgttacgtacgtaacggtaaagttcgtttagggttactaagttttaaattttaccgttacgtagtaccgtaacttaactaaagtttaaaccttaaccggttaacccgtccccggttacccttacccgtacccgtttaaccggtaccccggggttaaacggggtaacccggggttaaaccggtaaaacccgggttaggggttaaaccgtaaaccgggttaaaacgtaaaccccgggttaaaaaccggttaacgggttaccgggttacgggtacccggttaaaccccgtaacccgtttaaccggttaccttaacccggg

SEQ ID NO: 180202 - DNA, 685 bp, Homo sapiens
  misc_feature: GYAE6OF01C4B57.26.37.D04.1.454.CMB.1.raw
  modified_base (233)..(233): a, c, t, g, unknown or other
  misc_feature (233)..(233): n is a, c, g, or t
  modified_base (556)..(556): a, c, t, g, unknown or other
  misc_feature (556)..(556): n is a, c, g, or t
  modified_base (574)..(574): a, c, t, g, unknown or other
  misc_feature (574)..(574): n is a, c, g, or t
tcagagactatactcacgaccggtgctcgatttagtagcatactgttggggtttggggggaactgctcagttaggacccagccggaaccatggaagccccagcgcagcttctcttcctcctgctactctggctcccagataccactggacaaaatgtgctgacgcagtctccagcccacctgtctgcctctccgaaggggaacagtcacctatcctccgtggtcgggccggtnaagtacgtatagcaagctaacgttacgcctggaccaccgagaccgaaacggtaaaccgtcgggaccacgggccgtacccgacggtccctcctacgtactttccgttttagacgttccggtacccgttacccgaacccggtaccggggtcccttaaccggtttcccgggtttccccgaacgtcccgtaacgggtttcgacggtacggctacggttcggtccgttacgcggaccgacgtacgtacgttctaccgtctacaacctgtacaacgtcgcctagcgtacgtcgtagtaagttgtttacgtactttagtttacttacgtntacgtactatagtactanagtcgtacgtcgtcctcttacgtaccgtacggacccgtaaggacctaacggtacgtaggtaacgtaacgtaaacgtcgtacggtcgacgtcgtaactacgtgtcgttaccg

SEQ ID NO: 180203 - DNA, 758 bp, Homo sapiens
  misc_feature: GYAE6OF01AVRRX.26.37.D04.1.454.CMB.1.raw
  modified_base (205)..(205): a, c, t, g, unknown or other
  misc_feature (205)..(205): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccatggagaaatagtgatgacgcagtcctcacgccaccctgtctgtcgtctaccgaaggggaaancgtaccacccctctccctggaccgtacgggcccaagtcaaggagttgttaacggtccgcgggtactttaagcccgtaggtaaccagtcaagtaccaccgtggggaccaacgacctaccccgaggtacctacccttactaatttacgtcgtaccttggtaccaacctaccccgtaaccgaaccgggtaccctaacgttacggtaacctacccgtacggaccgttaacggtttcgaacggttcggacgtagggttcgggtaccgttaaggggaactacggtacttaccgactcctactaaccctacgtacacgtacacgccgtacgacgtattcgaagtacgtaagtttgtacgtaacttaacttttataccgttagtacgaacgtaacgtaattaaactaaccgtaacccgttcgacccgttcccgtaacgtaccgttaaccggtacggggaaaccgggtaccggaaccggttaaagggttacaagggttaactaaccggtaaaggtaaaccgttcggtacggtaccgacgtaacccgtaacctggttaccccg

SEQ ID NO: 180204 - DNA, 813 bp, Homo sapiens
  misc_feature: GYAE6OF01B7Y0K.26.37.D04.1.454.CMB.1.raw
  modified_base (156)..(156): a, c, t, g, unknown or other
  misc_feature (156)..(156): n is a, c, g, or t
tcagagactatactcacgaccggtgctcgatttagtagcatactgttgggtttggggggaactgctcagttaggacccagccggaaccatggaacgccccagcgcagcttcctcttcctcctgacctactctggcctcccagactaccactggaanaatagtgatgacgctagtcctaccagcccacctgtcttggtcgtcctaccggaaggggaacgacgtccacccgttctccgtgcgtacgggccagtcaggtagttcggttacggtcgcggtcttacggccgtacggtaacctcgaccgaacgaccgaccggtcggacctacgacccgtccgacggtcctccgttactagttttacgcgtccgtacgaccgtaccgtacccggacccggtaacggcccgtaacggttcgtaccgtcccaacggtaccggtacggttacgtacggtacggtacgtacggggtcggttaccggtacgggtacgtacggtaccgtttacctaccgttccgtaacccacgtaccgtaccgtacggtaccgtaccggtccgtacggtaccgttacgtcgttaacggtaaaggttcgttacgggttacttacgtttaagtttaacgttcggtaactacgtaactaacgtttaaaccgtaacgttacccgttaccgggtaccgtcccgttacgttacccgacgttaccgggttaccgggaaccggggttacggaacgggttaacggtaacgtacgtaaacggtaccggtaaaccggttacgggttcggtaccggttacggtacctaccccgtagttccgttacccg

SEQ ID NO: 180205 - DNA, 818 bp, Homo sapiens
  misc_feature: GYAE6OF01BFRHB.26.37.D04.1.454.CMB.1.raw
tcagagactatactcacgaccggtgctcgatttagtagcatactgttggggtttggggggaactgctcagttaggacccagccggaaccatggaagccccagcgcagcttctcttcctcctgctactctggctcccagatattaaccggaaaaatatgatgactcagtctccaggccaccctgtctgtgtctccgaaggggaaagacgtccaccctctcctagcgagggccaagtcagagttgttagcgcggtcttacgcctacggtaaccaacaacgaaaccgtgggacacggcctaccgaggtcttcttacagttcgtacgggtcgactaaccgtcccgaaccggacggacccgtaacggtttcggttaacccgtcccccggaccgttaagggtttaccgaacgggttcgggaccgtaacggggttcggggttaccggtaaggggtaccggtacggtttccaaccgttcctaccgaacctagtccaaggtccaacgtccgtggacctaggtacgtacggtaagttacgttttacggtacttaaggttttacgttaacgttacggtacgtaacgtaacgttaaacgtaaaacgttaaaaaccggtccgggtacccgttacccgggttaacgggtaccgggttacccgggaaccggtaacgggaaacccggttaaggggtaaacggtaaaacgtaaccgaaacgtaaccgttaggtaccggtacgtaaccgtaccgtaaaccgttacgttacgttacggtttaccttacggtaaccgtttccccgttacccgtaccctaagttccgttaaggtaaacg

SEQ ID NO: 180206 - DNA, 665 bp, Homo sapiens
  misc_feature: GYAE6OF01A72T6.26.37.D04.1.454.CMB.1.raw
  modified_base (163)..(163): a, c, t, g, unknown or other
  misc_feature (163)..(163): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (584)..(584): a, c, t, g, unknown or other
  misc_feature (584)..(584): n is a, c, g, or t
  modified_base (653)..(653): a, c, t, g, unknown or other
  misc_feature (653)..(653): n is a, c, g, or t
tcagagactatactcacgaccggtgctcgatttagtagcatactgttgggtttgggggaggactgctcagttaggacccagccggaaccatggaagccccagcgcagcttctcttcctcctgctactctggctcccagataccactggagaaatgtgatgacnagtctccagccacctgtctgtctctacgaggggaaancgtcacctctcnggcacgggccagtacagtagttggttagtcgcgtcttagccgtggtaccagacagacgaccgtgggacacgcctccgaggccttccgtatactttagtcgtctcgacctacgtaccgaccgaccggctacgtcggtaccacccgacggtccgtaggttccgaagtcgggacgtagggttcggaacggttcgggaaaccttacggtacgtttaacctaccgtaccttaccgtaacccgtagtaccgacgtacgttaacccgcgtacgtacccgtaacggttacgtaacggtaagtacgttttgtaacgttacctttaagtttacgttactcgtaactacggtaactaacgtagttaacctacggtccgttacncccggtctaccgtcgttcgggacggtaacggtacggtacgttacaggtacacgtaagacgtcggtcgtnacgcgtaactcg

SEQ ID NO: 180207 - DNA, 661 bp, Homo sapiens
  misc_feature: GYAE6OF01EA5EZ.26.37.D04.1.454.CMB.1.raw
  modified_base (154)..(154): a, c, t, g, unknown or other
  misc_feature (154)..(154): n is a, c, g, or t
  modified_base (184)..(184): a, c, t, g, unknown or other
  misc_feature (184)..(184): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (332)..(332): a, c, t, g, unknown or other
  misc_feature (332)..(332): n is a, c, g, or t
  modified_base (391)..(391): a, c, t, g, unknown or other
  misc_feature (391)..(391): n is a, c, g, or t
tcagagactatactcacgaccggtgctcgatttagtagcatactgttgggtttggggagaactgctcagttaggacccagccggaaccagtggaacgccccagcgctagcttctcttctcctgctactctggcctccagactaccagttggaanaaatgtgatcggaacgctacgtctccgaanccctaccgtgtactggtcgtccacgagggaactgccaaccgtntccngacgaggccagtcaaggnttagttaacaaaccgntttacggccaggtaaccagtacgaagtaacgtgccaaggtcctccaggcctcttccgaagtcgtacnggtacgtactacgtaccgaacgaggtaccctacgtcggtaaacctccccggaacgttanacgtatcgtagacgtagtcgctacgtagtacgagttacgacgttagcgactagacgttagacgtactagactacgtcgaagtcaacgacgttacgacgtacgtaacgtacgtacgaccgacgttagacctacgtacggacttacgaccgggtactaccgtcgtaacgtaacgtcgtacgcgtttaaacggtccagtaccgtaaggtaactttcggaacccgtagtacggttacgaaccgttaacgtaacggttaacccgtaaggttaacg

SEQ ID NO: 180208 - DNA, 691 bp, Homo sapiens
  misc_feature: GYAE6OF01EVXD8.26.37.D04.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (265)..(265): a, c, t, g, unknown or other
  misc_feature (265)..(265): n is a, c, g, or t
tcagagactatactcacgaccggtgctcgatttagtagcatactgttgggtttgggggggaactgctcagttaggacccagccggaaccatggaagcccccagcgcagcttctcttcctcctgctactctggctcccagataccactggagaaatagtgatgacgcagtctccagccaccctgtctgtgtctacaagggaaangtccaccctntccngcagggccagtcagatgttagcgcggcttagcctggtaccagcagacnccgtggcagcctccaggcctcctactattctttagagttacgccggtaccaccgagggccctagttcggtttcccagcccgtagggtttccaggtggactaggtcggcgttaccgaggtaccgaacgtaggtaacgttttacccaacgtttaccgtacctaaaccgaacttaccgaaacgtacccggtacctcgtaccgtacgttctaacggtaacggttacttttcgacgtttaagttttaaccgtttacttacggttacgacgtactaacgttactaacgtacgttaacggtacgtaaccggtccgttaccgtacccgtaaccgttccggaaccggtaaacgggaccgtaaccgttacggtacggtaaaggtaacgtaaacgtacgtagggtacgactacggactaaccgtacgttcgttaccg

SEQ ID NO: 180209 - DNA, 784 bp, Homo sapiens
  misc_feature: GYAE6OF01AY9OO.26.37.D04.1.454.CMB.1.raw
  modified_base (347)..(347): a, c, t, g, unknown or other
  misc_feature (347)..(347): n is a, c, g, or t
tcagagactatactcacgaccggtgctcgatttagtagcatactgttggggtttggggggaactgctcagttaggacccagccggaaccatggaagccccagcgcagcttctcttcctcctgctactctggctacccagactaccactggaagaaatagtgatgacgcagtctccagcccacctgtctgtgtctacgaggggaaatcgtccaccctctcctgccgacgggcctaggcaggtagttggttacggtccgggcggtacttacggccgtgggtaccaggtaccaggaccgaccgtgggaccacggtaccctcccgacggtccttccgtacgtagttttacncggtctacgcctaaccgttcccgaacgacgggtccccaaggttcggtactcccgtaacggtctaagggttcgaacggtcggtcggtacgggttcgggtacggtacggggactaacgggtcttaccgacctttacggacccaacctagttaccgagacccgtcggtcgtacggtctaacgggttactagggtaacgttagttcgtaacggtttaacttaacggttttaacgtaccggttcgttaccgaaagtttaactaaacgtttaacgttaaccgtacccggttcggtacccttaccggacccttttacccggttaacggggttcgggaacccgggttaaacgggtaccgggttaaacggttgaaccgtaaacgggttacgaaaccgtttacgggacggttccgacggttaaccggaccgttctcggtttacccgg

SEQ ID NO: 180210 - DNA, 602 bp, Homo sapiens
  misc_feature: GYAE6OF01EYQCQ.26.37.D04.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaaggggaaangtccaccctctcctgcgagggccaagtcagagtcggttagtccgcggtcttagcctaggtaccaggcagacaccgtgggcacgactccgagctctctattangntgacntcccacgcggcagtgtactcccagccaggttcaggtgctaggtggtccngggaacnggcttccacgtcacgaccatcgcgtacncggacctgacgtatccgtaaggtaagtagttcgtagtacgtaaatttacgttaactgtacctagactaaagttactaacgtcgtacgtccctcgtctaccttaccggttagggaccggtaacgggtacctagggttacgaagttaactaaccgttaaacgacggttacgggtacgtaaccgttaccaacctacccgtaagttcccg

SEQ ID NO: 180211 - DNA, 706 bp, Homo sapiens
  misc_feature: GYAE6OF01EE1PC.26.37.D04.1.454.CMB.1.raw
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
tcagagactatactcacgaccggtgctcgatttagtagcatactgttggggtttgggggaggaactgctcagttaggacccagccggaaccatggaagccccagcgcagcttctcttcctcctgctactctggcctcccagactaccatggaanaaatagtgatcgacncagtcctccacgccctacccttgtcctgttcgtcctaccggaagggggaaatcgtccacccttctcctgccgacggcagtcgagtgtgtcgcgcgtctcgcgtacgacngcacgacncgtggcacncctaccgcgtcctctattattcgtcgtctcgacctaccgtacccgaaccggcggtaccctaacggttcggtaccctaccccgacgtaccgttacggggttacgaggggtcgggtacgggttcggggttacggggtcgtaacggggaacgttacggggtttaccttacccgtaccgttacctacccgtacttaggacccgacggtccaaccggttcctacggtacccgtaggtacgtaaggtacgttaggtttacgtacttaaccttttaatttaccgtttacgtacggtacctaatacttaaattaccgtaaccgttccgtccgtcctacgtccttcgttaccggggtcgagggtacgtaaggtggttaacagtaccgtaaacgagtacgtgtacgtcctacgctacggtc

SEQ ID NO: 180212 - DNA, 638 bp, Homo sapiens
  misc_feature: GYAE6OF01AGXNZ.26.37.D04.1.454.CMB.1.raw
tcagagactatactcacgaccggtgctcgatttagtagcatactgttgggtttggggggaactgctcagttaggacccagccggaaccatggaagccccagcgcagcttctcttcctcctgctactctggcttcccagataccactaggagaaatagtgatgacgcagtctccagcccaccctgtctgtgtctccgaggggaaagcgtccaccctctcctgcgagggccagtcaggagttgttagtccgcggtcttagcctggtaccagcagacaccgtgggccagactcccgaggcctccgtctattatcgctgcctactcccgacgcgggcctacgtcggtacctcccgacgtccgtaggttcgacggtcggcgtagggtcggtcgtacgggactggtacttaccgactccgtaccactactacgacgtccaacgtcctagactagtacgtagaacgttgttacggtagtaacttaattttacgtaccgtacgtacaacgtaataaacgttaactaaccgtcccgtcgtaccctccgtcctaccgttaccggttcgggaccggtaacggtactaagggtcaacggtactaaccggaaacgtcgttaggtcgtaccgtgaccctaccgtacgttccg

SEQ ID NO: 180213 - DNA, 926 bp, Homo sapiens
  misc_feature: GYAE6OF01EIA3Z.26.37.D04.1.454.CMB.1.raw
  modified_base (175)..(175): a, c, t, g, unknown or other
  misc_feature (175)..(175): n is a, c, g, or t
tcagagactatactcacgaccggtgctcgatttagtagcatactgttgggtttggggggagaggagcccagcactggaagtcgccggtgttccattcggtgatcagcactgaacacagaggactcaccatggagtttgggctgagctgggttttcctcgttgcttcttttaaggnggtgtccagtgtcaggagcgaggtagtggagtcgtgggggagcggtggtccgagtccggtcgggggtccctggacgacctctccgttggtcgcgacgtccttcgtaggtactttaccgtacccgtttaccgtaaacgttaccccgttaaccggccctaagtcggtaccgaaccggttgggaccgttacccggaccgtaaccggggtcttacccggaagggtaccggtaacgggggtacctaaggggtacgggtttcgggggttacggaccttttacgttttaaacgtaacgtaccgtaagtttacggtacggttaaacggttaacggggaaaaggtttaactaacggtaaaccgttaacggtttaaccgggaaccgtaaccgggtaaccgttcccgggttaaacgggaaaccggggtcccttaacggttaccccgacccggtttacccgtaacccgaacgggtaacctaaaccgttaacgttaaccgaaacggtaaccgggtaccgtaaccgttaaggtttacgtttaccgtacgaaaccggtaaagtaaacggtaaaccgtcgtaacgggtacggtaagggttaccggtaaacgggtaacccgttacgggggttaccttaacgggtttaccttttacggtaccggttacggtaaccgggttaccgggttaacggggttccggggttaacgggtacggggttacttacccggtaaacgttacggtacgggttacgggccggttaacggggg

SEQ ID NO: 180214 - DNA, 866 bp, Homo sapiens
  misc_feature: GYAE6OF01A1GT6.26.37.D04.1.454.CMB.1.raw
  modified_base (207)..(207): a, c, t, g, unknown or other
  misc_feature (207)..(207): n is a, c, g, or t
  modified_base (821)..(821): a, c, t, g, unknown or other
  misc_feature (821)..(821): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggacaaaatgtgctgacgcagtctccagcccaccctgtctgccctcgtaccgaaggggaaancgtccaccatcctcctgggtccgggccggtcaaggtagtattacgcacgacctaaacgttcggccttagggacctaaccgagaccgtaaacggaaacccgtggggaccaccgggtccctacccggacggtcccttacccgttctaaccgtttcgtttacggacgttccggtacccgtacccgaaccggaccggggtcccttaaccggtttccgggtttaccccgaagggtaccccgttaagggttaccgacgggttaccgggaccgttaacgggttccggtacccgggtttacccgtacgggtaaccgggttaaaccgtaacgggttaacccgttttacccgaaacccgtttccccgtaaacccgtaacccgtaaccgttaacccgaaacccgtaccggtaccccgttacggtaaccgtaaccgggtttacgttaaacgggtttaaactttacgggttttaccgaacgtttttaacgttttacgtcgtacgtaaccgtaacgtacgtaagtacttcgtaacgttcgaaccggtcggtaccctacggttaccgaccgttaccggaacgtaacgcccggaacgttacggtaacgtaaacggttaaacgttaaccgnggttcgtaccgtaccggttacacccgttagtcccgttcggtttac

SEQ ID NO: 180215 - DNA, 750 bp, Homo sapiens
  misc_feature: GYAE6OF01B1LTM.26.37.D04.1.454.CMB.1.raw
  modified_base (638)..(638): a, c, t, g, unknown or other
  misc_feature (638)..(638): n is a, c, g, or t
tcagagactatactcacgaccggtgctcgatttagtagcatactgttgggtttggggggaactgctcagttaggacccagccggaaccagtgggagccccagcgcagcttctcttcctcctgctactctggcctccagactaccacgtggaagaaatagtgatgacgcgacgttcctccacgccctaccctgttcctggtcgtcctaccggaaggggaaactacgtccaccctcgtcctcgcgacgggccagtcgagtagttgttacggcgcggtctacgtcgtacggaccagcgacgaccgacgtgggactacgacctccgaggtcctcctatatttagcggtcctacgacctaccgtacccggaccggtacggtaccctacggttcgtaacccgtccccgaacggtaccggttacggttccgaggttccggacgttaggggtcggttcggaacgggtaactaggtacgttaccctaccgtctaccaccgtagtacccgacgtccgaccgtccgtaggtaccggttagtacggtaagacggttttagcgggttaacgttaaactttagttttaacggttctacgtaagtacgttaactaacgttaactaccggttccgtacccggttacctacccgngtttcggttaaacccggtcgggtaaaccggtaacggttaacgtacggtacgaacccgttaaacgaaccgtaacggtacgtcgggtaacgtctaacgaccctgttagttcccg

SEQ ID NO: 180216 - DNA, 510 bp, Homo sapiens
  misc_feature: GYAE6OF02JGZ6X.26.37.D04.1.454.CMB.1.raw
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (440)..(440): a, c, t, g, unknown or other
  misc_feature (440)..(440): n is a, c, g, or t
tcagagactatactcacgaccggtgctcgatttagtagcatactgttgggtttggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacacctgggcagactcccaggctcctcatttangctgcatccacagggccactggtactcccagccaggttcagtggcagtgggtctgggacagagttcactctcaccatcagcagcctgcagtcngaagnttgtgactaatttntactgtacagcaatatataccgtgtacctccgntcgacgtttcggcggaaggaccctaaggttagagaacgttacgaaacgtactggtgactcgactacctag

SEQ ID NO: 180217 - DNA, 500 bp, Homo sapiens
  misc_feature: GYAE6OF02HJITO.26.37.D04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactcccaggctcctcatttangctgcatccaccagggccactggtatcccagccaggttcagtggcagtgggtctgggacagagttcactctcaccatcagcagcctgcagtctagaagattgtgactaatttattactgtcagcaatataatacctggcctccgctcactttcggcggagggacctaaggttgagtatacaaacgacgtgtcggctggctacgatc

SEQ ID NO: 180218 - DNA, 511 bp, Homo sapiens
  misc_feature: GYAE6OF02IBOPY.26.37.D04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (290)..(290): a, c, t, g, unknown or other
  misc_feature (290)..(290): n is a, c, g, or t
  modified_base (354)..(354): a, c, t, g, unknown or other
  misc_feature (354)..(354): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctccagataccactggagaaatagtgatgacgcagtctccagccaccctgtctgtgtctccaggggaaanagtcaccctntcctgcagggccagtcagagtgttagtcgcggcttagcctggtaccagcagacacctgggcagactcccaggctcctnatttatgctgcatccaccagggccatggtatcccagccaggttcagtgcagtgggtctgggacngagttcactctcaccatcagcagcctgcagtctgaagtattgtgctaattttattactgtcagtctaaatataatacctggcctccgctctacgtttcggcggagggtaccaagggttcgaagtactacgaaacgtactggtaggctgaccactacg

SEQ ID NO: 180219 - DNA, 514 bp, Homo sapiens
  misc_feature: GYAE6OF02GSY6O.26.37.D04.1.454.CMB.1.raw
  modified_base (264)..(264): a, c, t, g, unknown or other
  misc_feature (264)..(264): n is a, c, g, or t
tcagagactatactcacgaccggtgctcgatttagtagcatactgttggggtttgggggaactgctcagttagggacccagccggaacctatggaagccccagcgcagcttctcttcctcctgctactctggctcccagataccactggagtacattgttttgacacagtctccagccaccctgtctttgtctccaggggaaagagccacccgtctcctgcagggccagtcagagtgttggcagctacttagcctggtaccaanagaaacctggccaggctcccaggctcctcatctatgatgcatccgaacagggccaactggcatcccagccaaggttcagtggcagtgagtctgggacagacttcactctacaccatcagacagcctagagcctagaagattttgctactttaattactgtcagcagcgtagcaactggcctctcacgtttcggcggagggaccagggtaggaggatcgagacgtaacgtgtggctggcaccgtatactcg

SEQ ID NO: 180220 - DNA, 492 bp, Homo sapiens
  misc_feature: GYAE6OF02G7V2L.26.37.D04.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacacctgggcagactcccaggctcctcatttangctgcatccaccagggccactggtactcccagccaggttcagtggcagtgggtctgggacagagttcactctcacatcagcagcctgcagtctgaagattgtgctaatttattactgtcagcaatataatacctgcctccgctcacgtttcggcggaggaccgaaggttgagatacaacgactggtgctgcactac

SEQ ID NO: 180221 - DNA, 536 bp, Homo sapiens
  misc_feature: GYAE6OF02HZ9DD.26.37.D04.1.454.CMB.1.raw
  modified_base (297)..(297): a, c, t, g, unknown or other
  misc_feature (297)..(297): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttangctgcatccaccagggccactggtactcccagccaggttcagtggcaggtgggtctgggacaggagttcactctcaccatcagcagcctgcagtctagaagtattgtgtactaattttattactgtcagcaaattataatacctcggcctccgctcctacgtttcggacggtacgggtaccgtaagggttcgaaggtactaccgaaacgacgttcggtacggacgtcggccaccgtacg

SEQ ID NO: 180222 - DNA, 512 bp, Homo sapiens
  misc_feature: GYAE6OF02FQWC5.26.37.D04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (296)..(296): a, c, t, g, unknown or other
  misc_feature (296)..(296): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctntcctgcagggccagtcagagtgttagtcgcggcttagcctggtaccagcagacacctgggcagactcccaggctcctcatttangctgcatccaccagggccactggtactccccagccaggttcaggtggcaggtgggtctgggacagagttcactctcaccatcagcagcctgcagtctagaagattgtgactaatttatactgtcagcaatataactacctgcctccgctctacgtttcggcggacggaccgtaaggttgaagtactacgaaacgtacgtggtaggctgaccactac

SEQ ID NO: 180223 - DNA, 504 bp, Homo sapiens
  misc_feature: GYAE6OF02F0N6W.26.37.D04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (297)..(297): a, c, t, g, unknown or other
  misc_feature (297)..(297): n is a, c, g, or t
  modified_base (397)..(397): a, c, t, g, unknown or other
  misc_feature (397)..(397): n is a, c, g, or t
tcagagactatactcacgaccggtgctcgatttagtagcatactgttgggtttggggaggaactgctcagttaggacccagccggaaccatgggaagccccagcgcagcttctcttcctcctgctactctcggctcccagataccactggagaaatagtgatgacgcagtctccagccaccctgtctgtgtctccaggggaangtcaccctntcctgcagggccagtcagagtgttagtcgcgggcttagcctggtaccagcagacacctgggcagactcccaggctcctcatttangctgcatccaccagggccatggtactcccagccaggttcagtgacagtggtctgggacagagttcactctacaccatacagcagcctgcagtctgaagtnttgtgactaatttatactgtcagcaatataatactgcctcgctcactttcggcgacggacctaaggttgacgtatacgaaacgtactggtacggctcgaccactacg

SEQ ID NO: 180224 - DNA, 801 bp, Homo sapiens
  misc_feature: GYAE6OF02GHQZC.26.37.D04.1.454.CMB.1.raw
  modified_base (262)..(262): a, c, t, g, unknown or other
  misc_feature (262)..(262): n is a, c, g, or t
tcagagactatactcacgaccggtgctcgatttagtagcatactgttgggtttgggggaggaactcgctccaggttaggtaccccaaggccggaaacctactggtaaggccccagcgcagcttctacttcctcctggcctactcctggctccctagggattaccactggaggttaaacttaggttgattcgaacgcgagttcctcctagcctaccctgtctggtgtcgtccgaggggtaaggagtctacccgtctccgggtncaagggcctagtcagagtgttagccgcggacttagcctgtaccagcagtacgaccttggcaggacctcccgaggccttcctcggaagtttactggctggctagtccaacgagggcctacgttcggtagtccccgagccgtagggtttccaggttcggtctaacgggtcggggtacctggggtactagggtacggtttccaaccgttccgtaccgaaccctacgttccgaaggtaccgaacgtaccccgtacgaacctaacggttccctaggaaacgtagttttcggttacgtacgttaaagtttttacgttaaccgttacggttaccgaacggtaccgtaaaacgttacgttaaaccttaacccggttacggttaccctttaccggtacctttaccgttaaccgttttccggggaccgggtaacgggttaacccggttaaacgggttttacggaaacggtaacgttaaaccgtaaaaccggttaaccggtttcgggggttaaccgggtccgtttacgggaccccgtaacccgtacccgg

SEQ ID NO: 180225 - DNA, 520 bp, Homo sapiens
  misc_feature: GYAE6OF02GU6M6.26.37.D04.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (395)..(395): a, c, t, g, unknown or other
  misc_feature (395)..(395): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacacctgggcagactcccaggctctcatttangctgcactccaccgagggcccacgtggtactcccagccaggttcagtgcagtggtctgggacaggattcactctcaccatcagcagcctgcagtctagaagtnttggtgactaatttattactgtcagtctaatataatacctggtcctccgtctctacgtttcggacgtagacgtaaccgtaggttgacgtactacgaaacgtacgtcggtacgcctagccactacg

SEQ ID NO: 180226 - DNA, 583 bp, Homo sapiens
  misc_feature: GYAE6OF02GT1R2.26.37.D04.1.454.CMB.1.raw
  modified_base (204)..(204): a, c, t, g, unknown or other
  misc_feature (204)..(204): n is a, c, g, or t
  modified_base (411)..(411): a, c, t, g, unknown or other
  misc_feature (411)..(411): n is a, c, g, or t
tcagagactatactcacgaccggtgctcgatttagtagcatactgttgggtttgggggaggaactgctcagttaggacccagccggaaccgatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacaccgtgggcagactcccaggcctcctcatttatgctgcatcccaccagggccacgtggtactcccagccaggttcagtggcaggtggtctgggacagtagttcactctacacctatcacgcagcctgcagtctagaagtattgtnacttaatttattacgttgtacagtactaaattactaattacccgtggtcccttccggtaccttaccgtaccgttttccgggaccgggtaacgggtacccgtaaagggttacgaacggtaacgtaaccgtaaacggtaacgttggtacgggtacctacggacctaccgtaccg

SEQ ID NO: 180227 - DNA, 585 bp, Homo sapiens
  misc_feature: GYAE6OF02HUETI.26.37.D04.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttagcgcggcttagcctggtaccagcagacacctgggcagactcccaggctcctcatttangctgcatccaccagggccactggtatcccagccaggttcagtggcaggtggtctgggacaggagttcactctcaccatcagcagcctgctagtctaggaacgtattgtgtacttaaattttacttacttgtactagactaaattaacttaaacttaaccgtcgggtcccttcccgacttactaaccgttttcggggaccgggtaggggtacccgtaaagggtttcggaacggtaactaacgaaaaccggtaacgttggttacgggccttacggacctacccgtagtttcccg

SEQ ID NO: 180228 - DNA, 544 bp, Homo sapiens
  misc_feature: GYAE6OF02H1N52.26.37.D04.1.454.CMB.1.raw
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtactcccagccaggttcagtggcaggtgggtctgggacagagttcactctcaccatcagcagcctgcagtctagaagtattgtgtctaattttattactgtcagacaattataactacctggtcctccgtactccgtaccgtttcggacgggtaagggtaccgtaagggttcgaagtactaaccgaaaccgtacgttcggtacggacgtacggacctacctacg

SEQ ID NO: 180229 - DNA, 586 bp, Homo sapiens
  misc_feature: GYAE6OF02GYRPI.26.37.D04.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacactgggcagacctcccgaggcctcctcatttangctgcatcccaccgagggccacgtggtactccccagccctaggttcaggtggctaggtgggtctgggacaggtacgttcactctcaccatcagcagcctgctagtcgtagaagtattgtagtacttaaattttacttactgtacagtactaaattaacttaacttaccgtcggtacccttccgtacttaccgtaccgtttccgggaccgggtacgggtaccgtaagggttcgaagtacgtaaccgaaaccggtaacgttggtacggtcctacggacctaccgtagttccg

SEQ ID NO: 180230 - DNA, 555 bp, Homo sapiens
  misc_feature: GYAE6OF02G5CCA.26.37.D04.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggcaaaatagtgctgacgcagtctccagccaccctgtctgcctctccgaggggaaangtcaccatctcctgtcgggccgtnagagtatagcagcaacttgcctggcaccagcagaacctgggcaggctcccaggctcctcatctttgatgccgtccaccgagggccacgttcggtttcccagcctaggttcaggtggcaggtcgcgtctggcgacagtgttcactctcaccatacaacncgcctgctagtctagaagttntttgcttagtttattactgtcagtnagtatcattgactcggcctctccgtaccgttccggaccgaagggaccacgtacgtacggtaacgtaaacgttaaaccgaacgttcggtacggtaccttacggaccctaaccgtacgttacgttcgg

SEQ ID NO: 180231 - DNA, 542 bp, Homo sapiens
  misc_feature: GYAE6OF02I1L82.26.37.D04.1.454.CMB.1.raw
  modified_base (295)..(295): a, c, t, g, unknown or other
  misc_feature (295)..(295): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttangctgcactccaccgagggcccactggtactcccagccaggttcaggtggcaggtgggtctgggacagagttcactctcaccatcagcagcctgcagtctagaagtnttggtnacttaattttacttactgtaccagtcaaattactaactccgtgccctccgctcctacgttcgggacggaggacctagggttcgaagtactaacgaaacggtacgttggtacggctacgaccgtacctagttcccg

SEQ ID NO: 180232 - DNA, 524 bp, Homo sapiens
  misc_feature: GYAE6OF02HRY0N.26.37.D04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (292)..(292): a, c, t, g, unknown or other
  misc_feature (292)..(292): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctntcctgcagggccagtcagagtgttagcgcggcttagcctggtaccagcagacacctgggcagactcccaggctctcatttangctgcatccaccagggccatggtatcccagccaggttcagtggcaggtggtctgggacagagttcacgtctcacatcagcagctgcagtctagaagtattgtgactaatttattactgtacagactaatatactaccgtgccttccgctctacgtttcgggacggtacgggtactaagggttgaagactaccgtaaaccgtacgttggtacggtactcgtacacctattccg

SEQ ID NO: 180233 - DNA, 580 bp, Homo sapiens
  misc_feature: GYAE6OF02J1JMI.26.37.D04.1.454.CMB.1.raw
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttagtcgcggcttagcctggtaccagcagacacgtgggcagacctcccgaggcctcctctatttatcgctgccactcccaccgacgggcccacgtcggtactccccgagcctaggttcaggtggcgaggtgggtcgtaggggacaggtacgttccacgtctacacctatacacgcgacgtcctgctagtctagaagtgttgtgtacttaatttacttactgtcagtactaattataactaccgtcgtccctaccgtctacgttacgttcgggacggtacgggtaccgtaaggttgaacgtacgtaacgaaacgtacgttcggacgtcgtacgtacctacgtacg

SEQ ID NO: 180234 - DNA, 587 bp, Homo sapiens
  misc_feature: GYAE6OF02JI4A3.26.37.D04.1.454.CMB.1.raw
  modified_base (202)..(202): a, c, t, g, unknown or other
  misc_feature (202)..(202): n is a, c, g, or t
  modified_base (332)..(332): a, c, t, g, unknown or other
  misc_feature (332)..(332): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
tcagagactatactcacgaccggtgctcgatttagtagcatactgttgggtttgggggtaacgtgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagacctcccgaggctcctctatttatgctgaccatccaccgagggcccacgtggttacnccccgagccctaggtcagtcggcaggtcgggtctgggacagtagttccactcctacgaccagtcagccacgtacctgctacgtctagaacgtnttggntactaattttactacgttgtcagtacaagttataacttaccgtcgtccctaccgttcctacgtacgtttccggcgggtacgggtaccgtaagggtttcggaagtactaaccgtaaacgtacgtacgtacgggtcctagggaccctacgactttacgg

SEQ ID NO: 180235 - DNA, 723 bp, Homo sapiens
  misc_feature: GYAE6OF02GN1Y4.26.37.D04.1.454.CMB.1.raw
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtcctcgagggaangtcaccctctcctgcgagggccagtcagagtgttagtcgcggtcttagcctggtaccagcagaccaccgtgggaccagacctcccgaggtccttcctactatttancgctgcctactcccacgacgggcctacgtcggtacctccccgagtcccgtaggttccgacggtccggacgtaggtcggtacgttcggtacgggactaggtacttaccgaccttctacgaaactcgtacgaacgtcaaccggtccgtacgaccgtaccgtccggttagggtaaggtttacgttttacggaaccttaaaccgtttttaacttaccgtacgaccctacggtaacgttaaaggttaacttaaagttccgttaaacctttaaccccgttattaccccggttaacccgggttcccgggggaacccgggggaactacccgggtacgtaaaccgggtaaaaccgtaaaccggtacggttcggtacggtaccgtacggtaccctaacgttacgttcgttaccggttactttaacccg

SEQ ID NO: 180236 - DNA, 542 bp, Homo sapiens
  misc_feature: GYAE6OF02FTC4P.26.37.D04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
tcagagactatactcacgaccggtgctcgatttagtagcatactgttgggtttggggggaactgctcagttaggacccagccggaaccatggaagcccagcgcagcttctcttcctcctgctactctggctcccagataccactggagaaatagtgatgacgcagtctccagccaccctgtctgtgtctccaggggaaanagtcaccctctcctgcagggccagtcagagtgttagtcgcggcttagcctggtaccagcagacacctgggcagactcccaggctcctcatttangctgcatccaccgagggcccactggtactcccagccaggttcagtggcaggtggtctgggacngagttcactctcaccatcagcagcctgcagtctgaagtnttggtgtactaattttattactgtctagtactaatataactacctggcccttccgctctacgtttccgggcggtacgggtaccgtaagggttcgagtaacgtacaaacggtacgtggtcggtaccgttacggacctacctattccg

SEQ ID NO: 180237 - DNA, 540 bp, Homo sapiens
  misc_feature: GYAE6OF02GVUAN.26.37.D04.1.454.CMB.1.raw
  modified_base (203)..(203): a, c, t, g, unknown or other
  misc_feature (203)..(203): n is a, c, g, or t
  modified_base (396)..(396): a, c, t, g, unknown or other
  misc_feature (396)..(396): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacacctgggcagactcccaggctcctcatttatgctgcatccaccagggccactggtactcccagccaggttcagtggcagtgggtctgggacagagttcactctcacatcagcagcctgcagtctagaagtnttgtgtactaattttattactgtacagtacaattataactaccgtggtcccttccgtcttaccgtacgtttccgggacggacgggtacctaagggttcgaagtactaccgaaacggtacgttggtacggctcgacctacgtacg

SEQ ID NO: 180238 - DNA, 689 bp, Homo sapiens
  misc_feature: GYAE6OF02JGJGE.26.37.D04.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (463)..(463): a, c, t, g, unknown or other
  misc_feature (463)..(463): n is a, c, g, or t
tcagagactatactcacgaccggtgctcgatttagtagcatactgttgggtttgggggaacgtgctcagttaggacccagccggaaccatggaagccccagcgcagcttctcttcctcctgctactctggctcccagataccactggagaaatagtgatgacgcagtctccagccaccctgtcctgtgtctccaggggaanagtcaccctctcctgcagggccagtcagagtgttagcgcgcttagcctggtaccagcagacaccgtgggcagacctcccgaggtcctcctactagttttancgctgccagtcccaaccgacgggcccacgttggtaactccccaaggccctaagggttcaaggttcggactagggtgggtctggggaactaggtacgtttccaccttcctccgaacctaatccgaaggccacgtccttggcctaggttccgaggtaaaggtntttcgttgaacctttaagtttttacttaccgtgttacacgttacgtaagttactacgtagttcgtaccgttcgggcccttaccgtacctaacccggtttccggggaacccgtaaggggtacccgtaaccggttaaccggtaaggggtaaccggttaaacgttttaaaaacccgggacgtttaacgggggttcggaaccgttttacccgggtacctaccccgttaag

SEQ ID NO: 180239 - DNA, 531 bp, Homo sapiens
  misc_feature: GYAE6OF02FMLV4.26.37.D04.1.454.CMB.1.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (401)..(401): a, c, t, g, unknown or other
  misc_feature (401)..(401): n is a, c, g, or t
  modified_base (487)..(487): a, c, t, g, unknown or other
  misc_feature (487)..(487): n is a, c, g, or t
  modified_base (526)..(526): a, c, t, g, unknown or other
  misc_feature (526)..(526): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacaccgtgggcagacctcccaggctcctnatttangctgcatccacgagggccacgtggtactccccagccaggttcagtggcaggtgggtctgggacagagttccactctcaccatcagcagcctgcagtctgaagtnttgtgactaattttattactgtcagtactaatattaactacctggccctccgctctacgtttcgggacggtacggaccgtaggttnagtacgtacaaacgtacgtggtcggactcggacctactnttccg

SEQ ID NO: 180240 - DNA, 629 bp, Homo sapiens
  misc_feature: GYAE6OF02GNC0W.26.37.D04.1.454.CMB.1.raw
  modified_base (276)..(276): a, c, t, g, unknown or other
  misc_feature (276)..(276): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
tcagagactatactcacgaccggtgctcgatttagtagcatactgttggggttgggggggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtcgtgggggagcgtggtccagccgtggggggtccctgagactctcctgtgcagcctcgtggattcaccttnagtacctacgccatgcactggatccgcaggctccaggcagggctaggagtgggngctcttanatcatatgataggaataatgaaactattacgcaagacctcggtagaacgggccgtattaccgaccgtctccgaagtacgtaacaacttaccgaaagacgtaccaacggtattcgtttacgtagtaacctaaagtacgtaaaacggtcccgtaggtaacgtaggttacggaagggtaacgtacggggtagttacttaacgtttacgtcggttaggccggtacggtacgggtaccgggttaggtacggggttcgtacccgtaacgtaccgtacggtacgggtccgttacgggg

SEQ ID NO: 180241 - DNA, 589 bp, Homo sapiens
  misc_feature: GYAE6OF02HZVH9.26.37.D04.1.454.CMB.1.raw
  modified_base (201)..(201): a, c, t, g, unknown or other
  misc_feature (201)..(201): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcaggagtgttagtcgcggcttagcctggtaccagcagacaccgtgggcagacctcccgaggcctcctctatttatgctgcactcccaccgagggcccacgtggtactcccgagcctaggttccaggtcggctaggtggggtctaggggacaggtacgttcactctaccaccatcagcacgcctgctagtctagaagtnttgngtacttaatttattactgtacagtactaaattaactaactaccgtacggtcccttaccgtcttaccgttaaccggtttccgggaccggtacgggtaccgtaagggttgaacgtactaccgtaaacgtacgttaggtcggcgttacgacctaccgtgttaccg

SEQ ID NO: 180242 - DNA, 557 bp, Homo sapiens
  misc_feature: GYAE6OF02IADHC.26.37.D04.1.454.CMB.1.raw
  modified_base (201)..(201): a, c, t, g, unknown or other
  misc_feature (201)..(201): n is a, c, g, or t
tcagagactatactcacgaccggtgctcgatttagtagcatactgttgggtttggggggaactgctcagttaggacccagccggaaccatggaagccccagcgcagcttctcttcctctgctactctggctcccagataccactggagaaatagtgatgacgcagtctccagccaccctgtctgtgtctccgaggggaaanagtccaccctctcctgcagggccagtcagagtgttagcgcggcttagcctggtaccagcagacacctgggcagactcccaggctcctcatttatgctgcatccaccagggccactggactcccagcaggtcagtggcagtggtctgggacagagttcactctcacatcagtcagcctgctagtctagaagtatttgtagactaatttattacttgtacagactaaataataatacctggtacctccgcttacaaccgtttcgggacgggtacgggtaaccgtaaggttcgaacgtaagtaccgtaaaaccgtaacgttacgggttacggtaccttacggacctacccgtattccgg

SEQ ID NO: 180243 - DNA, 558 bp, Homo sapiens
  misc_feature: GYAE6OF02GDW4Z.26.37.D04.1.454.CMB.1.raw
  modified_base (399)..(399): a, c, t, g, unknown or other
  misc_feature (399)..(399): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctcccggggaaagagccaccctctcctgcagggccagtcagagtgttggcagcaacttagcctggtaccaacagaaacctggcaggctcccgaggctcttcatctacggtgcactcccaccgagggccactggtactccccgcaggttcaggtggcaggtggtctggggacgagttcactctcaccatcagcacgcctgcagtctagaagtntttgctagtttactactgtcagctaagttaataaacgtcggtaccttcgtagggtacgttcggaccgtaagggaccgtaagggtaggtaaactacgtaaacggactggtaggtacgtacgacctactacgtcttgtcttcacgttcctcccgctactcg

SEQ ID NO: 180244 - DNA, 612 bp, Homo sapiens
  misc_feature: GYAE6OF02JBKRN.26.37.D04.1.454.CMB.1.raw
  modified_base (204)..(204): a, c, t, g, unknown or other
  misc_feature (204)..(204): n is a, c, g, or t
  modified_base (363)..(363): a, c, t, g, unknown or other
  misc_feature (363)..(363): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttagtcgcggtcttagccctggtaccagcagacacctgggcagactcccaggctcctcatttatgctgcatcccaccgagggcccactggtactccccgagcctaggttcaggtgcgagtggggttcnggggaacaggtagttcactcgtccacactcagcacgccctgcgacgttctagaacgtgttaggtagtactaaattttacttacgtcggtactacgactaaattacgttaaacctaccgttcggtacccttccgtacttccgttaaccggtttcgggaccgggtaacgggaacccgttaaaggggttcgaaggtaaccgttaaccgaaaccgttacgttacggtcggtaccttcggtaccctaacgtacg

SEQ ID NO: 180245 - DNA, 685 bp, Homo sapiens
  misc_feature: GYAE6OF02H42UY.26.37.D04.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagcccaccctgtctgtgtctccgaggggaaanagtccaccctctcctgcgagggccagtcagagtgttagcgcggcttagcctggtaccagcagacaccgtgggcacgacctccgaggcctcctctatttangctgccactcccaccgcgggcctagtcgtacctcccgagtccgtaggttcaggtcggacgtaggtcgggtcgtagggactaacggtgtttaccacttcctaccaacgtactaccgaacgccacgtaccgttcgacgtagttaccgtaaggtaaacgttagtttggtacgtaccttttaaagtttacgttacgttacgtacgtaacgtaactaaaagttaacgttaaccttaccgttccggtaccccttaccgtacccttacgttaccggtttaccggggaccgggtacggtaaccggtaacgggttcgaaacggttaccgtaaacccgttaaaccgtacggttcggtacggaccgttaccggaacctacccgttattcccgg

SEQ ID NO: 180246 - DNA, 573 bp, Homo sapiens
  misc_feature: GYAE6OF02HOMM7.26.37.D04.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (383)..(383): a, c, t, g, unknown or other
  misc_feature (383)..(383): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgactcagtctccagccaccctgtctgtgtctccgaggggaaangtcaccctctcctgcagggccagtcagagtgttagcgcggtcttagcctggtaccagcagacacctgggcagacctcccaggctcctcatttangctgcactccaccgagggccacgtggtactcccgagcctaagggttcaggtggcaggtcgggtctgggacaggtagttcactctcacntcagcagcctgcagtctagaagtgttgtagtacttaatttacttacgtgtactagtactaattaataactaccgtcggaccctccgtcttacctacgtttcgggacgggtacgggtaccgttaacgggttgaacggtaactaaccgtaaacgtacgtacggtacggtcctaggaccctaccgtattaccg

SEQ ID NO: 180247 - DNA, 549 bp, Homo sapiens
  misc_feature: GYAE6OF02F2TI3.26.37.D04.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (384)..(384): a, c, t, g, unknown or other
  misc_feature (384)..(384): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggcaaaatagtgctgacgcagtctccagccaccctgtctgcctctccaggggaaangtcaccatctcctgtcgggccgtnagagtattagcagcaacttagcctggcaccagcagaaacctgggcaggctcccaggcctccncatctttgatcgcgtccacagggccacgttcggtttcccagtccgaggttcaggtggcagtgcgtctgcgacagagttcactctccacatcaacncgcctgcagtctagaagtatttgcttagtttattactgtcagctagtactcatgactcggcctctccgtaccgttccggaccgtaacgggacctacggtacgtaggtaacgtaacgttaaaccggacgttaggtacggtacctacggtaccgtacctagttcccg

SEQ ID NO: 180248 - DNA, 577 bp, Homo sapiens
  misc_feature: GYAE6OF02H63RQ.26.37.D04.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagcccaccctgtctgtgtctccgaagggggaaanagtccaccctctcctgcagggccagtcagngtgttagcgcgcttagcctggtaccngcggacaccgtgggcagacctccgaggctcctntatttngctgcctactccaccgacgggccacgtcggtactcccagcctaggttcaggtcggcgtaggttgggtacgtgggacaggtcgttcactctcaccntccgagcacgtcctgcacgtctaggtacgtgttgtntacttaatttactatgtacagactaattataactccgtcgtccctaccgtcttaccgtacgttccgggacgtacgggtaccgtaaggttacgaagtaacgtaacgaaacggtacgtggtacgctacggacctacgtacgtcttacg

SEQ ID NO: 180249 - DNA, 630 bp, Homo sapiens
  misc_feature: GYAE6OF02H0U64.26.37.D04.1.454.CMB.1.raw
  modified_base (204)..(204): a, c, t, g, unknown or other
  misc_feature (204)..(204): n is a, c, g, or t
  modified_base (356)..(356): a, c, t, g, unknown or other
  misc_feature (356)..(356): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctccagataccactggagaaatagtgatgacgcagtctccagccaccctgtctgtgtctaccgaggggaaangtcaccctcgtcctgcagggccaggtcagagtgtagtcgctgcttagcgtggtaccagcagacaccgtgggcagactccgagcctctctattatgactgcatccacgaggcactggtactccagcctaggttcagtaggcaggtgggttcgngggactagactttcacgtctacaaccgtatccaaggcaacggtcccctagggactacgttaccgaggtaaagttagttcggtactacttaaagttttttactaacctggttaccaaaggtactaaagttaactaaaccgtacccgttacggcccctacggtccttacccgttacgtttaccgggacggggttaacgggtaacccgtaagggttacgaacgtaaacgtccgtaaaacggtacgttacgggtacgtacgttacgacccgttaaacc

SEQ ID NO: 180250 - DNA, 618 bp, Homo sapiens
  misc_feature: GYAE6OF02JAHBS.26.37.D04.1.454.CMB.1.raw
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaagagtcaccctctcctgcagggccagtcagagtgttagtcgcggcttagcctggtaccagcagacaccgtgggcagactcccaggcctcctcatttatgctgcactccaccgagggccacgtcggtactcccgagccctaggttccaggtcggcgtaggttgggtcgtgggacaggtacgttcacgtctccaccactacacgtcacgtcctcgacgacgtactggaagtagttaggtggtacttaattttacgttacttacgtacctagactaataacttaaactacccgtacggtcccttccgtccgttaccgttaaccgtttccgggacggggtacggtacccggtaaggttggtaacgtaacgtaaccgaaaccggtaacgttcggtacggtacgtcgaccgtacctagttaccg

SEQ ID NO: 180251 - DNA, 733 bp, Homo sapiens
  misc_feature: GYAE6OF02GCGXG.26.37.D04.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctgctcccagataccactggagaaatagtgatgacgcagtctccagccaccctgtcctgtgtctccgaggggaaancgtcaccctctcctgccgaggccagtcagagtgttagccgcggcttagccgtggtaccagcagtaccacgtggacaggacctcccgtaggccttccgtacctaagttttacncggtcctgacctacctacccaaccgaccgggccctaacggttcggtaccccaccgccgtaccggtacgttcgaggtccggacttgggtcggtccgaggacgtaacggttacgttccaaccgtttccgaacctaaccgtactaccgaccgaccgtaaccggtccgttacgaccgttacggttaccggtaaacgtagttacggtttaccgttaactaacgtttttaaacgtttacgttacgtaccgttaagaacctttaataaacctttaagttaaacccgttccgtacccggttaccttcccgtaccgtttaccggtttaccgggtccggggaaccgtaccggttaaaccggtcggtaagtacctaacccggtaagtaaccgttgggttacacgggtacctaccgtaccgacttaccg

SEQ ID NO: 180252 - DNA, 650 bp, Homo sapiens
  misc_feature: GYAE6OF02HVKEY.26.37.D04.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (472)..(472): a, c, t, g, unknown or other
  misc_feature (472)..(472): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaataggtgatgacgcagtctccagccacctgtctgtgtctcgaggggaaangtcaccctctcctgcagggccagtcagagtgttagtcgcggtcttagccttggtaccagcagaccaccgtgggcagacctcccgaggcctcctcattttancgctgcactcccaccgagggccctacgttcggtaactccccgagcccgtaggtttcaacggtcgggaccgtagggttcggggtacgtacggggaacacgggttacggttccctacttccgtaccaacgtactaccgacgtccaggtccctggacctagtcgtagaggttnttgtacgtaactttaattttacgttactgtacacgtactaaattaactacgttaccgtcggtcctccgtcttaccgtaccggtttacgggaccgggtaacggtaccgtaagggttcgaacgtacgtaacccgaaacggtcgttcgggtacggaccttacggaccgtaccgtattcccg

SEQ ID NO: 180253 - DNA, 633 bp, Homo sapiens
  misc_feature: GYAE6OF02JDCF9.26.37.D04.1.454.CMB.1.raw
  modified_base (340)..(340): a, c, t, g, unknown or other
  misc_feature (340)..(340): n is a, c, g, or t
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagcgtggtttccgtcgttagctctttaagaggtgtccagtgtcaggagcaggtagtggagtcgtgggggaggcgtggtccagccgtggggggtccctgagactctcctgtgcagcctctggattcaccttcacgtaccctacgccatcgcactggactccgccaggcctccgaggcgaaggggctaggnggtgggtgctcttatatcatgtgagttaggaagtaatagaactagttacgcagtaccgtcgtacggaacggccgtacgtcgtaccgtcctaccgacgacgaactaacttaccgaacgtacgacgacgtacttcgttactacgtactaagtacgaacgacgtaccgtagtagtaggttacggaggtaccccccccggtagggttacggttacgtttacgtttaccgttggttacggtccggtacggtacgggttaccggggttaggggtacggggttacggtacccgtaaccgg

SEQ ID NO: 180254 - DNA, 607 bp, Homo sapiens
  misc_feature: GYAE6OF02HC6R0.26.37.D04.1.454.CMB.1.raw
  modified_base (309)..(309): a, c, t, g, unknown or other
  misc_feature (309)..(309): n is a, c, g, or t
  modified_base (381)..(381): a, c, t, g, unknown or other
  misc_feature (381)..(381): n is a, c, g, or t
  modified_base (601)..(601): a, c, t, g, unknown or other
  misc_feature (601)..(601): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaatagtgatgacgcagtctccagccaccctgtctgtgtctccgagggaacagtccaccctctcctgcgacggccagtcagagttgttacgtccgcggcttacgcctacggtaaccagcagaccaccgtgggacaggcctcccgaggcctcctctagtttancgctcgaccactccaccgacgggtcctactcggtactcccgagccgtagtcgagtggctggtggctgggacngtagtcactctcacatcgagcacgcctgctagtactagaatagttgatacttaatttactacgtgtactagacttaaacgtaacttaacgtacccttacggtcccttccgtaccgttacccgtacggtttccgggaaccgggtacggtaaccgtaagggttacggaagtaccgttaaccgaaacgttacgttacggtaccggactaccggacctaccgtnttaccg

SEQ ID NO: 180255 - DNA, 584 bp, Homo sapiens
  misc_feature: GYAE6OF02G91R7.26.37.D04.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttagcgcggtcttagcctggtaccagcagacacctgggcagctccaggctcctntatttangctgcatccacgaggccacgtggtactccccagtccctaggttccaggtcggaccgtagggttcgggtcgtggggacctaggtacgtttcgaccttcctaccgaccatccgagctacgcctacgctagtcgtagaacgtgtttgtacgtacttaatttattacgtgtacagtactaatataactaccgtcggtccctccgtcttaccgtacgtttcgggacggtacggtaccgtaaggttgaacgtacttaacgaacggtacgtcggtacggtactcgacctacctcg

SEQ ID NO: 180256 - DNA, 900 bp, Homo sapiens
  misc_feature: GYAE6OF02HUIVH.26.37.D04.1.454.CMB.1.raw
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
tcagagactatactcacgaccggtgctcgatttagtagcatactgttgggtttgggggaggaactgctcagttaggacccagccggaaccatgggagccccagcgcagcttctcttcctcctgctactctggctcccagataccactggagaaatagtgatgacgcagtctccagccaccctgtctgtgtctccgaggggaaagagtccaccctctccgtgcgacgggccagtcagngtgttagtcgcggcttacgccgttggtaccagcaacgacaccgtgggacacggacctcccgaggccttacccgtactagtttttacncggactggacctacgtcccaaccggtacgggaccctaacgttcgggtaacctcccccgaacggtccccgttaagggtttaccaacgggttcggggaccgtaaggggtttccgggggttacccgttagggggaaccttaagggtaccgttttaccccgaaccgtttcccttacccgaacccgtaacgttaccaaaccggtcccgtaaccgggtcccccgttacgggacccgttaacgggtttcccgtaaaggtaaacggtttacggtttacggttaacggtaacctttaaaacgtttttttacgttaaaccgttcggttaacccgtaaagtaacctttaaaaacgttaactttaaaaacccgtttcccggttaccggggttacccccttacccggttacccctttaacccggttttaaccgggtttacccggggacccgggggttaaaaccgggtaacccgggttaaacggggtttaaccggtaaccggtaaaaccgtttaaacccgggaaaacccgtttaccgggtgggtttaacccgggttaccgtttacccggacccgttaacccccgttacgg

SEQ ID NO: 180257 - DNA, 556 bp, Homo sapiens
  misc_feature: GYAE6OF02GQLRM.26.37.D04.1.454.CMB.1.raw
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagcccaccctgtctgtgtctccgaggggaaangtcaccctctcctgcagggccagtcagagtgttagtcgcggcttagcctggtaccagcagacaccgtgggcagactccaggctcctctattangctgcatccacagggccacgtggtactcccagccaggttcagtgcaggtgggtctgggacagtagttcactctcacctatcagcacgcctgctagtctagaagtagttgtacgtacttaatttatactgtacagtactaaattataactaccgtcgtccctccgtctactaccggttcggacgggtaacggtaaccgtaagggttcgaagtaacgtaacgaaacgtacttcgggtacgacgtcggaccgtacctaacg

SEQ ID NO: 180258 - DNA, 570 bp, Homo sapiens
  misc_feature: GYAE6OF02FU9V2.26.37.D04.1.454.CMB.1.raw
tcagagactatactcacgaccggtgctcgatttagtagcatactgttgggtttgggggggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagccgtggggggtccctgagactctcctgtgcagcctctggattcaccttcagtacctacgccatgcactggatccgccaggcctccaggcaaggggctaggagtgggtggctcttatatcatatgatggaatatgaacattacgcagactccgtagaacgggccgattcaccgtctccagagacaacttaccaagacgcaacgattgtttctgacaaatagaaagcctagagtagttagaaggaccgacgggtgtacttatttcgtgtcggcggacgtacgggtccggggttggtacgggggttcgttaccgaccgttacgacggttcggggtccggttaccggg

SEQ ID NO: 180259 - DNA, 617 bp, Homo sapiens
  misc_feature: GYAE6OF02HK6Y7.26.37.D04.1.454.CMB.1.raw
  modified_base (206)..(206): a, c, t, g, unknown or other
  misc_feature (206)..(206): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggcaaaaatagtgctgacgcagtctccagcccaccctgtctgcctctccgaggggaaangtcaccatcctcctggtcgggccggtcagagtattagcagcaacttagcctggccaccagcaacgaaacctgggcaggcctcccgaggctcctcatctttgatcgccgtccaccgacgggccctacgttcgggtttaccccaggtcccgtaaggttccaggtcggctaggttcgccgttcgtggcgaacgtagtacgttccaccttccgtaccacctaataccaaaccgtacgtccctggacctaggttctaggtaagttacttttcgacttagttttacttacgtgtacacgtactagtatctagtcgtacgtcgcctcgtaccaccgttccgaccgacggtaccacggtacgtaggtaacgtaacgttaaaccggagttcggtacgtacgtacgacctacgtcgttacg

SEQ ID NO: 180260 - DNA, 580 bp, Homo sapiens
  misc_feature: GYAE6OF02JI876.26.37.D04.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
tcagagactatactcacgaccggtgctcgatttagtagcatactgttgggtttgggggtagggaacgtgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctntcctgcagggccagtcagagtgtagtcgcggcttagcctggaccagcagacaccgtgggcagactcccaggcctcctcatttacngtctgcatcccaccgagggccacgtggactccccgagccaggttcagtggcaggtgggtctgggacaggtacttcactctcactntcagcagcctgctagtctagaagtnttgngacttaatttatactgtacagataattataacttaccgtcggtaccctccgtacttaccgtaccgttttaccgggccgggtaacgggtaccgttaaggggttagaacggtaacgttaccgtaaaacgtacgttagggttaccggacgttacggacctaccgtacg

SEQ ID NO: 180261 - DNA, 603 bp, Homo sapiens
  misc_feature: GYAE6OF02ILL9N.26.37.D04.1.454.CMB.1.raw
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
tcagagactatactcacgaccggtgctcgatttagtagcatactgttggggtttggggggaactgctcagttaggacccagccggaaccatggaagccccagcgcagcttctcttcctcctgctactctggctcccagataccactggagaaatagtgatgacgcagtctccagccaccctgtctgtntctcaggggaangtcaccctntcctgcagggccagtcagagtgttaggtcgcggcttagcctggtaccagcagaccaccgtgggcagactccccaggctcctctatttatgctgcactccaccgagggcccacgtggtactcccgagccgtaggttcaggtcggctaggtgggtctgggacaggtacgttcacgtctcgaccatcacgcacgcctgcagttctagaagtagttgtacgtacgtaatttacttacgttgtacgaagtacgtaacttaattaacgttaacccgttacggtcccttccgtaccttacgttaaccgttttcgggaccgggtacgggtaaccgtaagggttcgtaaggtaactaacgtaaacgtaacgtcggtacggtacgtcgacgtacctagttaccg

SEQ ID NO: 180262 - DNA, 634 bp, Homo sapiens
  misc_feature: GYAE6OF02F0YGB.26.37.D04.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (307)..(307): a, c, t, g, unknown or other
  misc_feature (307)..(307): n is a, c, g, or t
  modified_base (388)..(388): a, c, t, g, unknown or other
  misc_feature (388)..(388): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctccagataccactggagaaatagtgatgacgcagtctccagccacctgtctgtgtctccgaggggaaangtcaccctctcctgcagggccagtcagagtgttagcgcggcttagcctggtaccngcagaccactgggcagactccaggcctctcatttangctgcactccacgnggccagtcggtactcccgagccgtaggttcagtcggcaggttcgggcgtgggacagggtacgttccacgtcctacaacctntaccaacgcgtcctggtacctagtccgtaggtaaacgttcttttacgacgtttaagtttacttacgttcgtacgtagtcctaagttactacgtagtacggtacgtcgggtacctacgttccgttaaccgttcgggaacccggtaagggtacccgtaacggtcgttaaccgggaaacgtttaaaccgttaaacgggtaaccgttcgggtaacggtaccgttcggacccgtaccggttatttacccgg

SEQ ID NO: 180263 - DNA, 588 bp, Homo sapiens
  misc_feature: GYAE6OF02G4VSB.26.37.D04.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
  modified_base (428)..(428): a, c, t, g, unknown or other
  misc_feature (428)..(428): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccgaggggaangtccaccctctcctgcagggccagtcagngtgttagcgcggcttagcctggtaccngcagacacctgggcagactcccaggctcctcatttangctgcatcccaccagggccacgtggtactccccagcccgtaggttccaggtggctaggttcgggtctgggacaggtagttccgacttcctacgacctagttccacgccaggtcccgtgaccagtcgtagtaagtntttggtcgtcttaagttttatttacgttcgtacagtactaaattacttaacttacccgtcggtacccttcccgtctttccgtaccgttttcgggccgggtagggtaccgtaagggttcgagtactacgaacgtacgtggtcggctggcctacgtattccg

SEQ ID NO: 180264 - DNA, 594 bp, Homo sapiens
  misc_feature: GYAE6OF02F1FC8.26.37.D04.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgttagtcgcggcttagcctggtaccagcagacacctgggcagactcccaggctcctnatttangctgcatccaccgaggccactggtactcccagccaggttcagtggcagtggtctgggacaggagttcactctacaccatcacgcacgcctgcagtctaggaacgtattcgtgactaattttattacgtgttacaagtactaaattataacttaccgtacggccctttccgcctacttaccgtttaccggggccggtaacggggtacccgaagggttttcggaacggtacgttaaccgaaacggtaacccggtttagggtacggttaccgtaccggtacccgtacccgtagtttacccgg

SEQ ID NO: 180265 - DNA, 710 bp, Homo sapiens
  misc_feature: GYAE6OF02H032W.26.37.D04.1.454.CMB.1.raw
  modified_base (325)..(325): a, c, t, g, unknown or other
  misc_feature (325)..(325): n is a, c, g, or t
tcagagactatactcacgaccggtgctcgatttagtagcatactgttgggtttggggggtaacgtggctcagttaggacccagccggaaccatggaagcccagcgcagcttctcttcctcctgctactctgctccagactaccactggacaaaatagtgctgacgcagtctccacgccctacctcgtctcgcctctaccggaagggaaagagtacaccatctcctggtcgggccgtgagagtattaggcaagctaacgttagccgtagccacctacgacaaacgtaaccgtggggacacggcctaccccaggtcctcctctactntttggatcggacgtcccaaccgtacggccctaacgttcggtttccccacgaccgtaagggttcgacggttcggctaggttacggcggttctagggacccgtaacgtaaggtacgtttccaacgttccttacccaaccggaacttaccaacgaccggtaccgtacgactacggttctaaaggtacggttaattttcggacttaacggtttaacttacttaggtacctagtcaaggttactacttacgtcgtaccgtcggcctctacggtccccgtaagggcccgtaaaggccttaacggaaccgtacgggtaacgttaaaactaaaccgggttaacgttcgggtacgggtacgtacggttacccaaaccgtttacgccttttccgg

SEQ ID NO: 180266 - DNA, 786 bp, Homo sapiens
  misc_feature: GYAE6OF02F3F7K.26.37.D04.1.454.CMB.1.raw
  modified_base (204)..(204): a, c, t, g, unknown or other
  misc_feature (204)..(204): n is a, c, g, or t
tcagagactatactcacgaccggtgctcgatttagtagcatactgggttgggtttgggggaactgctcagttaggacccagccggaaccatggaagccccagcgcagcttctcttcctcctgctactctggctcccagataccactggaagaaatagtgatgacgcagtctccagccaccctgtctgtgtctccgaggggaacncgtcaccctctcctgcacgggccagtcagagtgttagcgcggtcttacgccgtggtaccagcaacgacaccgtgggccagacctcccgaggcctccgtcacttcgttacgatcggtaccgtcccaccggacgggtcctacgttccgggtttccccagtccgtacggttcaaggttcgggacgtagggttcggtcggttacgtacggaccggtacgtaaggtacggtttaccaccgttccctacccgtaaccctaacgttacccaaaccgtaccgtacccgttcgaccgtacggtttacgtaaggtaaacgtttagtttacggtacgttaaccgtttaaagttttaccttttacgttacgttaacgtaactaaccgttaaaactttaaacgttaaacccgtttacccgggtaccgggttaccccgttcccgttaaccgttacccggttaacggttttacccggggacggggttaaccggtacccggttaagggttaacggtaacggtaaccgttaaccggaaaaccggttacgttacggtacggttaccgtacggtaccctaaccgtactttccggtttaccg

SEQ ID NO: 180267 - DNA, 730 bp, Homo sapiens
  misc_feature: GYAE6OF02IMIHU.26.37.D04.1.454.CMB.1.raw
  modified_base (202)..(202): a, c, t, g, unknown or other
  misc_feature (202)..(202): n is a, c, g, or t
tcagagactatactcacgaccggtgctcgatttagtagcatactgttggggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaangtcaccctctcctgcagggccagtcagagtgttagtcgcggcttagcctggtaccagcagacaccgtgggacacgacctcccgaggtcctccgtctaatttagcgcgttgcctacttcccgaaccgacgggtccctacgtcggtactccccgagtcccgtaggttcaggtggctacgggtcgggtctagggactaggtacgttccactctaccgacctagtcgacgcctacgtccgtacgtaccgtacgttacgtacggtaaacgttagtttacggtacgtaacgttttaaattttacgtttacctacggttaccgtaacgtaacttaaacgttaacgtttaaaccgttacccgttccgggtaacccttcccgttaaccgttaccgttaaccggttttacgggggacccgggtaacgggttaaccgttaacgggggtttcggtaaacgttaaccgttaaccgtaaaacgggttaccgttacggggttaccggtaccggttacggaccctaaccggtacgtttacccgg

SEQ ID NO: 180268 - DNA, 627 bp, Homo sapiens
  misc_feature: GYAE6OF02FNTNI.26.37.D04.1.454.CMB.1.raw
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggtttcctcgttgctcttttaagaggtgtccagtgtcaggagcaggtgtggagtcgtgggggaggcgtggtccagccgtggggggtccctgacgactcgtcctgtgcacgtcctcgtggtacttccacctttcacgttaccctacgccctatggccaacgtggactccggccacggcctccgaggcgaaggggctaggaggtggggtcgcttacgttatactctaatatgagtaggaaagtaactagaaactattaacggcaagtaccgtcggtacggaacgggctacgttcgacccgtctccgaagacacgtaacttacaacgagaccacgtattgttctgtactaaagtcgaacgacgtaccgtaggagtagttacgaggtacggaacgggtgttacttacgtttacgtggttcggtaccggtcggtacgggttaccgggtggggtaacggggttcgtacccgtaacgg

SEQ ID NO: 180269 - DNA, 551 bp, Homo sapiens
  misc_feature: GYAE6OF02GDXPW.26.37.D04.1.454.CMB.1.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
tcagagactatactcacgaccggtgctcgatttagtagcatactgttgggtttgggggggaactgctcagttaggacccagccggaaccatggaagccccagcgcagcttctcttcctcctgctactctggctcccagataccactggagaaatagtgatgacgcagtctccagccaccctgtctgcctctccaggggaaanagtcaccatctcctgtcgggccgtcagagtattagcagcaacttagcctggcaccagcagaacctggcaggctcccaggctcctcatctttgatgctccaccgagggccactggttcccagccaggttcagtggcagtgcgtctgcgacagtacgttcactctccaaccntaccaacagcctagcagtctgaagtattgtagtactaatttacttacgtntcatanaaattactaatacctggccctccgtcttactacgtttccgggcggaacggggacctaagggttgaagtaactaccgtaaacggtaacttgggtacggtccgtagtcccaactacgtcttacgg

SEQ ID NO: 180270 - DNA, 569 bp, Homo sapiens
  misc_feature: GYAE6OF02GMA2E.26.37.D04.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggtcttagcctggtaccagcagacacctgggcagactcccaggcctcctctatttangctgcatccaccagggccacgtggtactcccagtccaggttcaggtggctaggtgggtctgggacaggacgttcacgtctcaccatcagcagcctgcagtctagaagtnttggtgacttaatttattacttgtcacgtcagttactactagttcgtacgttcgggacccgtcttccgacccgtttacgggaccgtaacgggtaccgaacggtacggtacggtaagtaaccgttaaacggacgttaggtacggtccgtacggacctaaccg

SEQ ID NO: 180271 - DNA, 596 bp, Homo sapiens
  misc_feature: GYAE6OF02HGVLM.26.37.D04.1.454.CMB.1.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaangtcaccctctcctgcagggccagtcagagtgttagtcgcggcttagcctggtaccagcagacnccgtgggcagactcccgaggcctcctntatttancgctcgctactcccaccgaggcccagtggtactcccagcctaggttcaggtcgctaggtgggtctgggactaggagtttcacttctccaacctntacacgtcacgtccgtagctacgtcgtagtaacgtgttgtacgtacttaattttactacgttcgtacaggtctagttatactagcgtaacgtcggtccgtcttaccgtacccgtcggaaccggtaacgggaacctaccggtagtacgggtaacgttaaacggttaaacgtacggttacggtacggtaccgtagacccgtacg

SEQ ID NO: 180272 - DNA, 645 bp, Homo sapiens
  misc_feature: GYAE6OF02HKQH1.26.37.D04.1.454.CMB.1.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (409)..(409): a, c, t, g, unknown or other
  misc_feature (409)..(409): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccacctgtctgtcgtctcgagggaangtccaccctctccgtgcgacgggccagtcagagtgttagcgcggtcttacgccttggtaccagacacgactaccgtgggacacgacctcccgaggtcctcctntatttagcgtcgtacgctactcccgacgacgggcctacgtaggtacctccgagtccgtaggttcacggtcgcgtaggttcggtacgtaggactacgtcgttaccncgtcctactaacgtctacgacgtcgaacgtccgtacgacgtacgtactacggtaagttcgttaggtacgtactttaagttttactacgtgtacgaacgttataaacttagttaacctaccggtcgtacccttccgtacttacccggttacgtttccggggacggtaacgggttacgttaaggtacgtactaacgtaaccgaacggtcgtacggttacgacgtacgaccctagttcg

SEQ ID NO: 180273 - DNA, 572 bp, Homo sapiens
  misc_feature: GYAE6OF02G685E.26.37.D04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtctccaggggaaanagtcaccctntcctgcagggccagtcagagtgttagcgcggcttagcctggtaccagcagacactgggcagactcccgaggctcctcatttngctgcatccacgagggccactggtacncccagtccaggttcagtgcagtgggtctgggacagagttcactctcaccatcagcagcctgctagtctagaagtattgtgtactaatttattacgtgtcagtacaattaataacgttaccgtcggtcccttccgtacttcgtaccgttttcgggaccgggtacgggtaaccggtaacgggtttggaagttaacgtaaccgaaaccgtaacgttacgggttacggtaccgttacggacccgtaccgtacttccg

SEQ ID NO: 180274 - DNA, 617 bp, Homo sapiens
  misc_feature: GYAE6OF02IRT3O.26.37.D04.1.454.CMB.1.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
  modified_base (418)..(418): a, c, t, g, unknown or other
  misc_feature (418)..(418): n is a, c, g, or t
  modified_base (444)..(444): a, c, t, g, unknown or other
  misc_feature (444)..(444): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtccaccctctcctgcgagggccaggtcagagtgttagcgcggtcttagcctggtaccagcagaccaccgtgggacacgacctcccgaggcctcctactattttangtctgcactcccaaccgngggccagtggtactcccgacgccgtaggtcaggtggacagggtcggtacgtgggacaggtacgttacactctccaacactcacgacacgtcngacgtagtcgtagtaagttagttgtntacttaatttacttacgttctacgagtaactaaattaacttaacgtccgttacgtcccgtaccgtcttaccgttcgttacgggaccggggtaggtaacccggtaggtcggtaacgtacgtaaccgtaaacggttacgtcggttacggtaccttacggacctaccgtgttaccg

SEQ ID NO: 180275 - DNA, 870 bp, Homo sapiens
  misc_feature: GYAE6OF02I3PBT.26.37.D04.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagactaccactgganaaatagtgatgacgcagtctccagccacctgtctgtcgtctcgagggaancgtaccacccttctcgtgcgacggcctagtcagtagtgttaggtcgcggtacttacggcccgttagggtaaccctaggacctaacggtacccgtaaccccggttcgggaccaacggtaacccgtcccccgtaacgggtccttaccccgtacttaacgttttaacgtcggtccttacggacctaccgtacccgaacccgtaaccggggaccctacgttaccggtaccttacccgaacggtacccgtacgggttacgacggtacggacggttagggtcggttacggaggacctaggtacttcctacgttcctaccgacctataccgaaaccgtaccgtaccgtacgtaccgtacggttacgttacgtaaagttacgttacgttacgtaaccgtttaaagttttagtttaacgttaccgggtaataacggtaaacttaaacggttaaaccgttaaaccgttacccgtaccgggtaacccgttaccccgttaaccggtttacccggttaacccgggttttaccgggggtaaccgggtaaccggggtttaacgtaaccgggtttaacggaacggttaaccggttaaaaccgaaaccgtttacgggtacggtttaacccgggtacccggttaacccggtaaccccgttaaccgttaaccgttttcccggttaacccg

SEQ ID NO: 180276 - DNA, 879 bp, Homo sapiens
  misc_feature: GYAE6OF02FKDLA.26.37.D04.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (313)..(313): a, c, t, g, unknown or other
  misc_feature (313)..(313): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaaancgtccaccctctccngcagggccagtcagagtgttagtcgcggtcttacgccgtggtacccagccaagaccaccgtgggcagacctcccgaggccttccgtctatttancgtctcgaccactcccgacgacgggtccaacgtcggtacctccccgagtccctaaggtttcgaggttcgggactaggggttcggggtcgttacgggggaaccttaagggtccgtttaccaccgttccgtacccgtaacccgtagttaaccgaacgccgtaaccgtcccgttacgtaccgtacgttacggttaaggtaaacggttagtttcgggttaacggtaacttttaaaacgtttttaacctttaccggtttaccggttaccgttaaacgaaaccgtttaaaagtttaaccgtttaaaacccgtttaacccgggtttaccggtaacccccgttttacccccggttacccgtttaacccggttttaaccccggggttttttaacccggggggaaccccgggggtttaaaccgggggttaaacccggttttaaaaaccggggtttacggttaaaacgggttaaacccggtttaaacccggaaaaaacccgggttttaaccgggttaccgggtttaccgggtaacccggtttttaccccgggaacccgttaacccgtttaccccggg

SEQ ID NO: 180277 - DNA, 697 bp, Homo sapiens
  misc_feature: GYAE6OF02HRTZB.26.37.D04.1.454.CMB.1.raw
  modified_base (150)..(150): a, c, t, g, unknown or other
  misc_feature (150)..(150): n is a, c, g, or t
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (482)..(482): a, c, t, g, unknown or other
  misc_feature (482)..(482): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctccagataccactgganaaatgtgatgacgcagtctccagcccaccctgtctgtcgtctccgagggggaaangtccaccctctcctgcagggccagtcagagtgttagcgcggtcttagcctggtaccagcagacaccgtgggcagacctcccgaggcctcctactatttcngtctacgcctactccccgaaccgcggggccctacggtcgggttacctaccccgaggtacccgtagggttccagggtcggactaggggtcgggtcgtggggaacctaggtactttccgaaccttcgtaccaaactacgtcgaacgccacgccgtaggacctaggttacaggtaaagtnttacgggttactacttaaatttttacgtaacgtgtaccgtaagtaaccgttaaattaacgttaaccgttacccgttccggccctttccggtacctttaccggttaccgtttacccggggacgggtaccggggtaaaccgttaggggttacgtaaccggtaacgttaaacccgaaacgggttacgttcgggaaccggcgttacgacccgtacttcg

SEQ ID NO: 180278 - DNA, 643 bp, Homo sapiens
  misc_feature: GYAE6OF02GAGER.26.37.D04.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaanagtcaccctctcctgcagggccagtcagagtgttagcgcggcttagcctggtaccagcagacgacctgggcagactcccaggctcctctatttangctgcatccacagggccacgtcggtactcccgagtccaggttcagtcggcaggtggtcgtgggactaggacgttcaccgtctaccgaccactacgaacacgtccgtgactagtacgtagtaagtacgttttagtaccgttaagttttacttaccgttagttacgtagtacgtaagttaaacttaaaaacgtcgggtacccgtaccgggtacggttaccgtttaccggtaacccgtaaacgggtaaccgtaagggtacggtaaactaaccggaaacgtaacgtacggttacggtaccgtacgtacctaccgtacgttaccgttacgttaccttacgtacttaccccg

SEQ ID NO: 180279 - DNA, 780 bp, Homo sapiens
  misc_feature: GYAE6OF02G8H7K.26.37.D04.1.454.CMB.1.raw
  modified_base (306)..(306): a, c, t, g, unknown or other
  misc_feature (306)..(306): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagcccaccctgtctgtgtctccgaggggaaagagtccaccctctcctgcagggccagtcagagtgtagcgcggcttagcctggaccagcagaccacgtgggacagaccctcccaggcctccctactattttangcttgaccacttccccgaaccggacgggccctacgttagggttacctaccccgaaggccccgtaagggtttccagggttcggcgtaggggttcggggtacgtacgggggactaggtaccggtttccaaccgttcctaacccgtaccaacttccgaccggacctaaccggtcccttaggtaccctacggttacgtaaggtaaacggttcgttaggttacggtacttttaaattttacgttacgttaggtaacgtacttaactaaacgttaactttaaaccgttacccgttaccgggttaccccctttccgggtaccctttcccgggtttaaccgggttttacccggggaccggggttaaacggggtaaccccggtttaaggggtttaacggaaaccgggttaccgttaaaacccggaaaccggttaacggttcggggttaaccggacccggttaaggtaccccgtaaccttccgg

SEQ ID NO: 180280 - DNA, 718 bp, Homo sapiens
  misc_feature: GYAE6OF02IO35D.26.37.D04.1.454.CMB.1.raw
  modified_base (203)..(203): a, c, t, g, unknown or other
  misc_feature (203)..(203): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaaggggaaangtccaccctctcctgcagggccagtcagtagtgttacgtcggcggtcttagccttcggtacagcgagaccgaccgtgggacagtacctcccgaaggtcctccgtactattttagcgtctagcactacccaaccgtacgggcctacgtacggtacctcccgagtaccgtaggttcagtcggcgtaggtgggtcgtagggaactaggtacgttacacttctacccaacgactacgacgacgtacgtcctacgacgtacggttactaaggaagtttacgttaggttaacgttactttaaacgttttacgtttacgtgtaacaactaaacgttaaattaacgttaaacgtacccgttccggtacccgttaccgtccgttaacccgtttacgggtttacccgggaacggggttaaccggggtaccgttaaaggggttaccgtaacggtaaccgtaaaccggtaaaaccgttacgttacgggttaccggaccgtaccggtaaccgtaccgtagtttacccg

SEQ ID NO: 180281 - DNA, 693 bp, Homo sapiens
  misc_feature: GYAE6OF02H6RLP.26.37.D04.1.454.CMB.1.raw
  modified_base (217)..(217): a, c, t, g, unknown or other
  misc_feature (217)..(217): n is a, c, g, or t
tcagagactatactcacgaccggtgctcgatttagtagcatactggttgggtttgggggaggaactgcgtcagttaggacccagccggaacatggaaggccccagcgcagcttctcttcctcctgctactctggcctcccagataccactgggagaaaatagtagatcgacgcagtctccaagccaccctgtcctagtcgtctaccaggggaaaacncgtacaccctctccgtgccaggggcctaaggtccagtaggttcgttacgtcgacggtctttacggccttaggtaccaggccaagaccaccgtgggactacggacctccgaaggcctctcgacttttacgcgcctgactactccgaccgtagggcctacgtcggactcccaggcctaggttcacgttggctaggtacgggtctacgggatacgtagtttccacgttcacgaacctagtacgacgccgtagcccgttagacgtacgtctaaggtaatcgttaggtcctagttaaattttattacgtattaccgaagtactaaaacttagtaaacgtaccgtacggtcccgttaaccggactttaaccttaaccggtttccgggtacgggaacgggtaaaccgtaagggtttaaccggaacgtaacttaaccgaaaacgttcgtacggttacggaccgtacggttaccaaccgttaacg

SEQ ID NO: 180282 - DNA, 686 bp, Homo sapiens
  misc_feature: GYAE6OF02HDM90.26.37.D04.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtntctccgaggggaanagtcaccctctcctgcagggccagtcagagtgttagtcgcggtcttagcctggtaccagcagacaccgtgggcagacctcccaggaccttcctctactttangtcctgccacgtaccaaccgacggggacctacgttgggtacctccccgaggtccgtaggggttccaggttcgggactagggttggggttcctcggggaactaggtacgtttacccgaaccgttccgttaccctaaccgtacgtaccgtacggacccgtacgtacccggttcgaccgtagttccgtaagaacggttagtttggttaacgtacgtttaattttaactttaacgttacgtacgtagtaacttaaagttaacttaatacccgttcgtaccgttccgtaccttaccgttaccgtttaccgggaccgggtaacgggaacgtaaggttggaacgtaactaacgtaaacgacggttgtcggtactcgtaccgtactacg

SEQ ID NO: 180283 - DNA, 751 bp, Homo sapiens
  misc_feature: GYAE6OF02J2I4J.26.37.D04.1.454.CMB.1.raw
  modified_base (329)..(329): a, c, t, g, unknown or other
  misc_feature (329)..(329): n is a, c, g, or t
tcagagactatactcacgaccggtgctcgatttagtagcatactgttgggtttgggggaggaactgctcagttaggaccagccggaaccatggaagccccagcgcagcttctcttcctcctgctactctggctcccagataccactggagaaatagtgatgacgcagtctccagccaccctgtctgtgtctccgaggggaagtacgtccaccctctccctggcgacgggccaggtcaggtagtggttacgtcgacggtcttacgccgttcggtaccagccagaccgtcgtggggcacggtacctcccgacggcctcctactaattttancgtcgtgcctactcccgaacgacggccacgtcggtacctcccgacgccggtacggttacgagggttcgacgtaggttcggggtacgtacggaacgtaggtacgttcaccgttcgtacgtaccctacgtaccgtacgccgtacgtcccgtacggtcgttacgtaccggtaggtaaacggttacgtttacggacggtttactttaaacgttttacgtttccgtagttaccggaagttacgtaaactttaacgtttaaccgttaaccggtccggttaacccgttccgttaccgttaccgggttacccggtttacggggtaccgggaacgggttaacccggttaacggggttacgaacgttaaccggtaaaccgtaacggttaaccgtttcgggggaccttaccggtaacttcccgacgtttaccg

SEQ ID NO: 180284 - DNA, 681 bp, Homo sapiens
  misc_feature: GYAE6OF02IDZQI.26.37.D04.1.454.CMB.1.raw
  modified_base (202)..(202): a, c, t, g, unknown or other
  misc_feature (202)..(202): n is a, c, g, or t
tcagagactatactcacgaccggtgctcgatttagtagcatactgttgggtttggggggaactgctcagttaggacccagccggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagtagtgttagcgcggtcttagcctggtaccagcagaccaccgtgggcagacctcccgaggcctcctctatttacgtcgctcgcactcccaccgacgggcctacgttggtacctcccgagccgtaggttcaggtggctagggtcgggtcgtagggtacaggtacgttccaccttccgtacaacctagtcacgcgtacgtcccgtagtccgtacgttacgtaaggtaacgttagtttcgtagttactttaagttttacgttaccgttagtacgagtaactaattaaacttaacgttacccgtcggttcccttcccgtaccttacccggtttaccgtttccggggaacgggttaaccgggtaaccggttaacgggttacggtaacgttaaccgtaaaccggtaaaccgtaacgttcgggtaacggtcgttaccggacctaacccgtacgtttaccg

SEQ ID NO: 180285 - DNA, 732 bp, Homo sapiens
  misc_feature: GYAE6OF02I64BT.26.37.D04.1.454.CMB.1.raw
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
  modified_base (726)..(726): a, c, t, g, unknown or other
  misc_feature (726)..(726): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggcctcccagataccactgganaaattagtgatgacgcagtcctccacgccaccctgtctgtgtctccgaggggtaaancgtccacccttctctcgacgcggctagtcaggtagttggttacgtccggacggtcttacggccgttaggtaaccacggtacgacgacctacggtcggggactacggaccctccgacggtccttccttaactagtttactcggtcgtacgcctacgtaccccgaccggtacgacctagttcggtacctacccgagtccgttaggttacgacgtcggtacgtaccgggttagggttcgtaacgggacgttaaccgggtactaccgtaaccctcccgtactaacccgacgttaccgaacgccgtacggtaccgtcgtaaccgtgttacccgtaagttaacgttcgttacggttagttaacttaagttttccttaacgtcgttaacgaacgtactaaaggttacccttaaagcccggttaccgtcccctaagttcccgtaccgttacgggtccggacggtacggtaccgtaggtacctaagaaccgtaacgtaacggtctacggtcggtacctacgacctntaaccg

SEQ ID NO: 180286 - DNA, 854 bp, Homo sapiens
  misc_feature: GYAE6OF02JQRQL.26.37.D04.1.454.CMB.1.raw
  modified_base (165)..(165): a, c, t, g, unknown or other
  misc_feature (165)..(165): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
tcagagactatactcacgaccggtgctcgatttagtagcatactgttgggtttgggggaactgctcagttaggacccagccggaacatggaagccccagcgcagcttctcttcctcctgctactctggctcccagactaccacgtggagaaatgtagatcgacgnagtcctccagccctaccctgtctagtcgtctaccggaggggtaaaancgtaccacccgttcctaccnggacacgggtccctagtcgagtacgttgttaacgtccggacgtcttaacgccgttaggaaccctagcgtaacgaccgtaccgaggtcaacgccgtaccgacggcctacctcgtatttacgcgctcgcactccaccgnggaccacgtcggtactaccnggaccgtacggttcacggttcggaccgtacgggtcgggttactacggggaacgttcggttaacgttccccgacgtttacccgtaccttaaaccgaccgttaccgtaaccgggtacaccggttaccgtaccgaacggtttccgtaaccggtagtaaccggttacgttaccggttaacttaacgttttaaacgttttaccgttaccgttaacgtaacgttacgtaaacgttaacctttaacggttaaccgttaccgtttaccgggacccgttttaccgaaaccgtttccccggttaaaccgggttttaccgggaaaccggggtttaccggaaccgggttttaacgggtacccggttaaaacggtttaacccggtaaaacccgggtttaaaccccggtaaggtttacccggtaacggggttacccctaacccgtttaaaccggttacccggttaacccggtttaccgg

SEQ ID NO: 180287 - DNA, 777 bp, Homo sapiens
  misc_feature: GYAE6OF02FTUHE.26.37.D04.1.454.CMB.1.raw
  modified_base (202)..(202): a, c, t, g, unknown or other
  misc_feature (202)..(202): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatggacgcagtctccagccacctgtctgtcgtctccgaagggaaangtccaccgtctccgtgcgacgggccagtcagagttgttacgtcgcggtcttacgcctggtaccagccagaccaccgtggctacgcctccaggctccctagtatttgcgctcgcctactcccgaccgacgggcccacgttcggtacctcccgagtccgtaggttcgaggtgcgtagggttgggtccgtagggactaaggtacgtttccaacgttcccgactaacccgtagtaccgtacgaccgtaccggtccgtacgtaccgttacgtacgttaaggtaaacgttcggttacgttacggttaactttaaacgttttacttaaccgttcgttaccgtaacgggtaaccttaaagtttaaaccgtttaaaccgttaacccgggtttacccggttaccccgttaacccggtttacccgtttaaccgtttaaccgggtttaccggggtaccccggggttaacggggttaacccggttaaaggggttccgtaaaggttaaaccgttaacccggtaaaacggttaaccgggttcgggttaacggttaccggttaaccggaccgttaccgacgttttacccgg

SEQ ID NO: 180288 - DNA, 659 bp, Homo sapiens
  misc_feature: GYAE6OF02F3PS4.26.37.D04.1.454.CMB.1.raw
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctctttagaggtgtccagtgtcaggagcaggtagtggagtcgtgggggaggcggtggtccaggccgtggggggtccctggacgactctcctgtgcacgcctcgtggacttcacctttcacgtaccctacgcctagtgctactcggactcccgaccgacggcctccgaggcgagggctaggagtcgggngctnttacatcatctagataggtaagtaactagaactagttaacgctacgtaacgtcggtaggaacgggtaccagtttaccgaccgttcacccaggtaaccaacgtaacttacccggaaagtaccgacgtaacgttactggttttccctaggaaaccctaaagtaccgaaacggtacggacgtaaccgggtattaacgggtacgaccggtacgggacggtttcggtacttttacgtttgtccgggttagaccgggtacggacgggtttccgggtaggggtacgggttccaccgttaaccgg

SEQ ID NO: 180289 - DNA, 650 bp, Homo sapiens
  misc_feature: GYAE6OF02IG7YT.26.37.D04.1.454.CMB.1.raw
  modified_base (204)..(204): a, c, t, g, unknown or other
  misc_feature (204)..(204): n is a, c, g, or t
  modified_base (387)..(387): a, c, t, g, unknown or other
  misc_feature (387)..(387): n is a, c, g, or t
  modified_base (517)..(517): a, c, t, g, unknown or other
  misc_feature (517)..(517): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagcccacctgtctgtgtctccgaggggaaangtccaccctctcctgcagggccagtcagagttgttacgcgcgtcttagcctaggtaccagcagacaccgtgggcagactccaggcctcctcattctttgatcgccgtccaccgacgggccctacgttcggttcccagtccgtacggtttcaggtcggactaggtcgccgttctcggcgaacgnggtacgttccactccgtacctaccctaatacccaaccgtacgcccgttacgaccgtaggttccgtaagtaagttacgtttttcgacgtttaagtttttacttacgttgtaccacgtactagttacgttanaacgtcgtacgtcggcccgttactaccgtacccgttacgggaccggtaacgggccctaacgggtaacgtacggaaaggtaaccgttaaaccggtaagttcggtaacggtccgtacggacctaccgtagttccg

SEQ ID NO: 180290 - DNA, 756 bp, Homo sapiens
  misc_feature: GYAE6OF02J2L4V.26.37.D04.1.454.CMB.1.raw
  modified_base (151)..(151): a, c, t, g, unknown or other
  misc_feature (151)..(151): n is a, c, g, or t
  modified_base (206)..(206): a, c, t, g, unknown or other
  misc_feature (206)..(206): n is a, c, g, or t
  modified_base (334)..(334): a, c, t, g, unknown or other
  misc_feature (334)..(334): n is a, c, g, or t
  modified_base (415)..(415): a, c, t, g, unknown or other
  misc_feature (415)..(415): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactgganaaatagtgatgacgcagtctccagccacccttgtctgtgtctccgaggggtaaangtcaccctctcctgcaggccagtcagagtgttagtcgcggtcttagcctaggtaccagcagacaccgtggcagacctccaggtcctcctcgtatttagcgctgcactccacgacggcctactggtacnccgacgccgtaggtcacgtggcgaggttcggtcgtaggacgagtacgttcacgtccacaccgtactcgacgcgacgtccgngacctacgttcgtaagtacgttaggttacgttacgtaacgtttaacgttttacgttacgttaagtccgtaaaggtaccttaaaagttaacgttaaacccgttacccggggttaacccgttccccgttacggttaaccccgttacccggtttaaccggttaccgggggtacccgggttaaaaccggttaccgggggttaaaacccggttaaccggggtaaccggtttaaaaccggttaaaaccccggggttaaaaacccggtttaccccgggggtttaaacggttacccggggtaacccggttttaacggtaaccccccgttaaccggtttttaaccccggg

SEQ ID NO: 180291 - DNA, 587 bp, Homo sapiens
  misc_feature: GYAE6OF02F17UR.26.37.D04.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (443)..(443): a, c, t, g, unknown or other
  misc_feature (443)..(443): n is a, c, g, or t
tcagagactatactcacgaccggtgctcgatttagtagcatactgttgggtttgggggaactgctcagttaggacccagccggaaccatggaagccccagcgcagcttctcttcctcctgctactctggctcccagataccactggagaaatagtgatgacgcagtctccagccaccctgtctgtgtcctccgaggggaaanagtcaccctctcctgcagggccagtcagagtgttagtcgcggcttagcctggtaccagcagacaccgtgggcagacctcccgaggctcctctatttancgntcgctactcccaaccgagggccaacgttggtaactcccgaaggtccctaaggttcaaggtcggacgtaggtcgggtacctgggactaggacgtttaccactctaccaccatacagtcacgctgacctagtcgagaacgtnttgacgtaacttattttactactgtacagactaaagtatactacgtcgcctccgtctactacgttacgggcggtacgggactaaggttcgaagtactaaccgaaacgttaacgttggtacggcgttacgacctaccgtacttcg

SEQ ID NO: 180292 - DNA, 735 bp, Homo sapiens
  misc_feature: GYAE6OF02GVLXL.26.37.D04.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (611)..(611): a, c, t, g, unknown or other
  misc_feature (611)..(611): n is a, c, g, or t
tcagagactatactcacgaccggtgctcgatttagtagcatactgttggggtttgggggaggaactgctcagttaggacccagccggaaccatggaagccccagcgcagcttctcttcctcctgctactctggctcccagataccactgganaaatgtgatgacgcagtctccagcccacctgtctgtcgctccgaaggggaaangtccaccctctcngcgagggccagtcagngtgttagcgnggtacttacgctggtaccagcacgacaccgtgggacacgacctcccgagggtcctaccgtactacgtttaactcgacgtcgacctaactaccccgtaaccgacggggtaccctaacggttacggtaaccctccccgaacggtacccgtacggggtttacaagggttcgggacgtacgggtcgggttaccgtagggggaacctaggttacggtttacaaccgttccgtaaccgtaccgaacttcgaaacgccgtaacggtcccctaaggtactacgggttacctaagggaaacgttagttcggttacgtactttaactttaattacgttagtaacctacgaattaaacgttaactaaacgttacccgnggttacccgttcccgactttaccgtacgtttaccggaccgggtaacggtaaccgtacgggttaagagttaacgaaccgtaaacggtaacgtgggttaccggtcgtacggaccctaccgttaacg

SEQ ID NO: 180293 - DNA, 825 bp, Homo sapiens
  misc_feature: GYAE6OF02IH3JY.26.37.D04.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagagactatactcacgaccggtgctcgatttagtagcatactgttgggtttggggggaactgctcagtttaggacccagccggaaccatggaagccccagcgcagcttctcttcctctgctactctggctcccagataccactggagaaatagtgatggacgcagtctccagccacctgtctgtgtctcgaggggaaangtcacccttctcctgcaggccagtcngagttgttacgtcgcgtctttagcctggtaaccaggcagaccaccgtgggcacgacctcccgaggtccttccctactaatttttagtcgtccgtacggtaccacgtacccaaccgaggggtacccacggttcggttaacctaccccgacgtacccggttaggttaccgaggttcgggaccgtggttggggtaccgtaggggaaccaggttacgttacaccttcgtaccgaccgtaataccgacggacgtacgtccgttcgacgtaggttacgtaacggtaacggttagtttacgttacgttaaaccgttttaacgtttttattttaaccgttacggttaaccctaagggtaaacctttaaaactttaaacgtttaaaaccgtttcccccggttaaccggtttacccccgttaacccggtttccccgttaacccggtttaacccgggtttttacccggggggaacggggtttaaccgggggtaaacccggtttaagggtttaccgggtaaacggtaaaccgttaacccggttaaaaacgtacccgggtttgtaaccggggtacccttacgggtaaccttaccccggttatttaccccgg

SEQ ID NO: 180294 - DNA, 722 bp, Homo sapiens
  misc_feature: GYAE6OF02IBJPG.26.37.D04.1.454.CMB.1.raw
  modified_base (202)..(202): a, c, t, g, unknown or other
  misc_feature (202)..(202): n is a, c, g, or t
  modified_base (344)..(344): a, c, t, g, unknown or other
  misc_feature (344)..(344): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactaggagaaatagtgatgacgcagtctccagccacctgtctgtgtcctcgagggaangacacctctcctgcacgggccagtcagacgtgttagcgcggcttacgccgtgtaccagctacgacaccgtgggcacgcctaccgaggcctcgtactatttacgtgcttagctactaccaccggacggaccacgttggtaccncccgacgtaccgtaggttaccgagggtacggcgttaagggtcgggttacgtacggggactaaggacgttacctaccgtacctaccgtaacctacgtactcggtacaccggtacccgtagtaccgtaggttacgtaacggtaaacgttcggttagttacgtaccgttaaacgttttagtttaccgttacggtacgactaagttaaacttaacttaaacggttcccttacggtacccgtttaaccgtaccgtttaccgtttaccggggtttacggacccggggttaaccgggtacgttaaacggggtagtaacggtaacggaaaccgttaaacccggttacgttacgggttacgtaccggtacgtaccgtaacctaccgg

SEQ ID NO: 180295 - DNA, 648 bp, Homo sapiens
  misc_feature: GYAE6OF02FIDNM.26.37.D04.1.454.CMB.1.raw
  modified_base (322)..(322): a, c, t, g, unknown or other
  misc_feature (322)..(322): n is a, c, g, or t
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtcgtgggggaggcgtggtccagccgtggggggtccctgagactctcctgtgcagcctctggacttccacctttcacgtaccctacgccatcgcactggactccgccagccncgaggcgaaggggctaggaggtgggtgctcttatatcatatgagtaggtaaagtatagaactagttacgacacgacctccggtaggaacgggtccgtacttccacccgttcctacccgaaggtacgaacctaacttaccgaaacgacgaccacgtagtttcgtttacgtacgtaactaaagtacgaaaccgacgtacccgtaggaacgtaggttacggaagggtacggacggggttacgtttacgttacttttacgtcggttcggaccggtacgggtacggggttacccggggtaggggtacgggggttaccgtacccgtaaccgg

SEQ ID NO: 180296 - DNA, 712 bp, Homo sapiens
  misc_feature: GYAE6OF02FMTLQ.26.37.D04.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccgaggggaanagtccaccctctccngcagggcccagtcagtagttgttagtccgtcggctttagccgttaggtaccaggccagacctaccgtggggacctaagtaccctccccgaaggtcccttcccgtacttaagttttagcgtccgtgaccctactaccccggacgtacgggaccctagttacgggtactacccccggaggtaccgttacggtttcgacgggttcgggactacggggttcgggtcggtacggggaacaggttacggtttacccacttcccgtacccaactcgtacgaacgtcctaccggtccgtacggacctaggtaccgtaaggtaagttgtttcgtagttaacgttaattttactacgttagtactaacgtacttaaactacttaacgttccgtaccggttccctccggtccttaccgtacgttccggggacgggtaacggtaccggtaacggttacgaagtaccgtaacgtaacgtacgtcggtacgtcgtacgtccgattacg

SEQ ID NO: 180297 - DNA, 703 bp, Homo sapiens
  misc_feature: GYAE6OF02H9ATQ.26.37.D04.1.454.CMB.1.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
tcagagactatactcacgaccggtgctcgatttagtagcatactgttgggtttggggggaactgctcagttaggacccagccggaaccatggaagccccagcgcagcttctcttcctctgctactctggctcccagataccactggaagaaatgtgatgacgcagtctccagcccaccctgtctgtgtcctccgaaggggaaagacgccaccctccnctgcgagggccagtcagngttgttggcagcttatcgctaggtaccaacacgaaccgtgacgaggcctaccgagcctcctcacttctatcgatcgctactaccaacgacggacccagtcgacacctcccgacgtaccgtaggtaccaggtcggacgtaggtcggagttcggtacgggcgtaacgttaccttacgtacccttaccgtacctaaccgtaactaccgaacgtacccgtacggtaccgtaaggaccgtaccgttaaggtaacgtttacgttttacggtaccttttaacttttacgttaccgtttacgacgtacggtcgttaaccggacgttaccgaaccgttacggtcccgttacttaccgttaccgttaccggtttccggggaacggggtaccgggtaccgggttaggggacggtaacggtagtacccggaaaggtaccggtacgtacgggttcggtaccgtacgtacccgtacgtacgg

SEQ ID NO: 180298 - DNA, 694 bp, Homo sapiens
  misc_feature: GYAE6OF02ID1XW.26.37.D04.1.454.CMB.1.raw
  modified_base (152)..(152): a, c, t, g, unknown or other
  misc_feature (152)..(152): n is a, c, g, or t
tcagagactatactcacgaccggtgctcgatttagtagcatactgttgggtttgggggagaactgctcagttaggacccagccggaaccatggaagccccagcgcagcttctcttcctcctgctactctggcctcccagataccactggaanaaatagtgatgacgcagtctccagcccaccctgtctgtcgtctaccgaaggggaaagacgtccacccctctccgtgacgagggccagtcaggagttgttagcgcggtcttacgccgtaggtacagtcacgaccaccggtggacacgtaccctaccgaggtccctacctattacttttacgacgcgttacgacctacctaccccgtaacggaccgggtccctacgggtacgtacccctacccggacggtacccgtagggttacccagggtcgaaccgtgggttcggtaccggtaggaactggttactcaccgttcccatacgtatacgactccgtactcgtcgacgtacgtacgagtaacgtactttgacgttaacttattttacgtaacgtagacctagttaaaccttaaacgtactttaaaccgccggttacgtcccgttaccctagttcccggtaacggttcgggacgttaacggaccggttaaggacgacgttaaccgaacggtaacgttgtacggtcgtaaccgccgtaccgcttacg

SEQ ID NO: 180299 - DNA, 757 bp, Homo sapiens
  misc_feature: GYAE6OF02FSN4U.26.37.D04.1.454.CMB.1.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
tcagagactatactcacgaccggtgctcgatttagtagcatactgttgggtttgggggaactgcgtcagttaggacccagccggaaccatcggaagccccagcgccagcttctcttcctcctgctactctggctcccagataccactggaagaaatgtgatgacgcagtctccagcctaccttgtctgtcgtctaccgaggggaaacncgtacctacctctcgngccggacggactcgtacaggtcgttgtacgtccgcgtactacgccgtacggtacngcgaccgtacgtcggtggacaccgacctccgtacgtccttcctattatttacgcgtacgtcgacctacctaccgaccggcgtaccgtaggttacgtaccaccgacggtccgtacggttccgaggtacgaacgttggggttcggtacggtacgggaacttacggtacgttacnccgttaccgaccaaccgtntaccgaacgtccgaaccggttccacggtacgttacgttaccgtaaggtaaacgttcggtttacgactttaaactttaacttttacgttaacggtaccttacgaacgttaacttaaacgttaccgtacccgtttaccgtcccggtaccgttccgttaaccgttaccgtaaccgggttccggggaaccggtaccggtaacgtttaggtaaccggtaacgttaaaccgttaacggtaaccggtggttacgtaaccggtccgttaaacccgcgtttacctcggtttacccg

SEQ ID NO: 180300 - DNA, 829 bp, Homo sapiens
  misc_feature: GYAE6OF02HJ3CH.26.37.D04.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagtaaatagtgctgacgcagtctccagccacctgtctgcctctccgaaggggaaancgtaccacatccgtccgtgtccgggccgtnagtacgtaattacgctagcgaacttagccgtggctaccagcgtaacgaacgtcggacgacggctaccccgaggaccttcccgtactatttcgttttagaacgtcggtaccgttcccgaacctagggaccctaacgtttccgggtttaacccaacgtccgtaacggtttacgaaggtcggtacctagggtacggtacctcggttacgaacccgggaattacgggttaacgttaccgtaaccttacccgttacaaacccgttacgtaacccgaaacgttccgacccggttacgtacgtaaacgttacgttaacgtaaacggtttacgtttttacggacgtttaaacggtttttaaactttaaccgtacggttaccgtaagtaaccgttaacgttaagtaacccgtagtttaacgccggtttacggcccgtacccgtttaaacccgtaccggtttaaccgggaacccgtaaaccgggtacgtaacccggggtacgtaacgggtaacccgggtaaaaattttaaaacccgggacgtttaacgggttaccgggtaacctttacccgggtaacccgttaacccgtaccggtttaacccgg

SEQ ID NO: 180301 - DNA, 672 bp, Homo sapiens
  misc_feature: GYAE6OF02GJ7ZH.26.37.D04.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
  modified_base (464)..(464): a, c, t, g, unknown or other
  misc_feature (464)..(464): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctcagccacctgtctgtgtctaccgaggggaaancgtccaccctctcctagcgagggccaggtcaggtagttgttaggtccgcgggtacttacgtccttacggtacccaggacgagaccaccgttggggaccagacctacccgnggtcctcctactatttagnggtcctagctactcccgaaccgagggccctagtcggtacctcccgtagcccgtaggttccaggtcggcgtacggttgggtcggtacggggtacagggtacgttcctaacttcgtacccaactactacgacgntaccgtccgtcgacgacgttaggtacgtaagttagttggtatacttaagtttactacgttagtactagtaactaaattaactaaccgttaccgttccggtcccttaccctcgttaccgttaccggttccgggacggacggtaacgtagggttacaaggtaactaacgtacgttaacgcggttacggacgtaccggtaccaccgttacg

SEQ ID NO: 180302 - DNA, 735 bp, Homo sapiens
  misc_feature: GYAE6OF02JEKKD.26.37.D04.1.454.CMB.1.raw
  modified_base (150)..(150): a, c, t, g, unknown or other
  misc_feature (150)..(150): n is a, c, g, or t
  modified_base (163)..(163): a, c, t, g, unknown or other
  misc_feature (163)..(163): n is a, c, g, or t
  modified_base (321)..(321): a, c, t, g, unknown or other
  misc_feature (321)..(321): n is a, c, g, or t
tcagagactatactcacgaccggtgctcgatttagtagcatactgttgggtttggggggaactgctcagttaggacccagccgggaaccatggaagccccagcgcagcttctcttcctcctgctactctggctcccagataccactgganaaatgtgatgacncagtctccagccaccctgtctgtgtctccgaggggaaacacgtccacccgtctcctaggccacgggccagtccagagtgtagtcgcgtccttagcctacggtaccagacagtccaccgtgggaccaaggcctcccgaggccttcctagtactttacgngtcctcgactactcccacgtacgggtcccaaggttccggtaactccccgaaggtcctagggttccaagggttccggacttacgggttcggggtacctagggggatacggttagtaccctaccgttcctaccgaaaccctagtccgaaggtcccgaaggtcccgttcgaacgttccgtacggttacggttaaggtacgtttaaggtccgttaatttaacgttttacgtttaccgtagtcggtaacaacggttaaactttaactaaccgtttacccacgggtacccttcgtcccgttaaccttacccggtttacggggaacccgggcgttaaacccggtaggggtttaaccgaacgttaacgttaaccgaaaccggtaggtttcggacgtcgttacgaccgttactcgttacccgg

SEQ ID NO: 180303 - DNA, 646 bp, Homo sapiens
  misc_feature: GYAE6OF02IIK60.26.37.D04.1.454.CMB.1.raw
  modified_base (126)..(126): a, c, t, g, unknown or other
  misc_feature (126)..(126): n is a, c, g, or t
  modified_base (150)..(150): a, c, t, g, unknown or other
  misc_feature (150)..(150): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
tcagagactatactcacgaccggtgctcgatttagtagcatactgttgggtttgggggaactgctcagttaggacccagccggaaccatggaagccccagcgcagcttctcttcctcctgctactntggctcccagactaccacgtgganaaatagtgatgacgcagtcctccagccctaccctgtcctgtcgtcctccggaaggggaaactcgtcctaccctcgtccgtgaccgacgggcacggtcaggtagttcgttacgcggcggtcgttagccgttagaccgagacaacgaccgtcgtggacacgacctccgnggtcctccgtactaacgtttncgcgtcactaccgccgaccggacggccncgttcgtacctccgagccgtagttacgngtcgagtcggtggtacgaggtactaggtccttaccacgttcgaccacgtacncgtacgcncgtcgtcgcgtagtcgtagtagtgttacgtacttaacgttatttacgtactcgtacgtacgtaactaacgttaactacgtacgtcgtccctacgtaccgtacgttaccggttacggaccggtacggtacgttaggtaacgtactaccgaacgttacgtacgtacggtacgtctaccggtactaccgttctcg

SEQ ID NO: 180304 - DNA, 767 bp, Homo sapiens
  misc_feature: GYAE6OF02GJKN8.26.37.D04.1.454.CMB.1.raw
  modified_base (165)..(165): a, c, t, g, unknown or other
  misc_feature (165)..(165): n is a, c, g, or t
  modified_base (168)..(168): a, c, t, g, unknown or other
  misc_feature (168)..(168): n is a, c, g, or t
  modified_base (217)..(217): a, c, t, g, unknown or other
  misc_feature (217)..(217): n is a, c, g, or t
  modified_base (742)..(742): a, c, t, g, unknown or other
  misc_feature (742)..(742): n is a, c, g, or t
tcagagactatactcacgaccggtgctcgatttagtagcatactgttgggtttgggggaactgctcagttaggacccagccggaaccatggaagccccagcgcagcttctcttcctcctgcctactctggctcccagataccactggacgaaatagtgatggacncgngtctaccacgcccacccttgtcctggtcgtcctaccggaagggggaaancgtccctacccttcctccgtggaccgacgggcctagtacgaggtagttggttaggtcgcggtacttaccgcgtacggtacacgcgacgtaaccgccggtaggacgaccgtacgtcccgacgtcccttccacttactttacgtcgacctgacctacctaccggacccggtcggtaacccgtacggttacgtaccccgtaccccgtaaggttacccgtacggttaccgtaggttcggaaccggtttcggggtccgggtcggttaacgggacccgttaaggtccggtttacccaccgttccctaaccccgtaccgtacgttacccggacgacccgttaacgcccggtcgtaaacggtacggttcgaacggttaagtacgttcggtaattaaccggtttaatttcggttacgcttacaagtacttaagttacctacggtttccgcctcgtaccttcgtaccttcggggacggaccgggtactacgggtacgttacgacggttaacaacccgtaagtcccgtagtaccgnggttaaccgcctaccgttagtcccg

SEQ ID NO: 180305 - DNA, 944 bp, Homo sapiens
  misc_feature: GYAE6OF02HVJUC.26.37.D04.1.454.CMB.1.raw
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
tcagagactatactcacgaccggtgctcgatttagtagcatactgttgggtttgggggaggaactgctcagttaggacccagccggaaccatggaacgccccagcgcagcttctcttcctcctgctactcgtggcctccagataccactggagaaatagtgatgacgcagtcctcacgccacctgtctgtntctaccgaagggaacgngtaccaccctctccgtgacgacgggccagtcgaggtagttacggtaggtcgcgggtacttacgccgttagtaccaggacgacgaccgaccgtcggacctaggacctacccgagtccctactaacttacgtttatagtccgtacgtaccaccgttacccgacccgggaacgggtccctaaccggttcgtaacccgtaccccgtaagggaccccgtttaaggggttaccgtaagggttaccggtacgggtacgggttcggggttaacccggtacggtaacggtacgtaacgttttacctaaacccttccgtaaccgtacccgagttaccggaaaccgtaaccgtaccggacccgtttacggaccgttaacgttccggtaaacggttaacgggttaaacgtttcggttaacgttaacgtttaaacgtttttaaaacgtttaccggttaaccggttacggttaaaccgtaaacttaaaaccgttaacccgtttaaaaacctttccccgggttaccggttaaacccccttcggggtttaacccccgtaaccggggttttaacccgggttaccgggggttaacccggggtaaacccggggttaaaccggtttaaacggggttttaaacccgggaaacgttaaaacccggttaaaaccccgggttaaaagggttaacccgggttaacgggttacccgggtaaccccgtaaaccgggtttaacccccgtacccgtttaaccggg

SEQ ID NO: 180306 - DNA, 876 bp, Homo sapiens
  misc_feature: GYAE6OF02GWLVO.26.37.D04.1.454.CMB.1.raw
  modified_base (166)..(166): a, c, t, g, unknown or other
  misc_feature (166)..(166): n is a, c, g, or t
tcagagactatactcacgaccggtgctcgatttagtagcatactgttggggtttcggggagctctgggagaggagcccagcactggaagtcgccggtgtttccattcggtgatcagcactgaacacagaggactcaccatggtagttggctgagtctaggtttccngttgctactttagaggtgtcagtgtcaggacgcgaggtacgtggagtcgtcgggggagcgtaggtccgagccgtacgggggtccctgcggtactcccgtcgtgcgtacgcgtaccgttgtagtacgtcgtaccttaccgtaacgtaccccgtacgtcgtacgtttacgtaccgtaggtacctcccggaaccgtacggtaccccgtaaccggagggaccgggtaagggtacctagggtacgggtcgggtacgtaccttagttaacgtaccttaggtacgtagtacggtaacggtttaagtaaacgttaaccgtaagtaacccgttaagtaacccggtaccgtaaacccgggtaaccttacccggggggtaacggtaaacggggttaccctttcccggttaacccgtaccccggttaccgtaaccgacgtaaaccgttaaacccgttccggttaaaccccggaacgtacccgggtaacggtaccgttaatttccccgggtaacgtaacgttaaccggaaaccgtaccggtaaacctagggttaccccgaaggtaccggttttaagggaaccggtaccggtaaaccgggttggtacccgttttacggttttaaaccggtacggtttccccggggtagtacccgggtttaacgggcggggggttacccgggttagggttaaacccccggttcgtaacccgggttaacgtacggg

SEQ ID NO: 180307 - DNA, 959 bp, Homo sapiens
  misc_feature: GYAE6OF02JXRXR.26.37.D04.1.454.CMB.1.raw
tcagagactatactcacgaccggtgctcgatttagtagcatactggttggggtttgggggggaactgctcagttaggacccagccggaaccatggaagccccagcgcagcttctcttcctcctgctactcgtggctccagatattaaccggaaaatatgatagactcagtcctccgacggcctacccgtgtctggtcgtcctaccggaagggggaaaacgtcggttccacccttccttccgcgaccggacgggtacctagtaccgaaggtagttacgttaaaacgtaaaaccgtaaacctttacggtacccgttacgggtaacccaacggtaccgaaaccggtaaaacccgtcgggacccgaacgggccccgttacccgtaacgggtcccgttaccccgtacttacccgtttaccgttaccgggtcgggttacggtaccctaaccggtaaccccgtaacccggaaccggggtcccgtaaccggttaccggggtaaccgtccccgggaaccgtacgtaaccgtttacggacgggggttacgggtaaccggggacggggggttaccgtaacgggggaaaccgtttaacgggtaaactttacccgtaaccgttaccctaccgtaaaccctaaccgttaaccctaaacccggtcccggtacctacggtaccggttacgtcgttaaaacggtaagttttcggttacgtaacgttacgtttacgttaagttaccgtagtacgttaactaagttaaattacgttaaaccgttcggttaccgtacgttttaccggttcccggggtacggggtaaaccgggggtacgtaacggtccgttaaagggacccggttaaacgtaacccggtaaagggtaccggttcggttaggtaccgggtataccggttaacctacggtttaccgttcggtacctttacgtccccggtttaccctccccgggttataacgg

SEQ ID NO: 180308 - DNA, 777 bp, Homo sapiens
  misc_feature: GYAE6OF02IQHQ0.26.37.D04.1.454.CMB.1.raw
  modified_base (94)..(94): a, c, t, g, unknown or other
  misc_feature (94)..(94): n is a, c, g, or t
  modified_base (151)..(151): a, c, t, g, unknown or other
  misc_feature (151)..(151): n is a, c, g, or t
  modified_base (283)..(283): a, c, t, g, unknown or other
  misc_feature (283)..(283): n is a, c, g, or t
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
tcagagactatactcacgaccggtgctcgatttagtagcatactgttgggtttgggggaactgctcagttaggacccagccggaaccatggaanccccagcgcagcttctcttcctcctgctactcgtggctcccagataccacgtggaanaaatagtgatcgacgctagtctccacgcccacctgtacgtgtcgtctccggaaggggaactacgtccaccctctccgtgccgacggcagtcagtgttgtcgcgtcggtacttgcctacggacagcacgtacncggtggacacgtacctcccgaggtccttctacttagtttcgcgtctgaccgttaacncccgacgtaccgggcctcggtacggtaccncccgtacggtcgtacgggttcaggtccggngttacgggtccgggttacggacgggtacacggttacttaccgtacctttaccggcaaaccggtttacgtacccgaacgggtaccctaacgggcgtaccggtcgtaacggtacggttaacgtaaacggttcgttcggtaaaccgttacgttaaacgtttttcgttaccgtacgtaacctaacggaacttaaacttaacgttaacccgttacgttcccgggttacccttacccgttacttacccgggtttaccgttaaccggggaaccgggttaccgggtaaaccggtttacgggtaaacgtaaccggtaacgttaaacccgtaacgggttaaaccgtgggtacccggtcttaaccggacctttaccggtagtttcccg

SEQ ID NO: 180309 - DNA, 740 bp, Homo sapiens
  misc_feature: GYAE6OF02FWF2E.26.37.D04.1.454.CMB.1.raw
  modified_base (609)..(609): a, c, t, g, unknown or other
  misc_feature (609)..(609): n is a, c, g, or t
  modified_base (667)..(667): a, c, t, g, unknown or other
  misc_feature (667)..(667): n is a, c, g, or t
tcagagactatactcacgaccggtgctcgatttagtagcatactgttgggtttggggagctctgggagaggagcccagcactggaaagtcgccggtgtttccattcggtgatcagcactgaacacagaggactcaccatggagtttggctgagcgttggttttcctcgttgcttcgtttaagaggtcgtccgagtgtcgaggagcgtaggtagtggtagtacgtgggggaggcgtcggtccaggccgttcggggggtccctggacgacctcctccgtgtcgcacggccttcgtcggtacttccaccttttcgaacggtaacccctacggacccgtagtcgaccctacgtcggaccttccggccgtaacggtcccgtacccgaacgggtacggaacggggtaccgttaaggtaacgggttcggggtaccgtcgttttaacttaaagttaccgtataacgttacgtaggtaagttacgggtaaaattaagtaacgtaaaccgtaccgttaagtacacggtaccgttacggtaagaacggacgtcccgtaacttccgacccgttcaccagtacgaactaacgtaccgaagtacacgtactgtttaccgttangaactaaagtccgaaatcgaaccgtagtaacgggtgttaacggagttaccgcggtttnttaacctttcggtttacgaggtacggtccggttaggtaccgggttcccgggtaagggtccgggtcttaaccgg

SEQ ID NO: 180310 - DNA, 790 bp, Homo sapiens
  misc_feature: GYAE6OF02ICFBF.26.37.D04.1.454.CMB.1.raw
  modified_base (154)..(154): a, c, t, g, unknown or other
  misc_feature (154)..(154): n is a, c, g, or t
tcagagactatactcacgaccggtgctcgatttagtagcatactgttgggtttgggggaggaactgctcagttaggacccagccggaaccatggaagccccagcgcagcttctcttcctcctgctactctggcctcccagactaccactggaanaaatagtgaatgacgcacgtctccacgcccaccctgtcttgtcgtcctaccgaaggggaaacacgtcccaccccttctaccgtggaccgtacggggtcctaacgtcgaaggtacggttggtttacggccggacggttcttacggccgttcggtaccaggtacaacgaaccgccggttcgggacctacggaccctacccgacgggtccctacccttagtactttacgtcgtcgtcgactacctacccgaaccggcgtacctacggttacggtaccgtcccgacgtaccgtacggttacgagggtacgtcggtaggttcgggtacggtacgggaactacggtaccttaccgtccttccgtacgaaccctgtaccacggtccacggtctacgacgtacgtacgtaagtacgttaattcggtaattacttaactttcttaacgtcgtacgaactaagtaacttaacttaaccgtccggttaccgtaccgttaccgttccttaaccggttccgggtttaaccggggaccgggttaacgggttaaccggttaacggttaacggtaaccggtaaaccgttaaacccgtaaaccgggtttactaccgggttacggaaccgtaccggtaccgttaacgtttcccg

SEQ ID NO: 180311 - DNA, 871 bp, Homo sapiens
  misc_feature: GYAE6OF02IEYWO.26.37.D04.1.454.CMB.1.raw
tcagagactatactcacgaccggtgctcgatttagtagcatactgttgggtttggggagctctgggagaggagcccagcactggaagtcgccggtgtttccattcggtgatcagcactgaacacagaggactcaccatggagtttgggctgagcgttgggttttcctcgttgtctttacttttaagaggtgtccagttgtcgaggacgcgtaggtagtggagtcggtgggggaggcgtgggtccacggtccggttcggggggtccctagggacgtaccgttccttccgttggtacgcgtacgccttcgtcgggtacttccgtacctttccgacgttacccgtaccggcctaatcggacctacgttcggaccgttccccggccgacggtccgttaccgacgggaccgggtaacgggggacttaacgggtagggttacgggggttcgggtaccttccggtttaattacgttacgtaacttacggtaagtacggttaacgggtaaacggtttaaataacggttaaaaccttaacggtttaacccggtaaccgtaaccgggtaacccgtttaccgggtaaacggggtaaaacggggtcccgttaacggttacccggttaccccggtttccgaacccgtagggaacgtaaaaccttaccgtttaacccggaaagaccggaacctaacgttaacgtttccgggttttacacgtaccgttaaaagtaccgtaaactacggacccttacgggtaaagttcggttagaacgggtaccgtacgggttagttcctttaacggtttccgtggttacggtccggacccgggtttacgggttcccgggggttgggtacccggggtttccgttacggttaacccgg

SEQ ID NO: 180312 - DNA, 703 bp, Homo sapiens
  misc_feature: GYAE6OF02GSI3P.26.37.D04.1.454.CMB.1.raw
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (211)..(211): a, c, t, g, unknown or other
  misc_feature (211)..(211): n is a, c, g, or t
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
  modified_base (548)..(548): a, c, t, g, unknown or other
  misc_feature (548)..(548): n is a, c, g, or t
tcagagactatactcacgaccggtgctcgatttagtagcatactgttgggttgggggaggaactgctcagttaggacccagccggaaccatggaagccccagcgcagcttctcttcctcctgccttactcgtggcctacccagactaccactggagaaatagtgatgacncagtctccganccaccgtgtctgtgtctccggaagggaaancgtaccacccgtctccgtgacgtagggccagtcaggtagtgttacgcggcgtacttaggcctaggtcagcaacgcacgtggcagacctcccgagtctaccgtacttaacttagacgtacgtacgacaccttaccgaaccgagggtacctacgttacgtaccgtaccccgacgtcgtaccggtttanacgggtacgtacggtagggtcgggtacncggggaactacgggtaacttccgacgtctaaccgtaacgactacgacgaccgcgacccgtgaactcggtacgtagtacgttcttggtaaaccttagttttaacctacgtagccgtaaccgganaaggttaaactacggtaacctacgtttaaccgtaacttaccggtacgggtttaacccggcgggttaaccacggggtaaccgtaagggtaaaacccgtaacggttacgtcggaagttaccacgtacctaaccgggtattcccgttagttctaaccg

SEQ ID NO: 180313 - DNA, 607 bp, Homo sapiens
  misc_feature: GYAE6OF01CCWYW.40.65.F10.1.454.CMB.1.raw
  modified_base (232)..(232): a, c, t, g, unknown or other
  misc_feature (232)..(232): n is a, c, g, or t
  modified_base (376)..(376): a, c, t, g, unknown or other
  misc_feature (376)..(376): n is a, c, g, or t
  modified_base (421)..(421): a, c, t, g, unknown or other
  misc_feature (421)..(421): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtgctccatcagcagcagtacttacttcgnggggctggactccgccacgccccgaggggaagggctggagtggagttgggatattacgacgagtggagcacctactaccaacccgtcctacaaagtcgacgcacatatccgtagacacgtacaaacgaacaatctacctagaanctagagctcgtgtcgaccgcgcacgacacggctgtactattacgngtcgaccgacggcccgaggcgactaggtcggttctttttgacgttcgttaccgtttgtaattcggttggtaccggggtacgaaacgggtactaacggttcgggtaccctaccggttctacccgtttaccgaccgttaccccgtacccgaaccccggtaaccgggtcccctaacggtttcccccggg

SEQ ID NO: 180314 - DNA, 555 bp, Homo sapiens
  misc_feature: GYAE6OF01BMRUW.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttactctggggctggatccgccacgccccagggaagggctggagtggattgggagtatttaccacaggtgggagcacctactaccaacccgtcctacaaaagtcgagcaccatactccgtagacacgtaccaaacgaaccaattctaccctagaacgctagagctctgtcgaccgccgcacgacacggctgtctattactgtgcgacggccccagcgcagtgtcttttgattcgtcctttgagttagtggtcggggaccaaagggtactaagtcggtaccaccgttctcgttcgacgtcccttaccgaacccgaacgggccctagtccccgg

SEQ ID NO: 180315 - DNA, 575 bp, Homo sapiens
  misc_feature: GYAE6OF01ACJM9.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggatccgccacgcccccgagggaagggctggagtggagttgggagtatttaccacaggtgggacgcacctactaccaacccgtcctacaaaagtcgaggcacatactccgtagacacgtaccaaagaacctaacttcctacctagaacgctagacgctctgtcgaccgccgcacgacacggctcgtctattacgtgtcgcgacggcccgagcgcgagtgtcttttgattcgtcctttgattagtggtcgggaccgaagggactaaggttcggtactacccggttcttaccgttcgacgtcccttacccgaaccgaaccgggtccctaggttccccgg

SEQ ID NO: 180316 - DNA, 537 bp, Homo sapiens
  misc_feature: GYAE6OF01ACVUT.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggactccgccacgcccccgaggggaaggggctggaggtggagttgggagtatttaccacagtgggagcacctactacaacccgtccctacaaaagtcgaggcaccatactccgtagacacgtccaagaacccaattctccctgaagctgagctctgtcgaccgccgcagacacggctgtctattactgtgcgacggcccgagcgcagtgtcttttgattgtcctttgatagtggtcggggccaaagggacaagtcggtcaccgtctcttcacgtccctaccaccacgggccctagtcccgg

SEQ ID NO: 180317 - DNA, 665 bp, Homo sapiens
  misc_feature: GYAE6OF01BH0G3.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttactcgtgggctggactccgccgacgccccgagggacgggctggagtggagttgggagttacttacgacgtaggtggacgacacctaacctaaccgaacccgtaccctaacgaaaacgtcgaacggacaaccgatacgtaccgtaagaccaacgtaccaaacgtaacctaacttaccacccgtagaaacgtctacgacgtctcgtcgtaccgacccgacgacgacgaccgacggtcgtcgtactaagttacgtggtcggcgtaccgggcccgaggccgtcgtaggttcgttacgtttttagacgttcgttaccgtttagaagttacggtgggtacggggaccgtaaacggggtaactaacggttcggtaccttaccggttccttaccgtaccgaccgttccccgtaccgaacccggtacggtccccgtacggttcccccgg

SEQ ID NO: 180318 - DNA, 537 bp, Homo sapiens
  misc_feature: GYAE6OF01CRKMP.40.65.F10.1.454.CMB.1.raw
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccaggcccccaggggaaggggctggagtggattgggagtattacacagtggancacctactacaaccgtcctanaaaagtcgaggcacatatccgtagacacgtcaaagaaccaatctcctgaanctgagctcngtgaccgcgcagacacgctgtctatactgtgcgacgcccgagcgcagtgtctttttgacttgtcctttgactagtggtcgggacgaaagggacaacgtcggtacaccggttctccgttcacggtccctacccacccgaaacgggccctagttccccgg

SEQ ID NO: 180319 - DNA, 525 bp, Homo sapiens
  misc_feature: GYAE6OF01CAOFW.40.65.F10.1.454.CMB.1.raw
  modified_base (339)..(339): a, c, t, g, unknown or other
  misc_feature (339)..(339): n is a, c, g, or t
  modified_base (442)..(442): a, c, t, g, unknown or other
  misc_feature (442)..(442): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggatccgccaggcccccagggaaggggctggagtggattgggagtatttaccacagtgggagcacctactacaacccgtcctcaaaagtcgaggcaccatanccgtagacacgtcaagaacaattctccctgaagctgagctctgtgaccgcgcagacacggctgtctattactgtagcgacggcccgagcgcagtggcttttgnttgcctttgatagtggtgggccaaggggacaagtcggtcaccgtctcttcacgtccctacacccgaacgggcccagttcccgg

SEQ ID NO: 180320 - DNA, 538 bp, Homo sapiens
  misc_feature: GYAE6OF01ARD4F.40.65.F10.1.454.CMB.1.raw
  modified_base (298)..(298): a, c, t, g, unknown or other
  misc_feature (298)..(298): n is a, c, g, or t
  modified_base (449)..(449): a, c, t, g, unknown or other
  misc_feature (449)..(449): n is a, c, g, or t
  modified_base (529)..(529): a, c, t, g, unknown or other
  misc_feature (529)..(529): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggcttgatccgccagcccccagggaagggctggagtggattgggagtatttaccacaggtgggancgacctactaccaacccgtccctacaaaagtcgaggcaccgatactccgtaagacaccgtaccaagaacccaattcctccctagaacgctagagctctgtcgaccgccgcagacacggctcgtctattactgtgcgacggccccgagcgcngtgtcttttgatgtccttgatgtggtgggcctaagggcaagtcggtccacgtctcttcacgtcctaccaccgacggcccngttccccgg

SEQ ID NO: 180321 - DNA, 1061 bp, Homo sapiens
  misc_feature: GYAE6OF01EH23L.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccgttcggacgaccctcgtcccctcacctgcactgtcctcgtgggtgcctccatcagcagactagttacttacttcgtggggctcggactcccgaccgaccggacccccgaaggggaacggggcgtagggaggtagggtagttaggggtaagttaacgtttaaccgaaccgtagggttacggggaacgtacccgtaaccccgttaaaccgtaacccccgtaaaaccccccggttacccccgttaaaacgtaaaaaacgggttcccggaaacggtaccccgtaaacccgtaaacgttaaaccggttaccccgggttaaacgaaccccgtaaacccgttaaccccgaaaaaaccggaaaacccttaaacgttttaccccgttaccccgtaagggtaaaaccgtacccggttaaggtaaccggtcccgtttaccggtttaccggggtaacccggtaaccccccgggtaccccggtaacggaacccggtaaacccgggtacccgggttaaccgtttaccgggtttaaccctttaaacggtttttaacccgggttacgggttacccgggttaccgggggaaccccgggtacccccccgggtaaacgggtaccccggtacccgggttaaccgggttttaaccggggtttttccccggttttttaaggaacccgggttttccggttttaacccgttttaaggttaacgttaccgggtttacgggggttaaccgggggtaaacccgggtaaaacgggtaacccggtttaaaccgggttcccgggttaaaccccgtacccccggttttaccgttacccgttttacccggaaccccggttacccccgttaaccccggaaaccccgggtaacccgggtacccccgttaccggtttaccccccccgggg

SEQ ID NO: 180322 - DNA, 718 bp, Homo sapiens
  misc_feature: GYAE6OF01DTJXO.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgaggggaaggggctggagtggagttgggagtatttaccacgaggtgggagcacctactaccaacccgtcctacaaaagtcgaggccaaccatactccgtagaccaaccgtaccaaacgaaaccctaaatttcctacccgtagaacgtctaggaacgtccttcttggtacggaccccgcccggacaacggaaccgaccgggtccttaggttaccttaactttacgtcggttacggaccggaccgggcccccggaggccgacgtacgggttcgggttccgtttttttaggagtttcgttacccgtttttgaacgtttaggttcggggttacgggggacccgtaaagggggtaacctaaacgggttccgggttaccgtaccccggtttccgttacccgtttaccgaaccggtcccccttaaccccgaacccggtaaaccggggtcccccgtacggtttcccccggg

SEQ ID NO: 180323 - DNA, 762 bp, Homo sapiens
  misc_feature: GYAE6OF01BXL4E.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgagggaacggggctgggagtggattggggagtattaccgacaggtgggagcacctactacaacccgtccctacaaagtcgacggcaaccatactccgtaagaccacgtaccaaagaaccaactttcctaccctagaaacgtctacggaacgtcctacgttcgtcgaacccggtcccgaccgtaacggaaccgaacccgggtccgttacggttaccttaagtttaccgtcgggttacggcccgggtaaccgggtccccccgggtaggacccggtaccgttaagggttcgggtttaccgtttttttacggaacgtttcggttacccgtttttaggtaacgtttacggtttcgggttacggggggtaacccgtaaaagggggtaacccgttaaaggttcccggggttaaccctaccccggtttcctttaccgtttacccgaaccggttcccccgttaaccccgtaaacccccgggtaaacgggtcccccgttaacggtttccccccgggg

SEQ ID NO: 180324 - DNA, 648 bp, Homo sapiens
  misc_feature: GYAE6OF01B0PTX.40.65.F10.1.454.CMB.1.raw
  modified_base (469)..(469): a, c, t, g, unknown or other
  misc_feature (469)..(469): n is a, c, g, or t
tcagtctagcgactcacgaccggtgctcgatttagctacgctctaagggggatctcatgtgcaagaaaatgaagcacctgtggttcttcctcctgctggtggcggctccagatgggtcctgtcccagctgcagctgcaggagtcgggcccaggactggtgaagccttcggacgaccctgtccctcacctgcactgtctcgtggtgctcatcagcagctagtacttacgtcgtgggctggactccgccacgccccgagggaagggctggaggtggtagttgggtacgtagtttacgactaggtggagcacctaactaccaacccgtcctacaaaagtcgagcacatactccgtacgacacgtaccaaacgaacctaattccacctagaacgctagagcctcgtacgtcgaccgaccgacgaacggaccgacggtcttacgtcttacttacgtgtcgcggtacggccccgngccgcgtacggttcggttacgtttttgactttcgtccgttttagacgttagtagggtaccggggtaaccgaagggtaacgtaacggttccgggtacctacccgggtttcctttaacgttaccgtaccgtccccgttaaccgtaacccggaaccgggtccccgtaccgtttacccccggg

SEQ ID NO: 180325 - DNA, 699 bp, Homo sapiens
  misc_feature: GYAE6OF01C4U0A.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgccacttgtctcgtggtgctccatcagcagctagtactttactcgtgggctggactccgccacgccccgagggacgggctggaggtggagttgggagtacttaccgagtaggtggacgcctaacctacctaacccgtaacccgtccaacgaaaacgtccgaacggacctaaccagtacgtaccgtaacgaaccaaccgtaaccaaacgtaacctaaactttcccgtacccgtagaacgtccgtaggacgtcttaccgtagtaccgacccggcccgacgtacggacccgacgggtcttacggttacttaacgtttaccgtgggttaccggaccggacccgggacccccggagaccggtacgtacggttcggtttacctttttggacgtttcgtaccgtttagtacgttaggtcgggtacgggaccgtaaacgggtactaacggtcggtacctacccggttcttaccgtctaccgtcccacccgaacccggacgtcccgtacggttccccg

SEQ ID NO: 180326 - DNA, 633 bp, Homo sapiens
  misc_feature: GYAE6OF01C43OJ.40.65.F10.1.454.CMB.1.raw
  modified_base (623)..(623): a, c, t, g, unknown or other
  misc_feature (623)..(623): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctcatcagcagctagtacttacttgtggggctggactccgccacgccccgagggacgggcgtggagtggagttggacttattaccgagaggtggagacacctactaccaaccgtcctaacgaaacgtcgacggcaacactacgtaccgtaagacacgtaaccaaacgaacctaattcctaccgtaagaacgtcgtagtacgtactacttcggacgaccgccgacgaacgaccgacggtacttagtaccttaatacgtggtcgacccgacggtaccccgaggccgtacgtacgttcggttctttttagacgtttcgtacctttggaacttcggtgggttacggacgtaaacggactaaacggttcggtacctaccggttcttaccgttcgaccgtccaccggtaaccgaccggtacccngttaccccgg

SEQ ID NO: 180327 - DNA, 661 bp, Homo sapiens
  misc_feature: GYAE6OF01BJC1R.40.65.F10.1.454.CMB.1.raw
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtgggctggactccgccacgccccgagggaacgggctggagtggtagttgggagttacttaccgacgaggtgggacgccacctactaccacccgtcctacaaagtcgagcacatacncgtagacacgtacaagaacctaattcctaccgtagaacgctagacgtctcgtcgtacgacccgcccganacggaccgacggtctcgtactagttacctggtcgaccgaccggccccgagccggacgtaggttcggttcttttacggacgtttcgttaccgttttagagttacggttacgggtacggggtaacccgaaaggggtaaccttaaggttccgggttacccgtacccggtttccttacccgttacgtaacccggtcccccttaacccgaacccggtaacccgggtccccctaacgggtttccccccggg

SEQ ID NO: 180328 - DNA, 665 bp, Homo sapiens
  misc_feature: GYAE6OF01EYRZL.40.65.F10.1.454.CMB.1.raw
  modified_base (509)..(509): a, c, t, g, unknown or other
  misc_feature (509)..(509): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggactccgccacgccccgagggaaggggctggagtggattgggagtatttaccgacgaggtgggagcacctactaccaacccgtccctacaaaagtcgagaccacatacgtacgacgacacgtaccaaacgaacctaattccctacccgtagaacgtctaggacgtcctcgtcgtacggaaccccgtccgaccgaagaaccgacggtcttacgtacttaacttacgtgtcgcggaccggcccgaggccgtacgtaggttcggtttcttttagngtttccgttccgttttagtaacgttagttcggggtacggggtaacccgaaaggggtaaactaaggttccgggttaccctaaccggttccgttacccttacgaaccgtaccccttacccgaaccggtaaccccggggtccctacgggttccccccgg

SEQ ID NO: 180329 - DNA, 638 bp, Homo sapiens
  misc_feature: GYAE6OF01EU4K0.40.65.F10.1.454.CMB.1.raw
  modified_base (539)..(539): a, c, t, g, unknown or other
  misc_feature (539)..(539): n is a, c, g, or t
  modified_base (607)..(607): a, c, t, g, unknown or other
  misc_feature (607)..(607): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagttaccttacttcgtggggctggactccgccacgccccgaggggagggctggagtggagttgggagttacttaccgacgtaggtcggggacgccaaccgtaacctaacccgtaaaccccgtaccctaacgaaaacggtccggaaggaccaacctagtactaccgtaacgaacaccgtaccaaacgaacctaacttccctacccgtagaacgcgtagacgtccttcgtaggtcggaccccgccgacgacgtaccgaccggtctcgtacttaacgttacgtaggtcggacggtaccggccccgaagcgaccgtagttcggttnttttacgcgttcgtctttgattacgtggtacgggacaaagggtactaagtcggtacctccgtctactnaccgtcctaccacgacggtccctggtcccgg

SEQ ID NO: 180330 - DNA, 665 bp, Homo sapiens
  misc_feature: GYAE6OF01DVZ16.40.65.F10.1.454.CMB.1.raw
  modified_base (359)..(359): a, c, t, g, unknown or other
  misc_feature (359)..(359): n is a, c, g, or t
  modified_base (418)..(418): a, c, t, g, unknown or other
  misc_feature (418)..(418): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccagggactggtgaagccttcggagaccctgtccctcacctgcactgtctctggtgctccatcagcagcagtacttacttcgtggggctggatccgccacgccccccgaggggaaggggccgtggagtggattggggagtacttttaccacgtaggtgggagtcacctactaccaacccgtccacaaaagtcgagcaccatactccgtanacacgtaccaaagaaccaattccacctagaacgctaggactctcgtgcgtaccgccganacgaccgcggtctcgtactacttacgtgtcgaccgcggacccgacggcgtacgtaggtcggtttacgttttagacgttcgttacccgtttagtacgtttaggtacgggtacggggtaacccggtaaacggggtacctaacgggttccgggtacccgttacccccggtttacgttccctttacggaacccgttaccccttaacccggaaacccgtaccggggacccccttacggtttacccccccggg

SEQ ID NO: 180331 - DNA, 690 bp, Homo sapiens
  misc_feature: GYAE6OF01E36M8.40.65.F10.1.454.CMB.1.raw
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtcccctcacctgcactgtctcgtggtgcctcatcagcagcagtacttactcgtgggctggactccgccacggccccgaggggaagggctggagtggagttgggatattaccagagtgggacnccacctaactacccaacccgtcctacgaaaacgtcgacgacaccatatccgtanacacgtaccaaacgaactaacttcctcctagaacgctagacgtcttacgcgtaccgacccgtcccgacacggaccgaccggtcttcgtaccttaatacgtcgggtacggacccggaccggtcccccggaagccggtacgtagggttcggtttacctttttaggacgtttccggttaccgttttaggaactttacgggtcgggttacggggaacccgtaaaaggggaacctaaacgggttccggtacccgtaccccgtttcttacccgttaccaccggtacccccttaacccgaaacccgggtacccgggtccccctaaccggtttccccccggg

SEQ ID NO: 180332 - DNA, 756 bp, Homo sapiens
  misc_feature: GYAE6OF01B8JET.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctccagatgggtcctgtcccagctgcagctgcagggacgtccgggcccaggactgggtagaacgccgttcgggacgacccgttgtccctcacctgcacttcgtctcgtggtcgctccatcagcagctagttaccttacgttcgtcggggctggacctccgccgaccgcccccggaaggggaacggggtcgtcgggagtggggacgtttggggtaacgtttacgtttaaccgacgtaggtcgggaacgccaaccttaacgtaacccgaacccgtacctaacgtaaaacgtccgaacggccaacctataacgtaccgtaagaaccaacgttaaccaaagtaaaccctaagttaccctaccgtagaaacgtctacggacgtacttcggtacgtccggacccgcgtaccgaaggtaccgacgtccttagttaccttagttacccgtgtacggacccgaccgggtccccgagccggagttaccggttcggttactttttaggacgtttcggttacctttaggtacgttaggttacgggttacggggaaccgtacgggtaaacttaacgggttcggtacccgttaccggttccttaccgttccgaccggtaccccttaccgaacccggtaccggtaccccgtcggtttaccccccgg

SEQ ID NO: 180333 - DNA, 660 bp, Homo sapiens
  misc_feature: GYAE6OF01DTFQC.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtcgctcatcagcagctagttacttacgtcgtggggctggactccgccacgccccgagggaagggctggagtggtagttggagtacttacacgaggtggacgcacctacgtaacctaaccgtccaacgaaacgtcgaacggtccaacacttaacgtaccgtacgaccgaacgtaacccaaagtaaacctaacttcctaccgtagaaacgtctagaactcgttcgtacgtccgacccgtccggacacgtaccgacggtctagttactaagttactacggtcgaccggaccggtcccgacgtcggccgtaggttccggtttcttttaggacgtttccgtcgttttagagttaaggttcgggtaccgggacgtaaacggggtaactaggttccggtacctaccgttcgttacctaccgtaccgtcccctacgaaacccgccggtcccgtcgttaccccgg

SEQ ID NO: 180334 - DNA, 752 bp, Homo sapiens
  misc_feature: GYAE6OF01ALZI4.40.65.F10.1.454.CMB.1.raw
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
  modified_base (317)..(317): a, c, t, g, unknown or other
  misc_feature (317)..(317): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcgactgcactgtctcgtggtcgcctcntcagcagcagttacttacgttcgngggctggactccgccgacgccccgaggggacggcgtgggagtggtagttgggattaccttaccgacgtagggtacgggaacnccgtaacccgtacctaacccgtaacccgtccctaacgtaaaacggcggacggacctaccgtaataccgtaccgttaacgacctaaccgtaccaaacgtaacctaacgttcctaccgtaggaaactcgttacgacggtcttacgtacggtacccggtacccgaccgggacaacggtacccgtacggtactttacggttaacctttaacgttacgttacgggtaccggtacccgggacccggacccgtagccggtacgtaacgggtttcggtttaccttttagacggtttccttaccggtttagtacgtacggttacgggtacggggtaaccgtagggtaaaccttacgggttccgtacccggtacctttcccgtaacgttcccgaccgtaccccgttacccggaacccgacgggttaccctcccggtttaccccgg

SEQ ID NO: 180335 - DNA, 698 bp, Homo sapiens
  misc_feature: GYAE6OF01CQOJ6.40.65.F10.1.454.CMB.1.raw
  modified_base (304)..(304): a, c, t, g, unknown or other
  misc_feature (304)..(304): n is a, c, g, or t
tcagtctagcgactcacgaccggtgctcgatttagctacgctctaagggggatctcatgtgcaagaaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactcgtggggctggactccgccacgccccgaggggagggctggagtggagttgggagttacttaccacgaggtgggacncacctactaccaacccgtcctacaaaacgtcgacggcaaccatactccgtagaccaacgtaccaaacgaacctaattccgtaccctagaacgtctaggacgtcctcgtcggtacgacccgtcccgacgaacgaccgacggtcttcggttacttacgtttacgtggttcggaccggtaccgggccccggaggccgacgtagggtttcggttcgtttttaggacgtttcggttaccttttaggtacgttagggttcggggtacgggggtaacccggaaaaggggtaacctaaaggttccgggttacccgtaacccggtttcccgttaccgtttacccgaccgtaccccttaccccggaacccggaaacccgggtcccccgtacggtttcccccggg

SEQ ID NO: 180336 - DNA, 656 bp, Homo sapiens
  misc_feature: GYAE6OF01COS4W.40.65.F10.1.454.CMB.1.raw
  modified_base (202)..(202): a, c, t, g, unknown or other
  misc_feature (202)..(202): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgnggtcgctcatcagcagcagttacttacttcgtgggctggactccgccacggccccggagggagggctggagtggagtgggattacttaccgagtaggtggacgctaaccgtactaacctaacccgtacctaacgaaaacgtcggaacgacaaccgtaatacgtaccgtaacgaaccaaccgtaaccaaacgtaaccctaactttccacccgtagacgtacgtgactctacgtcgtcgacccgcgacgacgacgacgtctagtactacgttcgtgtacggcgaccggcccgagcgtacgtaggttcgttacgttttacgagtttcgttcgtttagtagttacggtcgggtaccggggaccgtaaacgggtaactacggttccggtaccgtaccgttccttaccgtacctaccgcccttacccgaaccgtaacccggtcccttaccggttccccgg

SEQ ID NO: 180337 - DNA, 647 bp, Homo sapiens
  misc_feature: GYAE6OF01DU39N.40.65.F10.1.454.CMB.1.raw
  modified_base (461)..(461): a, c, t, g, unknown or other
  misc_feature (461)..(461): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (555)..(555): a, c, t, g, unknown or other
  misc_feature (555)..(555): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggacgaccctcgtccctcacctgcacgtgtctcgtggtggcctccatcacgcagctagttacttacgttcgtgggctggactccgaccaccggccccgaggggagggctaggaggtggtagttgggtattactttaccgagtaggtcgggacgacctaaccttaccgtaacccgtaaccccgttacccgtaacgtaaaacggtcccgaacggacccaaccgtaactacgttaccgtaacgaaccgtaaccgtaaaccaaaccgtaacctaaactttcctacccgttaagacnccgttagagtccttacgttcgacgacccgcgacgacgaccgacgtctatacttattacgtgtcgcgcccggccgngcganaggttgttctttgngtcttcttgtatgtcggacgggacaaggactaggtccgttcctacgttccttactcgacctccctaccgaccgtacggccctggttcccccg

SEQ ID NO: 180338 - DNA, 825 bp, Homo sapiens
  misc_feature: GYAE6OF01BYFZS.40.65.F10.1.454.CMB.1.raw
  modified_base (240)..(240): a, c, t, g, unknown or other
  misc_feature (240)..(240): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtccgggcccaggacgtgggtagaacgccgttcggacgaccctcgtccctcacctgcactgtctctggtgctcatcagcagctagtacttacgttcgngggactggactccgccacggccccgaaggggaacgggctagggagtcggtagttagggagttactttaccgacgtaggtaggggacgtacctaacccgttaaccgtaacccgaaccccgttacccgtaaccgtaaaaacggtccggaaacggtacccaaccgtaacgttaacgtacccggttaacgaaccgtaaccggttaacccgaaaacggtaaaccctaacgtttacccttaccccgtaaggtaacgtaccgtacggtaaccgttccttaccggttacggttaacccggaccccggtaccggaccgtaacggaaccgtaccggtaccgttacggttacctttaagtttaccgtggttacgacccgggacccggccccgaacggccggtaccgtagggtttccggtttaccttttttacggcgtttaccgttaccgtttaggaacgtttacggttacggggtaccggggtaaccgtaaaacgggtaaccgtaacgggttcggtacccgtacggtttcctaccgttaccgaccgttccccgtaacccgaacccggacccggtcccgtaacggtttccccccggg

SEQ ID NO: 180339 - DNA, 718 bp, Homo sapiens
  misc_feature: GYAE6OF01EXW8T.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtggctccatcagcagcagttacttacttcgtggggctggactccgccacgcccccgaaggggaacggggcgtgggagtggagttaggggtagttactttaccgacgagggtcgggacgaccgtaacccgtaacgtaacccgaaaccccgtaccccgtaacaaaaacggtccggaacggtacccaaccaacttaacgtaccggtaagaccgtaaccgtacccaaaacgaacctaaactttcctacccgtagaacgtccgtaggagtcttcgtcgtacgacccgtacagacgaacggacctaacgggtcttacgttacttaacgtttacgtcgtcggacggaccggccccggagccgacgtaggttcggttctttttagacgttcggtttctttaggattacggtgggttaccggggaccgtaaagggtacgtaaggttacggtacccttcccggttcctacggtttaccaccggttaccctacccggaaacccggtaaccggtccccttacccggg

SEQ ID NO: 180340 - DNA, 692 bp, Homo sapiens
  misc_feature: GYAE6OF01BOF4Q.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcgaggagtccgggcccaggactggtgaagccttcggacgaccctgtccctcacctgcactgtctcgtggtgcctccatcagcagcagtacttacttcgtgggctggactcccgccgaccgccccgaggggaacgggctggaggtggagttgggattacgttaccgagaggtggacaccgtacctactaccgaacccgtccctaagaaacgtcgaggaccaccatactaccgtagactaccgaccgaaacgtaacctacttacctaccctagaacgcgtagactcttcgtacggtaccgacccgccgacgtacgaaccgccggtactcggttaccttagttaccgtggtaccgaccggtaccggccccggtagccggtccgtagtttccggttacttttcggaacttcggttacctttgaagttacggttggaccggggtaacctaaggggtaaactggttaccgggtaacccgttcccggttcttacccgttacgaaccccgttcccgtaaccccggaacccggtaaaccgggtcccctaaccggtttcccccgg

SEQ ID NO: 180341 - DNA, 617 bp, Homo sapiens
  misc_feature: GYAE6OF01EARM7.40.65.F10.1.454.CMB.1.raw
  modified_base (236)..(236): a, c, t, g, unknown or other
  misc_feature (236)..(236): n is a, c, g, or t
  modified_base (561)..(561): a, c, t, g, unknown or other
  misc_feature (561)..(561): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtccgggcccaggactggtagaagccttcggagacccttgtcccctcacctgcactgtctcgtggtgctccatcagcagcagttacttactcgnggggctggactccgccacgcccccgaggggaagggctggagtggagttgggagttacttaccagaggtgggagaccacctactaccaacccgtcctacaaaagtcgagcaccatactccgtagacacgtacaaacgaacctaattcctaccgtagaacgtctagaacgtctacgtgtccggaaccgccgacacggaaccgacggtctagtacttacttacgtgtacgccggacgccccgagtccgcgtacgttggttcttttaggacttgttaccgtttgagttaggttcggcgggaaccgaacgggtaactacgtcggttaccnccgttgtaccttcgaccgtcccctaaccgaccgaaccggtccctaggttcccccgg

SEQ ID NO: 180342 - DNA, 880 bp, Homo sapiens
  misc_feature: GYAE6OF01CW2XM.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagctagtacttacgttcgtgggctggactccgccacgccccggaaggggacgggctagggacgtggtagttgggtaacttacgttaaccgacgtagggtacgggacgaccctaaccgttaaccgtaacccgtaaccccggttacccgtaaacgtaaaaacggttcccggaaacggtacccgtaaacctaacgttaacgttacccggtaacggaacccgtaaacccggttaacccgaaaaacgtaaaccccttaaactttacccgtaccccgttaaggaaacgtcgtaacggtaccgtcccttacggttcggtacccggaaccccggtaccggtaccgaaacgggtacccgtaccgggtctttacggttaccttaacgttaccgtcggtaccggacccgggtacccgggccccgaggtaccgtaccgggttaggttccgggttttacgtttttacggacgtttaccgttccgtttagtaacgtttacgggttaccggggtaaccgggggtaaccgtaaacggggttaacctaacggttacccgggttaaccccgttacccggtttccgtttacccgttaacccggaccgtttaacccccccggtaacccgttaaacccggggtaaaccccgggttcccccctttaagggtttaccccccccgggg

SEQ ID NO: 180343 - DNA, 864 bp, Homo sapiens
  misc_feature: GYAE6OF01A4K3B.40.65.F10.1.454.CMB.1.raw
tcagtctagcgactcacgaccggtgctcgatttagctacgctctaagggggatctcatgtgcaaagaaaatgaagcacctgtggttcttcctcctgctggtggcggctcccagagtgggtcctgtcccagctgcagctgcgaggacggtcgggcccagggacgtgggtagaacgccgtttcgggaacgcccgttcgtccctcaccgtgcacttgtcttcgtgggtcgcctccgtatcgaagcagcgtacgtttacttacgttcggtgggctaggacctccgaccgtaccggaccccggaagggggtacgggcgtacgggaggtggtaggttacggggtagtttaaccttaaccgacgtacgggtcggacgtacctaaccgttaaccgtaacccgtaacccgttaccctaaacggtaaaacggtcgaacggtacctaaccgtaagtaccgttaccggaacgaacctaaccgtaaccgaaaacgtaaccctaacgtttaccgaccgttaacgggactacgtacggtaacgtccgtttacgtaccgggtaccggacccgtaccggtaacgacgtacccggtacggttacgttccgttaacttaacgtttacgtcgggtaccggacccgggtaaccgggtaccccggaggttacccgaaccgggtttcgggttacgttttaccggttttacgggtaccttcggttttaccgtttacgggttaacggtcggttacgggggaacggtaacccgggtaaacggacgtttaccgggtccgtacccgttacggtttcccttaccggttacccgaccccggtaccctaacccggtaaccccggaacggttccccgtaaacgttttccccccggg

SEQ ID NO: 180344 - DNA, 638 bp, Homo sapiens
  misc_feature: GYAE6OF01E4LOL.40.65.F10.1.454.CMB.1.raw
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
  modified_base (444)..(444): a, c, t, g, unknown or other
  misc_feature (444)..(444): n is a, c, g, or t
  modified_base (468)..(468): a, c, t, g, unknown or other
  misc_feature (468)..(468): n is a, c, g, or t
  modified_base (488)..(488): a, c, t, g, unknown or other
  misc_feature (488)..(488): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctcatcagcagctagtactttacttcgtggggctggactcccgccaccggcccccgaggggacggggctggaggtggagttgggagttactttaccagtaggtggganctacctactaccacccgtcctacgaaagtcgaggccaccatactaccgtaagaccgaacgtaccaaacgaacctaacttcctaccctaggaacnctagacgtctcgtcggtacgacccgccgacacgaccncggtcttgttaccttattcgtggnggacccggaccggtccccgngtccggctagggtcgtttactttggacgttcgttccgttgtattcgtcggggtcggggactaaagggactaaggtccggtaccctacccgttcttaccgtacctaccgtccccttaccgaacccggaccggtcccaacggtttcccccgg

SEQ ID NO: 180345 - DNA, 643 bp, Homo sapiens
  misc_feature: GYAE6OF01BSW2A.40.65.F10.1.454.CMB.1.raw
  modified_base (315)..(315): a, c, t, g, unknown or other
  misc_feature (315)..(315): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagttacttacttcgtggggctgggactccgccacggcccccgaaggggaacggggctgggagtggagttacgggagttaatttaccagaggtgggacncaacctactaccaacccgtcctacaaaagtcgagccaacatataccgtagacacgtaccaaagaacctaattcctccctagaacgtctgagctctagtcgacccgccgacagacacggctgtactattacgtgtacgcgaccggacccgagccgacgtagttcgttctttttagacgttcgttccgtttagacgttagtcggggtacgggtaacccgaaagggtaacgtaacggttccgggtaccttacccggttccttacccgttacgaacccggttccctaaccccggtaacccggaaccggtccccgtaacggtttccccccggg

SEQ ID NO: 180346 - DNA, 868 bp, Homo sapiens
  misc_feature: GYAE6OF01DMTAT.40.65.F10.1.454.CMB.1.raw
  modified_base (137)..(137): a, c, t, g, unknown or other
  misc_feature (137)..(137): n is a, c, g, or t
  modified_base (214)..(214): a, c, t, g, unknown or other
  misc_feature (214)..(214): n is a, c, g, or t
  modified_base (675)..(675): a, c, t, g, unknown or other
  misc_feature (675)..(675): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcgcgtncgacgaggtcggcccggaccgaagtcgtggaacgaccgtccggttacggacccgtccgttcctacccacctacgtcnctacgtcgttctcggtcgggtctaccctactacgacgacgacgacgtacgttaacgtttaaccctttccgttcggggtacggtccgtacggttcccgacccgacccggacccggacccgggaaggggggtacggtcggtagggtagggttaggtagggttaaggttaacgttaacgtaccgaaggtggggtacggacgtacccttaacgtaaacccgtaacccgtaccccgtaacctaaaacgtaaggtaccgaaccggtacccaaactacgttacccgtaaccgtaacgaaccgtaaccccgtaaaacgaaaccgtaaacctttaacgttccccacccgttaaggccgttaagacggtaccgtcttacggtccggaaccgccccgacgtaacgaccgaaaccgtccgttagtccggtttaaacttcgttacgtggtacccggtaccgggacccgggaccncggtacgagttacgggttattttccggttaacgtacggttccgtttaaacgttgtaagtttcggacgggggttaacccgaagggtaccggttaaactacgggtaaccggttaccccttcggttcccttacgccgtacccccgttaccaaaccccggtacggaaacccccgttgttaaccccggttccccccgg

SEQ ID NO: 180347 - DNA, 559 bp, Homo sapiens
  misc_feature: GYAE6OF01AZ2HV.40.65.F10.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (396)..(396): a, c, t, g, unknown or other
  misc_feature (396)..(396): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcnggggctggactccgccacgcccccgaggggaaggggctggagtggattggggagttatttaccacgagtgggacncacctactaccacccgtcctacaaaagtcgaggacaccatactccgtagacacgtaccaacgaacctatactaccctgaacgctgagtcnctgtcgaccgccgcagacacggtctgtcttatacgtgtcgcgacggccccgagcgacgtagtcggtcttttggattgtcctttgattacggtggtcgggacaagggactaaggtcggtcaccggtcttcgttcacgtccctccaaccgacggccctcgtcccg

SEQ ID NO: 180348 - DNA, 581 bp, Homo sapiens
  misc_feature: GYAE6OF01A6EFC.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgagggaagggctggagtggagttgggagttattaccacgaggtggagcacctactaccaacccgtcctacaaaagtcgagcaccatatccgtagacacgtaccaaacgaaccaacttctaccctagaacgtctagacgctctcgtcgacccgccgcgacgacacggactgtactattacgtgtcgcgacggccccgagcgacagtcgtcttttgattcgtcctttgacgttagtggtcgggtaccgaaagggaccgtaagttcggtactacccggtcttcttaccgacggtccctacccgaccgacgggtcccctaggttccccgg

SEQ ID NO: 180349 - DNA, 686 bp, Homo sapiens
  misc_feature: GYAE6OF01DUFFZ.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagactgggtcctgtcccagctgcagctagcaggagtccgggcccaggactggtgaagccttcggagaccctgtccctcacctgcactgtctctggtgctccatcagcagcagtacttacgtcgtgggctggactccgccacgaccccgaggggaacgggtcgtgggtagtggtagttgggtagttacttaccgagtaggtcgggacgtccaaccgtactaccgtaacccgtcctaacgaaaacgtcgaacggtcaaccgtatacgtaccgtacgaccacgtaacaacgaacctaacttccgtacctagacgtctagacgtcgtacgtcggtacgacccgtcgacacgaccgacgtcttcgtactacgttagtcggtacgacggtaccggccccgagtccgtcggtacggttcggtttaccttttagggactttcggttaccgttttaggtaagttcgggttaggggtacccggggtaacgtaaaggggtacctaagggttccgggttacctacccggtttctccgttaccaacggttcccttaacccgacggtaaccggtccctaggttcccccgg

SEQ ID NO: 180350 - DNA, 742 bp, Homo sapiens
  misc_feature: GYAE6OF01ARS10.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccgttcggacgtaccctcgtccctcacctgcgactgtctcgtggtcggctccatcgacgcacgcgtaacgttacttacgttcgtgggggccttggactcccgccacgaccccggagggacgggctagggagtggtagttgggattaagttacccagtcggtcgggactcacctactacccgaacccgtcctaacgaaagtcggaacgaccacagtactcgaacgacgaccgtaccaaacgtaacctaacttccgaccgtagacgcgtagacgtctcgtcgtaccgcccggtcgacgacgtaccgaccgtacgttcgttaacgttacgttacgtcggttaccgaccggggtaccccgggacccctagggtcccggtaccggttaaggtttccgggtttagtttacggacgttaccggttacgttttagggacttaacggggtcgggttaaccggggacccggttaaagggtaacccgttaaggtccggttaaccccgttacggttccttccggtaacccgtccgtaaccccgttaccccggtaaaccgggacccgggtaccccgttcgggttcccccgg

SEQ ID NO: 180351 - DNA, 922 bp, Homo sapiens
  misc_feature: GYAE6OF01BO52K.40.65.F10.1.454.CMB.1.raw
  modified_base (293)..(293): a, c, t, g, unknown or other
  misc_feature (293)..(293): n is a, c, g, or t
tcagtctagcgactcacgaccggtgctcgatttagctacgctctaagggggatctcatgtgcaagaaaatgaagcacctgtggttcttcctcctgctggtggccggctcccagatgggtcctgtcccagctgcagctgcaggagtccgggcccaggactgggtagaaggccttcggacgaccctcgtcccctcacctgcactgttctcgtggtcgctccatcagcagtactagttaccttacgttcgtcgggtctggacctccgaccgaccggccccggaggggaggcgtggnggtggaggttggtacgttacttaccgcgtaaggtcggggactaccgtaacccgtaaccgtaaccctaacccgtttcccctaaacgaaaaacggtccggaacggaccctaaccgtaacgttaccgtaccggttaaacgaacccgtacccggtaaaccgtaaaacggtaaacccttaacgtttaccccttacccgtaggaaaccgtcgttaacggacgttccgtttacggtcggttaccgaccccggtacccaacggaacccggtaaccggacccgggttactttacgggttaaccctttaagtttaccgtggggtaacccgaccggggtaccccgggaccccggtacgggacccggtacggtttaacggtttcgggttttacccttttttagggaccgttttaacgtttttcgggttttaacgtaacgtttacggggttaccggggtaaccgggggggtaaacccgtaaagggttaaaacccggttagggtttcccggggtttaaaccccttcgggtttaccccggttaacccttttaccggggaaaccccccgttcccccgtttaaccccggaaaacccggggtttacccccgggttaaacccccgtggggttttccccccccccgggg

SEQ ID NO: 180352 - DNA, 748 bp, Homo sapiens
  misc_feature: GYAE6OF01D7B5C.40.65.F10.1.454.CMB.1.raw
  modified_base (74)..(74): a, c, t, g, unknown or other
  misc_feature (74)..(74): n is a, c, g, or t
  modified_base (252)..(252): a, c, t, g, unknown or other
  misc_feature (252)..(252): n is a, c, g, or t
  modified_base (598)..(598): a, c, t, g, unknown or other
  misc_feature (598)..(598): n is a, c, g, or t
tcagtctagcgactcacgaccggtgctcgatttagctacgctctaagggggatctcatgtgcaagaaaatgaancacctgtggttcttcctcctgctggtggcggctcccagatgggtcctgtcccagctgcagctgcgaggacgtccgggcccaggactgggtgaacgccttcggacgaccctcgtccctcacctcgctacgtgtctcgtggtcgctcatcgagcagtacgtagttacctttacgttcggngggctggacctccgaccgaaccggcccggaaggggtaacggggtctagggtaagggtcggtaaggtttacggggtaacgtttaaccttaaccggacggtacgggtacggggaaccacccgttaaccctaaccgtaacccctaaccccggttaccctaaacgtaaaacgggtccgaacggtccaaaccgtactacgtaccgtagaacctaacgtacccaaaacgtaaccctaacgttccctacccgtagaaaccgtcgtaggacctcgtcgttacggccgaaccgccacacgtaccgacggtctacttacgttaactcgtagacgtaccggaccgcccgaacggtcncggttagttcggttcttttcgattcgttacttacggtattgggtacgggtacgggaacggtaacggtaacgtaccgttcggtaccctccggttcttccggtacaccggtaccctacccggaccggtaacccggcccttccgttcccccgg

SEQ ID NO: 180353 - DNA, 721 bp, Homo sapiens
  misc_feature: GYAE6OF01CP4UU.40.65.F10.1.454.CMB.1.raw
  modified_base (141)..(141): a, c, t, g, unknown or other
  misc_feature (141)..(141): n is a, c, g, or t
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
  modified_base (439)..(439): a, c, t, g, unknown or other
  misc_feature (439)..(439): n is a, c, g, or t
tcagtctagcgactcacgaccggtgctcgatttagctacgctctaagggggatctcatgtgcaagaaatgaagcacctgtggttcttcctcctgctggtggcggctcccagatgggtcctgtcccagctgcagctgcaggngtccgggcccaggactggtgaagtccgttacggacgaccctcgtccctcacctgcctactgtctctggtcgctcgatcagcagctagtacttacttcgnggggactcggactccgcctaccgaccccggaggggaacgggccgtggtaaggtggtagttacgggtaacgtttacgttaccgacggtaagggttcgggacnccgtaaccgtaccgtaaccgtaccccggttacctaacgaaaaacggtccggtaacgcaactactacgtaccgtaacgaaccgtaaccaccggtaaaanaacccttaacgttccacccgtagaacgtccgtaggtctccgtacgtcggaccggtacccgccgaacgtacggaccctacggtccgttacgttactacgtttaccgtcgggttacgggaccgacccggggtccgaacggcggtaacgttcggttcggtttctttacggaccgtttgttaccgtttgtaacgtgggtacgtacgggcgaagggttactaacggtgtcccgtacgttccgtactccggtactccccgtaccaccggaccgccttggtacccccgg

SEQ ID NO: 180354 - DNA, 510 bp, Homo sapiens
  misc_feature: GYAE6OF02GHWZP.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgctttgatatgtgggccagggacaatggtcaccgtctcttcagcctccaccaaggcccatccgg

SEQ ID NO: 180355 - DNA, 632 bp, Homo sapiens
  misc_feature: GYAE6OF02G3PUE.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggatccgccacgcccccgaggggaacgggctggagtggagttggggagttatttaccagaggtgggagcacctactaccaacccgtccctacaaaagtcgagcaccatactccgtagacacgtaccaaagaaccctaattcctaccctagaacgtctaggacgtcttcgtacgtcgaacccggccgaccacggaaccgacggcttcggtacttaacttacgtgttacggccggacgggtccccgaaggccgctaaggttcggttccgttttttagacgttcggttccttttagactttaggtggtacggggacccgtaaggggactaaggttcggtacctacccggttcttcgttacaccgtccctaccgaacccgacgggcccctagttccccgg

SEQ ID NO: 180356 - DNA, 607 bp, Homo sapiens
  misc_feature: GYAE6OF02G23SL.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctcatcagcagcagtacttacttcgtggggctggactccgccacgcccccgaggggaacgggcgtaggagtggagttggggagttactttaaccgacgtaggtgggacgcaacctactaaccaacccgtccacaaaacgtcgaggcaacatactccgtagacacgtaccaaagaacctaattctaccctagaacgctggacgtccttcgtgtcgacccgccgacacgacgacggctgtcttagttacgtgtgacgacggccccgagccgacgtaggtcggttacctttttgacttcgtcctttagattagtggtacgggacgtaagggtaccaaggttcggacctaccggttctaccgttcgacgtccctaccgaacccgtaacggtccctagttaccccgg

SEQ ID NO: 180357 - DNA, 561 bp, Homo sapiens
  misc_feature: GYAE6OF02FPF9C.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtcctcaaaagtcgaggcaccatatccgtagacacgtccaagaaccaattctccctagaacgctgagctctgtcgaccgccgcacgacacggctcgtctattactgtcgcgacggccccgagcgcagtcggtctttttgattgtccttttgattagttggtggggacctaaggggacctaaggtcggtaccaacccggttcttacctttcgacgtccctacccgaacccgaacgggcccacgttcccgg

SEQ ID NO: 180358 - DNA, 773 bp, Homo sapiens
  misc_feature: GYAE6OF02I3B5Y.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttacttcgtggggctggactcccgccaggcccccgaaggggaacggggctgggaggtggagttggggtagttatttaccgacgtaggttggggagtaccaacctactaacccgaaccccggtcccctaacaaaaacggtccgaaggccaaccgtaatacgtacccggtaacgaaccgaaccgttacccaaaacggaaaccctaaactttccctacccgttacgaaacggtccttacggacgtaccttcgttacgtacgaaccccggcccgacgaaacggacccgaaccgggtcctacggttaccttaagtttaaccgttggttcgaccggtacccgggcccccgtaaggccgaaccggtacggtttcggttccgtttttttacgaagtttccggttaccgtttttagaagtttacggtacgggttacggggggaaccctaaggggaccaagggtttccgggtacccgtaaccggttcccgttaccgtttaccgtaccgacccgtttacccgaacccgggaacgggttacccccgtaacgtttcccccggg

SEQ ID NO: 180359 - DNA, 828 bp, Homo sapiens
  misc_feature: GYAE6OF02HUDO7.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgccccgagggacgggctggagtggagttggggagttactttaaccgacgtaggtaggggacaccgtaacccgttaacctaaccgaaccccccggttaccccttaacgaaaaaaccggttccggaacgggaccctaaaccccgtaagttaaccgttacccggttaacgaaccccgtaaacccgtaaccccgaaaaaggtaaaaccccttaaactttaccccgtaccccgtaacggtaaacgtccgttaggaacgtcctttccgttacggttacggacccccggtccgaaccgaacgtaacccgaccggtaccttacggtacctttaacgtttaccgttcggttacggaccgggaacccgggtcccccgaaggtcccggacggtacgggttcggtttacgttttttaggaacctttcggttaccgttttagaatttacggtcgggttaccgggggaccgttaaaggggtacctaaacgggttacgggttcccgtaacccgggtttccctttacccgtttaccgaccgttccccttaacccggaaccccggtaaaccgggtccccctaacggtttcccccgg

SEQ ID NO: 180360 - DNA, 563 bp, Homo sapiens
  misc_feature: GYAE6OF02G68SZ.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccacgcccccagggaagggctggagtggattgggagtatttaccactaggtgggagcacctactacaacccgtcctacaaaagtcgaggcaccatatccgtagacacgtccaagaaccaattctacctagaagctgacgctctgtcgaccgccgcagacacggctgtctattactggtgcgacggcccgagcgcagtcggtcttttgattgtcctttgatagtggtggggaccgtaagggactaaggtcggtacctaccggttcttccgtttaccgacgtcccttacccacccggtaacgggtcccctagttccccggg

SEQ ID NO: 180361 - DNA, 790 bp, Homo sapiens
  misc_feature: GYAE6OF02G7B8Y.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttggagaccctgtccctcacctgcactgtctctggtgctccatcagcagcagtacttactctggggctggactccgccacgcccccgaggggaacggggctggagtgggtagttggggtagttacgttttaacccacgtaaggtcggggacgcgtaacccttaccgtaaccgaaacccccgttcccctaacgaaaaacggttccggaacgggaccaacccgtaacgttaacgtacccggttaacgaccgaaccgttacccgaaaggtaaaccctaaactttcccgtaccccgttaggaaacgtccgttaggacggtccttcgttcggttacgaaccccgtcccggtaccgacgaaccgaccgggtctacggttccttaacgtttaccgttggttacggccggtaccggaccccggacgtacccggacgtaacgggttcgggttccgtttttttagacgtttcggtcccgtttttaggtaacgttacggttcggggttacgggggacccggtaaagggggtaaccttaagggttcgggttcccgttaaccggttacccttaccgtttacccgacgtccccgttacccaacccggtaaaccgggtcccctaacggtttcccccggg

SEQ ID NO: 180362 - DNA, 666 bp, Homo sapiens
  misc_feature: GYAE6OF02G1POD.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggactccgccacgccccgagggaagggctggagtggagttgggagttatttaccacgaggtgggagcacctactaccaacccgtccctacaaaacgtcgaacggccaccatactaccgtagacacgtaccaaacgaacctaacttcctacctagaacgtctagacgctcgtgtacgacccggccgacgaacgaccgacggtctacgtacttagttacgtcgtcgccgaccggccccgagccgcgtacggttcggttaccgtttttgacgtttcgttccgttttagaacgttagttacgggtacggggtacccgaaggggtactaaacggttccgggtaacctaccggttcccttaccgtttaccgtaaccgtccccgttaacccgaaccccggtaaccgggtacccccgttaacggtttacccccggg

SEQ ID NO: 180363 - DNA, 956 bp, Homo sapiens
  misc_feature: GYAE6OF02JCO26.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgagggaagggctggaggtggagttggggagttagtttaccgacgtaggtggggacgtccaacccgtacgtacccgaaaccccgtccccttaacgaaaaacggttccggaacgggacctaaccccgaagttacgttaccccggttaaacggaaccttaaacccggtacccaaaaggtaaaaccccgttaaaacgtttcccgtaacccctaaggtaaaaccggtccgttaacggaaaccggttcccttttccgtaacgggtttcccggtaaacccccgggtcccggtaccggtaaacccggaaacccgttacccgggggtaacctttcggggtttaacccttaaaacgttttacccgttacggtttccgggtaaccccgggaacccgggggttaccccccccgtaagggggccccgttaaaaccgggtacggggttccgggtttttaaccgtttttttacggggtacccgggttttcggtttaacccccgggtttttcgttaaggtttaaccggttccgggggtttaagggggggaacccccttaaaggggggttaaaccgtaaacgggtttacgggggttaaccccgttaacccgggtttacccgtttcccggtttaaccggtaacccggtttcccccgtaccccccgggttaaaccccgggaaacccggtttaccccccgtaagggttttcccccccgggg

SEQ ID NO: 180364 - DNA, 635 bp, Homo sapiens
  misc_feature: GYAE6OF02JL4ZM.40.65.F10.1.454.CMB.1.raw
  modified_base (233)..(233): a, c, t, g, unknown or other
  misc_feature (233)..(233): n is a, c, g, or t
tcagtctagcgactcacgaccggtgctcgatttagctacgctctaaggggatctcatgtgcaagaaaatgaagcacctgtggttcttcctcctgctggtggcggctcccagatgggtcctgtcccagactgcagctgcaggagtcgggcccaggactggtgaagccttcggagtaccctggtcccctcacctgcactgtctctggtgctccatcagcagcagtacttactcgngggctggactccgcacgccccgagggaacgggctggagtcggagttggagtattaccacgtaggtcggatcgtacctactacctaacccgtcctacgaaaacgtcgaaggtcactagtactccgtagtacacgtaccaagtaacctaattcctacccgagaacgcgtagacgtctacgtgtacggaccgtccgcgacgaccgtacgcgtgtactattacgtgtcggacgacggccccaggccgacgacgtcgtacgttttcgagtcggttccttaggacttacgtcgggttacgggacccgtagggtaccgaggttcggtacccgttaccggttccttaccggttaccgtaccggtacccgtcccgtaacccggtaaccggtcccgttaaccgttccccggg

SEQ ID NO: 180365 - DNA, 929 bp, Homo sapiens
  misc_feature: GYAE6OF02HFCLE.40.65.F10.1.454.CMB.1.raw
tcagtctagcgactcacgaccggtgctcgatttagctacgctctaagggggatctcatgtgcaagaaaatgaagcacctgtggttcttccctctgcgtggtcggcggcctccagtagttcgggtcctccgtcccagcgtcgacacgtcgtcgacggagggtacgggtcccgggacccgaagggtacgttggtaggaaccgttcccgttacgggacccgtacccgttccgttacccctacctaccgtcgacctaccgttcgtccttcggttgggtccgtaccctacctatcgacggcacgctaacgtttaccttcgttcgggtcgggtctacggacctccccgaccgaccccgaccccgggaagggggaccgggtcggtagggtacggttagggttagggttacggggtaacgttttaaccgtttaacccgaacgggtaggggttacgggaccgacccgttaaacccgttaaccgtaaccccgttaaaccccccgttacctaaaaccggtaaaacgggtccggaaccggaccctaaaccgttacgttaaccgttaccgaacggaacccgtaaccgtaaccgaaaaccgtaacctttaaaccttcccgttaaccgaaggtaaccgtcttaacggaccgttacctttcggtacgtacccgacccggaccgaacgaacggacccgtcggtactttacgtaccttagtttacggcggacgtacccgggacccgacccgtaggcccggtagtaggtttccggttttacgttttacgtaacggttcccgttttacgtttaagaccgtttaggccgggggttaacgggaaccggttaaggaaccgttacgggttaccgtacccggttaacttccggtacccttaccggccgtttaccccgacgtaaaccccgggcgttacccgtccgttacccccgg

SEQ ID NO: 180366 - DNA, 654 bp, Homo sapiens
  misc_feature: GYAE6OF02J0JHN.40.65.F10.1.454.CMB.1.raw
  modified_base (196)..(196): a, c, t, g, unknown or other
  misc_feature (196)..(196): n is a, c, g, or t
  modified_base (498)..(498): a, c, t, g, unknown or other
  misc_feature (498)..(498): n is a, c, g, or t
  modified_base (519)..(519): a, c, t, g, unknown or other
  misc_feature (519)..(519): n is a, c, g, or t
tcagtctagcgactcacgaccggtgctcgatttagctacgctctaaggggatctcatgtgcaagaaaatgaagcacctgtggttcttcctcctgctggtggcggctcccagatgggtcctgtcccagctgcagctgcaggagtcgggcccaggactggtgaagccttcggagacctgtccctcacctgcactgtcncgtggtggctccatcagcagcagtacttacttcgtggggctggatcccgaccacgccccgaggggaacgggctgggacgtagggacgttgggagttatttaccgacgtaagggtgggaagacacctaacgtaaccgaaccccgttccccaaagtaaaacggtcgaacgggcctaacccaatacgtaccgtaagaccaccgtaaccaaacgaaccgtaaattccgtacctaggtaacgctaggaacgtccttgacggtcgacccgcggactaacgacgaccgcgtacgtactaactttaccgnggtacgaccggaccgtcccgngccgacgtaggttcggttactttacgacttcggttctttaagtacgttaggtcgggtacggacgaggtacgtacgtcggtacctccgttcgtactccgtaccgtccctaccgaccggaccgtaccgtacgtcccg

SEQ ID NO: 180367 - DNA, 616 bp, Homo sapiens
  misc_feature: GYAE6OF02F7EDP.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccgaggggaaggggctggagtggattgggagtatttacacgagtgggacgcacctactaccaacccgtcctcgaaagtcgagcaccatatccgtagacacgtccaagaacctaattcctaccctagaacgcttggagccttcgtcgtcgacccggccgaccagaccgaccggtcgtcgttacttaacgttacttggtcgaccggacgggacccccggagccgtcgaggttcggtacgttttttgagttcgtccgttttgaattgttcgggtggggacccgtaaggggactaaggttcggttaccgacccgttcttccgttacgacgtcccttaccgaacccgtaacgggtcccctagttccccggg

SEQ ID NO: 180368 - DNA, 709 bp, Homo sapiens
  misc_feature: GYAE6OF02GEORK.40.65.F10.1.454.CMB.1.raw
tcagtctagcgactcacgaccggtgctcgatttagctacgctctaaagggggatctcatcgtgcaagaaaattgaagctacctgtggttcttcctcctgctggtggcggctcccagatcgggtcctgtcccagctgcagctgcaggagtcgggcccaggactggtgaagccttcggacgaccctgtccctcacctgcactgtctctggtgctccatcagcagcagtaccttacttcgtggggctggactccgcccacgcccccgaggggaacgggctgggacggtggattggggagttacgttttaccgacgtaggtaggggacgcctaaccgtaacctaaccgaaccccgttcccctaaccgtaaaacgttccggaacggtaccacctaatacgttccgtaacgacccaaccggtaacccaaacgaaaccctaactttaccttacccgtaacggtaaacgtccgttaggacgtaccttcgtcggtcgaacccggccgactacggacgtaccggtccttcgtactttaacttccgttagtcggacgtaccgggtccccggaggtccgcctagggttcggttcttttagtacgttcgttactttcgtaagtaggttcggtcggggtacgacgggtacgtaacggtggttacgacgttaccgttcgtttccgttactaccgtccctaccgaaccggtaccggccttaccgg

SEQ ID NO: 180369 - DNA, 715 bp, Homo sapiens
  misc_feature: GYAE6OF02H24RW.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggatccgccgacgccccgaggggaacgggcgtggagtggagttgggaagtatttaccacgaggtggacgacacctaactaccaaccccgtcctaacgaaaacgtcgaggaccaacctaatacgtaccgtaagaccgaaccgtaccaaagaacctaaattccgtaccctagaaacgctagacgcctacgttcgacgaccccgccggaccgtaacgaaccgaacgggtctcggttaccttaagttacgtggtacgccggacgggcccccgagccgacgtaacggttcggttacgtttttaggaactttcgttacccttttagtaaccgttaagtccgggttacgggggtaacccgaaacggggtaacgtaaacggtttccgggtaacccgttaacccggtttccttaccccgttttcgaccggttaccccgtaacccgttaacccgggaacccgggtacccgtaccgtttacccccgggg

SEQ ID NO: 180370 - DNA, 774 bp, Homo sapiens
  misc_feature: GYAE6OF02GNR0P.40.65.F10.1.454.CMB.1.raw
  modified_base (232)..(232): a, c, t, g, unknown or other
  misc_feature (232)..(232): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcggcccaggactggtgaagccttcggagaccctgtccctcacctgcactgtctctggtgcctcatcagcagctagtacttacgttcgngggctggactccgccaccgccccgaggggaacgggcgtggaggtggtagttgggtacgttaactttaccgacgtaggtacgggacgtaccgtaacccttaactaacccgtaaaccccgtcccgtaaacgaaaaacggttccggaacggacctaacccgtaataacgtaccggtaacgaacgtaaccgtaaccaaacggaaaccttaacttccctaccgtagaaacgcgtagacgtctacgtgtaccgaccgcgacacggacctacggtctacgttactaacttacgttcggtacgaccgggacccgtacccggagtaccgacgttacggttacgttcgtttttacgagtttaccgttccgttacgtgttaaacggttcgggggtaccgggtaaccggtaaacggtaaccgttaacgggtttcccgggtaaccgttacccggtttacccttttaaccggttacccgtaccccggttacccgtttaaacccccggaaacccggggttaacccgggtaccccgtttaacccggtttaccccgggg

SEQ ID NO: 180371 - DNA, 670 bp, Homo sapiens
  misc_feature: GYAE6OF02FUOGZ.40.65.F10.1.454.CMB.1.raw
tcagtctagcgactcacgaccggtgctcgatttagctacgctctaagggggatcgtcatgtgcaagaaaatgaagcacctgtggttcttcctcctgctggtggcggctcccagatgggtcctgtcccagctgcagctgcaggagtcggcccaggactggtgaagccttcggagaccctgtccctcacctgcactgtctctggtgctcatcagcagcagtacttacttcgtggggctggactccgccacgcccccgaagggacgggctagggagtcggattgggagttactttaccgaacgtaggtcgggacgccgtaaccgtactaaccgaaccccgtacccctacaaaaacggtccgaacggcaacctagttactccggtaagaaccgtacgtaccaaacgtaacctaacttcctacccgtagaacgtcctaggaacgtccgttactggtacgacccgccggtacgaacgaccgacggtcttcgtacttaacgtttacgtgttacggcgaaccggcccgaagccgtacgtaggttcggttactttttggacttcggttccgtttagactttaggtcgttacggggaacctaagggactaacgggtcggtacctaccggttctaccgttacgacgtccctaccgaaccggacggtccctaggttccccgg

SEQ ID NO: 180372 - DNA, 586 bp, Homo sapiens
  misc_feature: GYAE6OF02F27Y2.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgaggggaacggggctggaggtggagttgggagttatttaccacgaggtgggagcacctactaccaacccgtccctacaaaagtcgaggcaccatactccgtagaccacgtaccaaagaaccaattcctccctagaacgctgacgctctgtcgaccgccgacacgacgacggctcgtactattacgtgtcgcgacggcccgagcgcgaggtcggttctttttgagttcgtccttttgacttagtggtcggggaccaagggacaaggttcggtacctacccggttcttccttcgacgtcccgtaccgaccgaacgggtcccctagttccccgg

SEQ ID NO: 180373 - DNA, 699 bp, Homo sapiens
  misc_feature: GYAE6OF02FIGO2.40.65.F10.1.454.CMB.1.raw
  modified_base (272)..(272): a, c, t, g, unknown or other
  misc_feature (272)..(272): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccgttcggacgaccctgtccctcacctgcactgtctcgtggtgctcatcagcagctagttacttacttcgtgggtctggtactccgccacgcccccgagggacgggcnggagtggagttgggagttacttaccgacgaggtagggagctaacctaacctaccgaaccccgttaccctacaaaacgtcgaacggcaacctatactaccgtacgactaccgtaccaaacgaacctaacttacctccgtagaacgtctcggaacgtcctcgtcgtaccgacccgccgacgacgaaccgcggtcttacgtcttaacgttacgtgtacggaccgaaccgggcccccggagccggacgtacgggttcggttcgttttttacgcgtttcgttacggttttgaacgttaggttcggggtaggggacccgtaaagggtaactaacgggttccggtaccggtacccgtttccgttacgttacccggtacggttaccccgtaaccccgaacccgggtaacgggtaccccttcggtttacccccggg

SEQ ID NO: 180374 - DNA, 828 bp, Homo sapiens
  misc_feature: GYAE6OF02HA2YW.40.65.F10.1.454.CMB.1.raw
tcagtctagcgactcacgaccggtgctcgatttagctacgctctaagggggatctcatgtgcaagaaaaatgaagcacctgtggttcttcctcctgctggtggcggctcccagatgggtcctgtcccagctgcagctgcaggagtcgggcccaggactggtcgaagtccttcggacgaccctcgtccctcacctgctacgtgtccgtcgtgggtcgcctcactcgacgcacgactaacgttaccttacgttcggtggggtctacggacgtccgccgaccggtcccggaagggggacgggtcgtaggtaggtaggtacgttagggtaacttaccgtacgacgtagggtcggaccgtacctaacctacgtaacccgtaacccgtacctaacgtaacggacgacgaccaactacgtacgtaccgtaacacgtaccgtaactaaccgtaacttaccgttacctaccgtagaaccgtactacggtaccgtaccttacggtccgtaacccgcccggacgtaaccggaacgtaccggttaccgtacgtttactaacggtttaccgttacggtacggtaccggggccccgggtaacccgtccgggtacggtaccggttaccgggtttacggtttacggtttaccgtttacggttaccggtttccgggttaacgttacgggttacgggtaccggtaacgggggtaccgtaaacggtacgtacggttaccgggttcccttaccggtcccgttaaccgttaccggaccccgtacccggttaacccggaacccgggttacccccggtaaccggtcccccggtttaccccggttacccccg

SEQ ID NO: 180375 - DNA, 541 bp, Homo sapiens
  misc_feature: GYAE6OF02FY3LB.40.65.F10.1.454.CMB.1.raw
  modified_base (293)..(293): a, c, t, g, unknown or other
  misc_feature (293)..(293): n is a, c, g, or t
tcagtctagcgactcacgaccggtgctcgatttagctacgctctaaggggggatctcatgtgcaagaaaatgaagcacctgtggttcttcctcctgctggtggcggctcccagatggggtcctgtcccagctgcagctgcaggagtcgggcccaggactggtgaagccttcggagaccctgtcccctcacctgcactgtctctggtggctccatcagcagcagtacttacttctggggctggatccgccagcccccagggaaggggctggagtggattgggagtatttaccanagtggagcacctactacaacccgtcctacaaaagtcgagcacatatccgtagacacgtccaagaaccaattctccctagaacgctagagtctcgtgtcgaccgccgcgagacacggctgtctatactgtgcgacggcccgagcgcgagtggtctttttgagtgtcctttgattacgtggtcgggaccaagggacaagtcggtaccaccgtctacgttcacgtcctaccaccgaacgggcccagtccgg

SEQ ID NO: 180376 - DNA, 774 bp, Homo sapiens
  misc_feature: GYAE6OF02GQN1V.40.65.F10.1.454.CMB.1.raw
  modified_base (235)..(235): a, c, t, g, unknown or other
  misc_feature (235)..(235): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggacctggtgaagccttcggacgaccctgtccctcacctgcactgtctcgtggtggctccatcagcagcagtacttacttcgngggctggactccgccacgcccccgaggggaacgggctggagtcggagttgggagttacgtttacccactggtacgggagccgtaacctacctaaccctaaccccgttaccctacgaaaaacgtcccggtaagggacctaaccaacttaacgtaccggttaacgaccgtaccgtaaccgaaacggtaacctaaactttcctccccttagaaacgtctagacgtccgtttacgtcggtacgtacccgacccgacgacggtaaccgtacccgggactttacggtttaccttaacgttttaccggtacgggtttacgaccgggaaccgggcccccgtaagggccggcgttaacgggttcgggtttactttttttcggaacggtttcggtttcccgtttttgggaacgttttacgggttcggggtacggggtaaccctaaggggggtaactaaacggtttcggaccgtaacccgggttccttaccggtttaaccgtacgtaccccgtacccaaccgggtaccggacccctaggtttccccccgg

SEQ ID NO: 180377 - DNA, 774 bp, Homo sapiens
  misc_feature: GYAE6OF02J0NFY.40.65.F10.1.454.CMB.1.raw
  modified_base (546)..(546): a, c, t, g, unknown or other
  misc_feature (546)..(546): n is a, c, g, or t
tcagtctagcgactcacgaccggtgctcgatttagctacgctctaaggggggatctcatgtgcaagaaaatgaagcacctgtggttcttcctctgctggtggcggctccagatcgggtcctcgtccagctgcagctgcgagggtacggtccgggcccgagggcgtgggtcgaacgtccgttacgggacgtaccctcggtcccctacacctgctacgttgtcctcggtggttcgcctccatcagactacggctaagttaccgttacgttcgggtggggtactcggtacgcccgccgaccgacccgggaggggagggtcgtagggagtcggtagttagggtatttactaccgtacggtaggtgggtacctcgtaacctaaccttacccgaaccccggttacaaccgtaaaaggtcgaccggtaccgtacctaagttaccgtaggtaaccgccgtaaaccggtaccaaacgttaacccaaccttcgtaccggacgtaacgtactaggtacctcgtcgtacggccgaccgtcgacgtacgacgggtaccnccgttataccgttatacggtcggcgaccggacggtacccgagttcgccggttaagtttcggtttacgtttacgtacggttcgttccgttaagtgtacggtacggggtccgggaaccggttaggaacttacgggtcccggttaccttaccggtaccttttaccggaccttacccggttaaccccgacggtaacccccgggttacggacccgtttacccggttcccccgg

SEQ ID NO: 180378 - DNA, 670 bp, Homo sapiens
  misc_feature: GYAE6OF02JHUD3.40.65.F10.1.454.CMB.1.raw
  modified_base (496)..(496): a, c, t, g, unknown or other
  misc_feature (496)..(496): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtggctccatcagcagcagttacttacttcgtgggctggactccgccacgcccccgaggggaagggctgggagtggacgttgggagttactttaccgactagggtgggagcacctactaaccaacccgtcccacaaaacgtcgacggaccaacactactccgtaacgacacgtaccaaacgaacctaattacctacctagaacgctacgacgtctcgtggtcgacccggtccgacaacgaaccgacggtcttacgttcttaacttacgtgtcgaccggaccggtcccgagccgngtaacggtcggtttacgtttttgacgttcggttccctttaggaacgttaggttgggttaccgggggtaaccgaacgggtaacgtaacggttcgggttacccgtaccggttaccttccgttaccaccggttaccctacccgtaaccggaaccgggtcccctaaggtttcccccgg

SEQ ID NO: 180379 - DNA, 706 bp, Homo sapiens
  misc_feature: GYAE6OF02HTPHF.40.65.F10.1.454.CMB.1.raw
  modified_base (449)..(449): a, c, t, g, unknown or other
  misc_feature (449)..(449): n is a, c, g, or t
  modified_base (590)..(590): a, c, t, g, unknown or other
  misc_feature (590)..(590): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcgaggaggtccgggcccaggacgtggtagaacgtccgtttcggacgacccttcgtcccctcacctgcactcgtctcgtggtgctccatcagcagcagttacttacgttcgtgggctggactccgccacgccccgagggacgggctggagtggagtggtagttacttaccagtaggtgggactacgtaccttaaccgtacctaaccccgtcctaacaaacgtacgaacggtcaccatacgtaccgtaagaccgtaacgtaccaaacgtaacctaattacccgtaccgtagaacgtcgtaggcgtcgtttaccncggtaccgacccgccggaacgtaagacccgtaccggtcttacggttactttacgtttacgtcggttcggtaccgggaccggtaccccggagcccggaagttcgggttcgtttcgttttacgacgtttccgttaccgtttanacgtttggtacgggtacgggtacgtacgggtaactacggtcggttacccaccgttccgttaccgtcctacccgacccgtacccgacccggtaccggtccccgtagtttacccccgg

SEQ ID NO: 180380 - DNA, 842 bp, Homo sapiens
  misc_feature: GYAE6OF02JWD2Y.40.65.F10.1.454.CMB.1.raw
tcagtctagcgactcacgaccggtgctcgatttagctacgctctaagggggatctcatgtgcaagaaaatgaagcacctgtggttcttcctcctgctggtggcggctcccagatcgggtcctgtcccagctgcagctgcagggacggtccgggcccaggactcggggtagaacgtccttacggggacaccccttggttcccctacaccgtgctacgttcgttctccgtgggttcggccttaccattcgagccaggtcctaggtttaccttccttcggtggggccttcggactcccggaccacggcccccgtaggggacgggctaggacggtggtagtcgggtagtacgttaccgagtaggtcggacgtccgtaccttaaccgtacctaacccggtcctaacctaacggtcgaacggaccaccgtactacgtccgtaacgtaccgaccgtaaccgaaacctaaccgtaaccgtttacgtaacccgtaacgggtaaactccggtaacgtaccgaccgtttaccgttccggttaccgaaccccgggtccaacggaccggtaacccgtaccgggacgttttaccgtacgtttaacgtttaccgggtaacttcgggtcccggttaacccgggaccccgtacggtccgaaccggttaacggttcggttaccgttttgttaacccggttggtttaacccggtttcggttaagttaaaccggtttacggggttcccgggtaaaccggttacgggtaaccgttaaccgggttaacggtccgttaaccgttccgttaccgttaccgtacccgtaacgtccccgtaaccggtcgtacccgtcccgttacccgg

SEQ ID NO: 180381 - DNA, 713 bp, Homo sapiens
  misc_feature: GYAE6OF02FPR03.40.65.F10.1.454.CMB.1.raw
tcagtctagcgactcacgaccggtgctcgatttagctacgctctaaggggggatctcatgtgcaagaaaatgaagcacctgtggttcttcctctgctggtggcggctcccagatgggtcctgtcccagctgcagctgcagggagtcgggcccaggactggtagaagccttcggagaccctgtccctcacctgcactgtctcgtggtggctccatcagcagcacgttacttacttcgtgggctggactcccgccacgccccgaggggtacgggctggagtggagttgggaattacttaccagtaggtgggaacgctaaccgtactaacctaccccgtcctaacgaaaacgtccggacgaccaacctataacgtccgtaacaccgtaccgtaccaaacggtaaacctaacgttcctcccgtagaacggtctaggtactccgtcgtaggtccgaacccggtccgaccgacggaccgtcccggtacgttcggttaccttaacgttaccggtcggttacggtacccgggtaaccgggcccccgaagggtccgtaccggtagggtttcggtttacgtttttgactttacgggttccttttagtaacgttcggttgggaccggggtacctacggggtaacaggttcgggtaccctacccgttcttacccgttacggcccgtacccgtaccgaaccggaccggtaccctagtttcccccgg

SEQ ID NO: 180382 - DNA, 777 bp, Homo sapiens
  misc_feature: GYAE6OF02I3NLX.40.65.F10.1.454.CMB.1.raw
  modified_base (333)..(333): a, c, t, g, unknown or other
  misc_feature (333)..(333): n is a, c, g, or t
  modified_base (438)..(438): a, c, t, g, unknown or other
  misc_feature (438)..(438): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcgaggagtccgggcccaggacctgggtgaacgtccgttacgggacgtacccctcgtcccctacacctgccactgtctcgtggtcgctccgatcgagcagcagttacttcttcgcgggctggactccgccgaccgaccccggaggggagggccgtaggacgtggagttgggaacgtacttaccgacgtagtacgganccaactaccaccgtaacccgtccgtaacgaaacgtcgaacggccaaccgtagtacctacggtacgaccgaacgtaaccaaacgaacctaacttcccgtaccgtanacgtacctacggtactccgttaagtcgacccgtacccgacccgtacgaaccggaccgtaccgttacgtacgttaccgtacgttacggtcggtacgtacccgggaacccgggtccccgacgggtaccgtacggtccgggtttacggtttaccggtttgaccgtttcgtttcccggtttagtaaggttcggtacggggttaccgggaaccgttaaaggggaccgttaacggggttaacccggttaccgtaccgggttttacccgtaacccgtccgggttaaccctcccccgtttaaccggaaacccggggttcccgtaccccggttaacggtttcccccgg

SEQ ID NO: 180383 - DNA, 792 bp, Homo sapiens
  misc_feature: GYAE6OF02IFK5K.40.65.F10.1.454.CMB.1.raw
  modified_base (282)..(282): a, c, t, g, unknown or other
  misc_feature (282)..(282): n is a, c, g, or t
tcagtctagcgactcacgaccggtgctcgatttagctacgctctaaggggggatctcatgtgcaaagaaaatgaagcacctgtggttcttcctcctgctggtggcggcctcccagatcgggtcctgtcccagctgcagctggcgagggagtccgggcccaggacgtggtagaacgccgttacgggactacccgtcgtccctacaacctgcctacgttcgtcgtcgttggacgctccatcacgcagtacacgttaccttacgttcggcgggtactcggtaccncccgacccgaccggaccccgggaaggggacgggtcggtagggacgttagggtaggttacgggtaacttaccgttaaccaacggtacggggtacggtaacgtaaccgtaacccgttaaccgtacccgtaaaccccgtccgtaaactaaaacggtccgggaacgacttaacccgtaagttacgtaacccgtaacgaacccgttaccggtaacccaaaacgtaaacctttaacggttccctaacccgttaagggtaacctcgtacggacttcgtacgtagtacccggacccgacgcgaacgaccgacgttcgtaccgtactacttacggtcgtcggaccggaccgaccggtcgtacgtacgtagttcgttttgttacgtaagttccgtttacgttaaggtacctagggtaccgggtacggaacggtaacgtaacgtacgtccggttacctacggttaccttacttaccgtaccgaccctaccggtaaccggtccggttacccgcgttacccgg

SEQ ID NO: 180384 - DNA, 795 bp, Homo sapiens
  misc_feature: GYAE6OF02HQZ5J.40.65.F10.1.454.CMB.1.raw
  modified_base (113)..(113): a, c, t, g, unknown or other
  misc_feature (113)..(113): n is a, c, g, or t
tcagtctagcgactcacgaccggtgctcgatttagctacgctctaagggggatctcatgtgcaagaaaatgaagcacctgtggttcttcctcctgctggtggcggctcccagntgggtcctgtcccagctgcagctgcagggacgtccgggcccaggactgggtgaacgtccttcggacgtacccctcgtcccctcaccgtgctaccgttcgtctcgtgggtcggccttaccatcgagctagctacgttacttacgttcggtcgggtctacggacctccgaccgtaccggacccccggaagggggtaacgggcggtagggacggttaggtacgttagggtagttaacgttaaccgacgtagggtcgggacgtacctaccgtaaccgtaccgtaaccccgttacccgtaactaaacggtcgaacgacctaacctaacgtaccgtaccgtaacgaaccgtaccgtaaccgaaacgaaccttaacgtttaccgtccgttaagacgtacctaagaccgtccttcgtaggtaccgcccgaccacgtaacgacgacgtgttacgtcgttaagttacgtcgtacggaccggacggacccgtagccgacggttaggtttcggtttacttttagacgtttcgttacgttttacgtacgtaggtaccggggttacggggtaaccgtacggtacgtttaaccgggtcggtaacccgtttacccggtacctttacgttacccgtaccggttacccgttaacccggaacccggtttaacccgggtccccgttacgggtttacccccgg

SEQ ID NO: 180385 - DNA, 570 bp, Homo sapiens
  misc_feature: GYAE6OF02GPGTO.40.65.F10.1.454.CMB.1.raw
  modified_base (468)..(468): a, c, t, g, unknown or other
  misc_feature (468)..(468): n is a, c, g, or t
  modified_base (498)..(498): a, c, t, g, unknown or other
  misc_feature (498)..(498): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgccactgtctcgtggtgctccatcagcagcagttacttacttcgtggggctggactccgcccacggccccccgaggggaacggggctgggagtggagttgggagttatttaccacgaggtgggagcacctacaccaacccgtccctacaaagtcgagcaccatactccgtagaccacgtaccaaagaaccaattcctaccctagaacgtctgacgtctcgtcgtcgacccgccgcaacgacacggctgtactattactgtcgcgacggcccgagcgcngtcgtcttttgactgtctttgatgttcggngggaccgaggactaagtcggtactaccgtcttcttaccgacgtcctaccacccgacggtcccacgttcccgg

SEQ ID NO: 180386 - DNA, 723 bp, Homo sapiens
  misc_feature: GYAE6OF02HWQ0V.40.65.F10.1.454.CMB.1.raw
tcagtctagcgactcacgaccggtgctcgatttagctacgctctaagggggatctcatgtgcaagaaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagcagttacttacttcgtgggctggactccgaccacgaccccgagggaacgggctaggacggtggagttgggaattactttaacccgaagtaggtgggacgacctaaccgtaacctaaccaaccccgttacctaacgaaaaacgttcgaacggtaccaacctaagttaacgtaccggttaacgacctaaccggttaccaaaacggtaaaccctaaattacccgtacccgtaagtaacgtcgtaacgtctacgtcgtacgaacggtacccgacgaccgaacgaccggtacgtcgtacgttacttaacgttacgtaggtaccggtacggacccggacccgcggacgtaacggtaggttccgttttagttacgtagtttccgttacgttacgtaacgtaggttacgggtaccgggaacggtaacgtacgttacggtacgttaccgtaccgttcttaccgtacgtcccttaccgtaacccgaaccggtaccgtaccgttacccgtaccccg

SEQ ID NO: 180387 - DNA, 765 bp, Homo sapiens
  misc_feature: GYAE6OF02FKIF7.40.65.F10.1.454.CMB.1.raw
  modified_base (218)..(218): a, c, t, g, unknown or other
  misc_feature (218)..(218): n is a, c, g, or t
tcagtctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtccgggcccaggactgggtgaacgccttcggacgaccctgtccctcacctgcactcgtctctggtgcctccatcngcagcagttacttacttcgtgggtctggactccgcctacgccccgaggggtagggcgtggacggtggtacgttggggacttacgtttaccgacgtaggtgggacgaccaccttaacgtaaccgaaccccgttccctaacgtaaaacgtcggacggtaccaaccgtatacgtaccgtacgaccgtaaccgtaccaaacgtaacccgtaactttacccgtcccgtaggaacgtccgttacggacgtacccgttcgtacggtaccggaaccccgcccggaaccgtacgaaccgtaccggtcttcgtacctttacgttaccgtcgggtcgtacccggggaccgccccggtagtccgaccgttcgggtttacggttccgtttttaggacttttcggttacccgtttagtaactttcgggttacgggtccggggtaacctaagggtaacccgtaagtttcccgggtacccttacccggttaccttacccggttcctaaccggttcccctaaacccggcccggtaaccgggttcccccaggttttcccccccgg

SEQ ID NO: 180388 - DNA, 574 bp, Homo sapiens
  misc_feature: GYAE6OF01CR0U1.10.52.E08.1.454.CMB.1.raw
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgctccgaggggaaancgccaccctctcctgcagggccagtcagagtgttaaacaacaactacttagcctggtaccagcagaacctggccaggctcccaggcctcctcatctatgatgcatccagcacgggccacgtcggcactcccagacaggttcaggtcggcaggtgggtctgggacagtactcactctacacatcagcagctggacnctagaagtntttgcgtagtcgtattctgtacagtactagttagtcgggtaccgccccggtcggtcttacggtagggttccgggacgggtaacgggacccgtaagggttacgaacggtaacgtaccgaaaacggtacgtagggtacgtccgttacgaccctaaccgtgttccgttaccg

SEQ ID NO: 180389 - DNA, 768 bp, Homo sapiens
  misc_feature: GYAE6OF01CTH5D.10.52.E08.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagcatagtagtgcacgaccggtgctcgatttagtcgagctctcagagaggaaagggggagctgctcagttaggacccagagggaaccatggaaaccccagcgcagcttctcttcctcctgctactctggctccaggtaccaccggagaaattgtgttgacacagtctccaggccacctgtctttgtctaccgaggggaaanacgccaccctctcctgcgagggccagtcagtagtagtaaacaacaactacttacgcctaggtaccagcaagaaacctggaccaggctccaggcctaccnatctatgatcgcatccagcgacgggccagtcggcctactacccgagaactaggttacgagtcgggacagggttcgggtcgtaggggactaacggtaaccttcgaaccttcctaccgaacctacgtaccaacggaccgaacgtaccggttacgggaacgtacccgttaaggtaaacggttagtttttcggaaccgttaaggtttacgtttaactttaacggttacggttacaacggtacgttaaacggttaggttccggggttacccgccccccgggttacgggtacccgtttaccgggttaacggggtttcccgggggaacccggggtaaacgggggtaaaccccgggttaaaggggtttaccggggaaacgttaaacccgttaaaccgggtaaaaacccggttaacgggttcggggtaaccgggtccgttacgggtaaccctaacccgtacgtttcgttacccgg

SEQ ID NO: 180390 - DNA, 174 bp, Homo sapiens
  misc_feature: GYAE6OF01AXITU.10.52.E08.1.454.CMB.1.raw
  modified_base (169)..(174): a, c, t, g, unknown or other
  misc_feature (169)..(174): n is a, c, g, or t
tcagcatagtagtgcacgaccggtgctcgatttagtcgagctctctcggcgggggttttcggcggagggaccaagctgaccgtcctaagtcagcccaaggctgccccctggtcactctgttcccgccctcctccactactatgctgagcgggctggcaaggcgcatagnnnnnn

SEQ ID NO: 180391 - DNA, 579 bp, Homo sapiens
  misc_feature: GYAE6OF01B2PHP.10.52.E08.1.454.CMB.1.raw
  modified_base (201)..(201): a, c, t, g, unknown or other
  misc_feature (201)..(201): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgtctccaggggaaangccaccctctcctgcagggccagtcagagtgttcgctacttcggttagggtggtatcaacataaatccggccaggctcccaggctcctcatcttgatgctttcaacacgggcccctggccgtcccaggcaggttcagtggcaggtgggtctgggacagacttcactctcaccatcagcagcctagagcctagaagtatttgctagtttatactgtcagtcagtcgtgcctacgtttcgggcggtaggtcgccgtacgtttcgggacgggtaacgggaaccgtaaagtacggtacggtacgaaaaccggtaacgttaggtacggtcgtacggccaccgtattccgttcgttccttactacgttcccttccccgtacccg

SEQ ID NO: 180392 - DNA, 721 bp, Homo sapiens
  misc_feature: GYAE6OF01CR444.10.52.E08.1.454.CMB.1.raw
  modified_base (200)..(200): a, c, t, g, unknown or other
  misc_feature (200)..(200): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggccacctgtctttgctccgaggggaancgccaccctctcctgcagggccagtcagagtagttaaacaactaactacttacgcctggtaccagacagaaacctggaccaggcctacccagacctcctcatctatgatcgctatccagcgagggccacgtcggaccactaccccgagaccgtacggttcaggtcggcgtacggtgggtcgtaggggactacggtacctttacgaccttcctaccgtaacctactaaccgaaactacggtaacccgttaacggtaaacccgttaggtaaacgtttactttttacggacctttttaaccgtttttacgtttcccgttacggtttacccaaccgtaacggttaccgttacccgactaaaccggttccggtaccccgttacccgggttaccgttacccggggaacccggtaacgggggtaccctaggggtaccggaaggtacacggtaacggaaccggtacggttcgggtccggaccgggtactaacccgtagttaccgttcgttaccttcgtccgttaccccg

SEQ ID NO: 180393 - DNA, 764 bp, Homo sapiens
  misc_feature: GYAE6OF01BDYWX.10.52.E08.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (596)..(596): a, c, t, g, unknown or other
  misc_feature (596)..(596): n is a, c, g, or t
tcagcatagtagtgcacgaccggtgctcgatttagtcgagctctcagagagaaagggggagctgctcagttaggacccagagggaaccatggaaacccagcgcagcttctcttcctcctgctactctggcctcccaggtaccaccggagaaattgtgttgacacagtctccaggcaccctgtctttgcctccgaaggggaanacgcccacctctcctgcgaggccagtcaagagtgttaacaacaactattagcctggaccagcaagaaaccgtggccaggctacccaggcctccnctatctactgatgactatccagaccgacgggcccaacgtcggactactcccgaagaccgtaggttcacggttcggacgtaggtcggggttcgtacggggacaacgggttacctttccaaccgttcctacgtaccctattaccgacgtaccgaaggtaccgtacggggtacgaccgttaggaaacgttttaagtttacgggtacccttaagggttaacggttttaacttttaaaccggcgggttttaacccaaggggtcttaagggttaacggtttccggggtacgttaacccccccgggngggttacccgttccggtaacggggtttttacccggggacccgggtaaacggggttaccgttaaaccggggtttacggaaacggggtaacttaccggtaaaaaccgtacggttaccgggtacgggtaccgtaccggtaacgtaccccctaaggttccgtttaacccggg

SEQ ID NO: 180394 - DNA, 550 bp, Homo sapiens
  misc_feature: GYAE6OF01BVI0Y.10.52.E08.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (402)..(402): a, c, t, g, unknown or other
  misc_feature (402)..(402): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgctccaggggaaangccaccctntcctgcagggccagtcagagtgttaaacaacaactacttagcctaggtaccagcaagaaacctggccaggcctcccgaggctcctcatctatgatgcatccagcgacgggccacgtggcactccagacaggttcagtggcaggtgggtcgtgggacagtacttcgacttctacgacatcagcagtacgtgganccgtagtaagtatttgctagtatacttagtgtacagtactagtagtcggtcgccccgtcgtctcgtacggttcgggcggtaacgggacctaagggttgacggtatacgaaacgtacgtaggtcggtactcgaccgactagtcgttacg

SEQ ID NO: 180395 - DNA, 861 bp, Homo sapiens
  misc_feature: GYAE6OF01EXIMD.10.52.E08.1.454.CMB.1.raw
  modified_base (207)..(207): a, c, t, g, unknown or other
  misc_feature (207)..(207): n is a, c, g, or t
tcagcatagtagtgcacgaccggtgctcgatttagtcgagctctcagagagaaaggggggagctgctcagttaggacccagagggaaccatggaaaccccagcgcagcttctcttcctcctgctactctggctcccaggtaccaccgggagaaattgtgttgacacagtctccaggcacccttgtcttttgtctccgaaggggaaanacgcccaccctctcctgcacgggccagtcagagtcgttaaacaacaactacttacgcctggtaccagacaacgaaaccgtcggccgacggcctcccgacggcctcctcactacttacagactagccagtcccaaggccaaggggtcccaacgtcgggccctaaggtcccccaaggtacccaaggggtttaccaaggttcgggacgtaaggtcgggggtacttgggggacctacgggaactttaccgaaccgttcctcgtaccccgacgttacccaagggaccaagggaaccgtacggggaacggtacccgttagggtaaacggtaacgttttttacgggaccgtttaacggtcgttaaagttttaaccgttacggtttaccgtaacgggtaccgtaacgggttaacgtacggggttaccgggtaccccccgggttaccgggtacccgtttaccggtaacggggtttttcccgggggtacccggggttaaccggggggtaaaccccgggttaaaacgggggtttaaccgggtaaacggggttaaccggttaaacccgggttaaaaacccgggttaaacccgggtttaaacgggttacccggggtaccggttaccgggtaacccgttaacccggtaaccgttacccggttaccggg

SEQ ID NO: 180396 - DNA, 958 bp, Homo sapiens
  misc_feature: GYAE6OF01E2JD0.10.52.E08.1.454.CMB.1.raw
tcagcatagtagtgcacgaccggtgctcgatttagtcgagctctcagagaggaaagggggagctgctcagttaggatccaggagggaaccagtacggaaaccccagcgcacgtctttccttccttccctcctgctactcgtcggcctcccgacggtaccgaccggtaagtaaagttgttgttacgacacgtagtcctccgacggccctacccgttgtttcctttcgtccgtaccggaaaggggaaacgaccgtcccctacccttccgtccgtggaccgacgggccacggtacgagtaagtacgtaaacctaacctaacgttacttacgtccgtacggtaccacgaccgtaacgaaccgtcggaccgacggtccctaccgtacgtccttcctctacttacgtagtacgacgtacgtccaccgtaccgacggtaccggaccggtacctacggtacggtaccctaaccgtacccgaacggtaccggttaacggtcgaggtcgggtacggttcgggtacgggtacgtacggaacttaccggtaaccttccgtaccgtcctaccgtaaccgtacgtacccggacggttcccacgggttcccttacggtaaccgttacgggtaccggttaacggttaccggggttttaacgtttacggttttaaaccggttttcgtaacccggggttctaccggtaaccgggtttacgtaaaccgtttttacggaaccgtttaaccgggtttaccccggccggggtttaaaccccgggttccgggttaacgggggtttaccccgggaaaccgggtaacccggggttaaaaccgggaacccggttttaaaccgggaacccccgggtttaaaccaaaaccccggggtttaaacgggttacggtttcccgggaaacccggttacccgttacccggaaacccgtttaacccggtttaccggttccttttaaccccggg

SEQ ID NO: 180397 - DNA, 741 bp, Homo sapiens
  misc_feature: GYAE6OF01BJUC9.10.52.E08.1.454.CMB.1.raw
  modified_base (675)..(675): a, c, t, g, unknown or other
  misc_feature (675)..(675): n is a, c, g, or t
  modified_base (713)..(713): a, c, t, g, unknown or other
  misc_feature (713)..(713): n is a, c, g, or t
  modified_base (725)..(725): a, c, t, g, unknown or other
  misc_feature (725)..(725): n is a, c, g, or t
  modified_base (731)..(731): a, c, t, g, unknown or other
  misc_feature (731)..(731): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgtctccgaggggaaagcgcccaccctctcctgcgagggccagtcagtagtcgttaaacaactaactacttagcctggtaccagcaacgaacctggacccacggccctacggactccctctatcgtatagagtacgtacgactaccgacggtaccggacgggtacccggtaccgtacggtaccgaccgttacccgaaccggtaccggtaacggttaccggtaggttacgggtacgggtacgggttacgggggttacgggtaccggggtaaccggtaaccgtacggtttaccctaccgttacccgttacccaacccggtacttaccgtacggaacgtacggtaccggttaacggggtacggttaaccccgtaggtttaacgggttaaagttttcggtaccgtaaggtttacgtttaacgttacgttccggttaagcgtaagttaacggtcgtaccgggtccgacccggttcggcgttacgtcggtacgggngggaccggtacgtacggtagtacgacgtacggaacgtntcggtgactcgnaacctnttcgtctacc

SEQ ID NO: 180398 - DNA, 594 bp, Homo sapiens
  misc_feature: GYAE6OF02GRNEA.10.52.E08.1.454.CMB.1.raw
  modified_base (199)..(199): a, c, t, g, unknown or other
  misc_feature (199)..(199): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctccaggtaccaccggagaaattgtgttgacacagtctccaggcaccctgtctttgtctccaggggaangccacctctcctgcagggccagtcagagtgttaacaacaactacttagcctggtaccagcagaacctggccaggctccaggctcctcatctatgatgcatccagcagggccacgtggcatcccagactaggttcaggtgcaggtgggtctgggacagacttcactctacactatcacgcagacgtggacgccgtagtaacgtagttttacgacgtagttacgttactttacgtacgtactacgtactaaggtagttcggtaccgccccggtcggtccgttacgtacggtttaccgggacgggtacgggtaccgtaagggttacggaacggtaacgtacgtaaaccggtaacgttacggtacggtacgttacgaccgtaccgtacgttcgttacgg

SEQ ID NO: 180399 - DNA, 710 bp, Homo sapiens
  misc_feature: GYAE6OF02J3IBR.10.52.E08.1.454.CMB.1.raw
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (353)..(353): a, c, t, g, unknown or other
  misc_feature (353)..(353): n is a, c, g, or t
  modified_base (430)..(430): a, c, t, g, unknown or other
  misc_feature (430)..(430): n is a, c, g, or t
tcagcatagtagtgcacgaccggtgctcgatttagtcgagctctcagagagaaaggggagctgctcagttaggacccagagggaaccatggaaaccccagcgcagcttctcttcctcctgctactctgcctcccaggtaccaccggataaattgtgttgacacagtctccaggcacctgtcttgctcgagggaancnccacctctcctggccagggccagtccaggtagttacgttaaaccaactaaccttacgttacgcccgttaggtaaccaggtaccaacggaaacccgtggacccgaggtccctaccccgaggtccctcctacattacctagtgaacgttcgacctacnccgaggccgaacgggccctacgtcggacctacctaccccgagtaacgtcggttacaggtcgcgtaggtcgggtaccngggaactcgtacttccacgttcccaccgaactgtaccgacgacctacggtaccgaggactccgtaaggttacgttagtttaccggacttaggttacgttacttacgtcgtacgaacgtcgtaaggttcgtaccggtccggtcccgtacgttaccgtcgttaccgggttacggggaccggtaacgtacgtaagggtttaccgaacggttaccaaaaccgggttacgttaaccggtgtaccgggtactacccggtaccgttaccgtaccgttcgtttacccg

SEQ ID NO: 180400 - DNA, 593 bp, Homo sapiens
  misc_feature: GYAE6OF02H1JBW.10.52.E08.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgtctccaggggaanagccaccctntcctgcagggccagtcagagtgttaacaacaactacttagcctggtaccagcagaacctggccaggctccaggctcctcatctatgatgcatccagcagggccatggcatcccagacaggttcagtggcaggtgggtctgggacagactttcactctaccaccatcacgcagacgtaggagtcgtagaagtattttgacgtagttagttatttattggtcgtactaattagtagggttacgtaccgtacgttcgggttacgttttcgggaccggtaacggggaccgtaaggtacgttagggtaacggtaacgttaaccgtaaacggtaacgttaggttacggtacgttacggtaccgtaaccgtacgttccgttaggttaccg

SEQ ID NO: 180401 - DNA, 601 bp, Homo sapiens
  misc_feature: GYAE6OF02HSWP8.10.52.E08.1.454.CMB.1.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
  modified_base (488)..(488): a, c, t, g, unknown or other
  misc_feature (488)..(488): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggccaccctgtctttgtctcgaggggaaancgccaccctctcctgcagggccagtcagtagtgtaaacaacaactacttagcctggtaccagcaagaaacctggccaggcctcccgagcctcctcatctatgatcgcactccagccacgggccacgtcggcactcccagacaggttcaggtgcgaggtcgggtcgtagggacngtaccttcactcctacacctatcgacgcaagcgtaggacgcctaggaagttattttgacgttagttgttaactttacgtagtacagtactaggttacgtcggtccgccccggngtccttcggtacggttccgggacgggaacgggtaccgtaagggttacggaagtaaccgtaacgaaaccggtagttcgggtacgtacgtaccgacctaaccgtacgtacgttcg

SEQ ID NO: 180402 - DNA, 601 bp, Homo sapiens
  misc_feature: GYAE6OF02IRALP.10.52.E08.1.454.CMB.1.raw
  modified_base (200)..(200): a, c, t, g, unknown or other
  misc_feature (200)..(200): n is a, c, g, or t
  modified_base (451)..(451): a, c, t, g, unknown or other
  misc_feature (451)..(451): n is a, c, g, or t
  modified_base (595)..(595): a, c, t, g, unknown or other
  misc_feature (595)..(595): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcacctgtctttgcctcgaggggaaanagccaccctctcctgcagggccagtcagagtgttaaacaactaactacttagcctggtaccagcagaaacctggaccaggcctccaggcctcctcatctatgatgactactccagccgagggccctacgtcggacactaccccgaagtacctaggttaccaggtcggcgtaaggtcgggtacgtaggggactagtaccttcactctaccactatacctacgacaagtacgtaggacgtaccgtagaagttntttagctaagtttgtaacttacgtgtacagtactaggtagtcggtccggccccgtagtccgtacggtacgggttccggacgggtaacgggacgtaaggttcgaaacgtactacggaaacgtgtgtacggactacgactaccgtntcttcg

SEQ ID NO: 180403 - DNA, 842 bp, Homo sapiens
  misc_feature: GYAE6OF02I8ZZB.10.52.E08.1.454.CMB.1.raw
tcagcatagtagtgcacgaccggtgctcgatttagtcgagctctcagagagaaagggggagctgctcagttaggacccagagggaaccatggaaccccagcgcagcttctcttcctcctgctactctgctcccaggtaccaccggagaaattgtgttgacacagtcctccaggcaccctgtctttgtcctccgaggggtaacagccaccctctcctagcgagggccagtcagtagtagttaaaccaacgtaacctacttagccctaggtacccagccagaaacctggaccagggcctcccgaaggcctcctacgacttctaacgttgaacttcggacctaagttccccaacggtaccgaacgggggtacccctaaccgttcggggaccctaacgttacccccccggaaggaacccggttaacgggtttaccgtacggttacggggtaccgtacggttaggggggttcccgttagggggaacctaaacgggtaccgtttacccgaaacctttcccgttacccgtaaacccacgttaccaaacggtaccgtaaacggtaacccgttaggggaaaccgtcccgtaagggttaaaccggttaagttttttcggacgttaacggtttacgtttaaacgttttaccgttgttaaccgtacgtaacgtaacgttaagttaccgggttaccgcccccgggtacggttcccgttacgtttacggtttacccgggtcggggtaacccggggtaacggtaaccgggtttaggaaaccggttacggtaaaccgtaaaccggtaaaccgtcggttacgggtacgtaccggtaaccgaccgtacgttcgttaccgg

SEQ ID NO: 180404 - DNA, 505 bp, Homo sapiens
  misc_feature: GYAE6OF02FUI67.10.52.E08.1.454.CMB.1.raw
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgtctccaggggaaagagccaccctctcctgcagggccagtcagagtgttaaacaacaactacttagcctggtaccagcagaaacctggccaggctcccaggctcctcatctatgatgcatccagcagggccactggcatcccagacaggtcagtggcagtgggtctgggacagacttcactctcaccatcagcagactggacgcctgaacgtattttgactagtgtattactgtcagtcagtatggtcgcccgcgctcgagtttcggcggaggacgaaggtgaagatacgaacgtacgtgtcggctgacgaccatctcg

SEQ ID NO: 180405 - DNA, 694 bp, Homo sapiens
  misc_feature: GYAE6OF02JXW6Q.10.52.E08.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
tcagcatagtagtgcacgaccggtgctcgatttagtcgagctctcagagagaaaggggagctgctcagttaggacccagagggaaccatggaaaccccagcgcagcttctcttcctcctgctactctggcctccaggtaccaccggagtaaattgtgttgaccacagtcctccaggcaccctgtctttgctccgaagggaancgccaccctntcctagccgaggccagtcagntagtaaacacaacttactgcctgtaccagcagaacctgccagctccagctccnatctatgatgcatccagcacgggcctagtcgactactccccgaagcgtaggttacaggttggacctaggttcggggtccgtaagggtaccaagttccgtttacaccgttcctaccgaactcgtaccgacgtacgtaacggacgtaggacggtaccttaacgggtaacgttaacgttttacggacgttaacggtttacgttaaacgtttaccgttcggttaacacggttaccgtaaggtttaacgtccgggttacccggacccccggttccgggtaccgtttacggttaccgggttaccgggtaccggggtaaccggtaccgggtaacggtttacggaacgttaacggtaaccgaaaccggttaacgtggtaccggacgttccgacccgttacgtagttcccgttacgg

SEQ ID NO: 180406 - DNA, 738 bp, Homo sapiens
  misc_feature: GYAE6OF02HUG60.10.52.E08.1.454.CMB.1.raw
  modified_base (467)..(467): a, c, t, g, unknown or other
  misc_feature (467)..(467): n is a, c, g, or t
tcagcatagtagtgcacgaccggtgctcgatttagtcgagctctcagagagaaaggggggagctgctcagttaggacccagagggaaccatggaaaccccagcgcagcttctcttcctcctgctactctggctcccaggtaccaccggagaaattgtgttgacacagtctccaggcaccctgtctttgtctcgaaggggaagacgcctaccctctcctgacgagggccagtcagagtgttaacaacaactactagcctagtaccagcaagaacctcggaccgaggcctaccgaggtcctcctcatactagtagaatcgacctactaccgagacgaccgggcctacgtcggaccaacctaccccgaagtaaccgtagggttacagggtacggcgagggttcgggtacgaggggtacacggttacctactacctaccgtaccaacctatacgtacgacgaacgtacggnggtaacgccgtaagaacgttagttttagaccgttagttagttaacttacgttacgtacgacgtacgtaagttacggtacgggttaccgtaccgttaccggtttacggggtaccggggttacggtacccggttaccggttaaccgggttttaccgggaaccgggggtaaaccgggtaaacggtaaaaacgggttacgggtaacgggtaaaacccgtaaaacggttaacggttacggggtaccggtacgtacggtacccgtaaccgttaccgg

SEQ ID NO: 180407 - DNA, 694 bp, Homo sapiens
  misc_feature: GYAE6OF02FH3NO.10.52.E08.1.454.CMB.1.raw
  modified_base (158)..(158): a, c, t, g, unknown or other
  misc_feature (158)..(158): n is a, c, g, or t
  modified_base (204)..(204): a, c, t, g, unknown or other
  misc_feature (204)..(204): n is a, c, g, or t
tcagcatagtagtgcacgaccggtgctcgatttagtcgagctctcagagagaaaggggagctgctcagttaggacccagagggaaccataggaaaccccagcgcagcttctcttcctcctgctactctggcctcccaggtaccaccggagaaattgtnttgactacagtctccaggcaccctgtctttgtctaccgaggggaancgccacctctcctgcgagggccagtcagtagtagttaacaactaactacttagccctaggtaccagacagaaaccctggaccctaggccttacccgaggtcctcctacgactctatagatcgacacgtccacggcgtacgggcctacgtcggccactccccgaaggaccgtaaggttccaagggttcggaccgtaaggtcggggtactcggggaactacggactttacacttcgacaccctatccgaacgtacgacgtacgttaggacgacgtagaacggtactggttagactagttttagtaccgtaggtacctaacgtacgttaccggtacggtacggtccggtacccggttccggggtaacccttaccgggtttacccggcccgggttaccggaaccgttaacggttacggaacttaacgaaccgaaacggttaccgtaacggttccgtaacgtcggaacctaaccggtacttaccgttagttaccg

SEQ ID NO: 180408 - DNA, 805 bp, Homo sapiens
  misc_feature: GYAE6OF02FH3TK.10.52.E08.1.454.CMB.1.raw
  modified_base (244)..(244): a, c, t, g, unknown or other
  misc_feature (244)..(244): n is a, c, g, or t
tcagcatagtagtgcacgaccggtgctcgatttagtcgagctctcagagagaaaggggagctgctcagttaggacccagagggaaccatggaaaccccagcgcagcttctcttcctcctgctactctggctcccaggtaccaccggagaaattgtgttgacacagtcctcagccaccctgtctttgctccgagggaaagcgccacctcgtcctgacagggccagtcagagtgtcgcgcctacgngtccgtggtaaccacgaacgaaaccgtggaccacggccctacccgaccggccccctacgactcttagtcggtcgcctactccaacgcgggacctacgtcggcacctcccagccgtaggttccgacggtggaccggtggttaccggggtcgtacggggaacctagggtaccttactcctaccgttaccacctacgtcctacgtccaaccgtccgttagggaccgtacccgtaagtaacggttacgttaggtttacggtaccgttaacgtttttaacgtttaacgttacgttaccctaaacgtaccgtttcccggttaaaccggtgggttaccccgggtaccccgggttaccggggggttaccccctttaaccgggtttacccccgggtaaccccggttccgggggttaaaaacccgtaacgggttagggtaaccgttaaaccggtaccgtaaaacccggtaacggttccgggttaacggttaccgtaccggtaacccgtaccgttaaccggttccgtttaccgtttccgttaacccttaccggtttacccccgttaccccgg

SEQ ID NO: 180409 - DNA, 707 bp, Homo sapiens
  misc_feature: GYAE6OF02HOZ95.10.52.E08.1.454.CMB.1.raw
  modified_base (591)..(591): a, c, t, g, unknown or other
  misc_feature (591)..(591): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggcctcccacggtacccaccggagaaattgtagttcgacacagtctccaggccaccctgtctttgacctccgagggaaagcgccctaccctctcctcgcgacgggtccaggtaccaaggtagtacgttaaacaaccgtaaacttaccttacggaccttacgggtaaccaagtccaaacggtaaaccgttcgggaccacgggtacctaccccgtaacggcctccccgtactacttaccctagtacgacgttacgacctactacccaggtaccgaccgggtacccaaccggtcgaccgtaccgtaccccaaggtaccgtagttccgaggttacggcgtaggtccggggttacgacggggtacctaacggtaccttcccgtaaccttcccgtaccgaacctactacgaactcggaacgtacgtcgacgtccgtagtacgttacttagccgttattgttacttagtntacgtacgcgtatacggtcgaccggcccgaggtacctcggtacggttgaccgggacggtactaggtcgaataccgaagtaacgtagtcggtagcgtacgtaccgctacgtcttccg

SEQ ID NO: 180410 - DNA, 769 bp, Homo sapiens
  misc_feature: GYAE6OF02I0U5Q.10.52.E08.1.454.CMB.1.raw
  modified_base (206)..(206): a, c, t, g, unknown or other
  misc_feature (206)..(206): n is a, c, g, or t
  modified_base (756)..(756): a, c, t, g, unknown or other
  misc_feature (756)..(756): n is a, c, g, or t
tcagcatagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttagacacagtcctccaggccaccctgtctttcgtctccgaggggaaancgcccaccctctcctgccgagggccagtcagtagttacgttaaacaaacgtaacttacttacgaccgttcggtaaccaggtaccaaacggtaaaccctcggacccacggcccttacccgacggtcccctacctacgacttcgttaagtacgattcggacctacgtacccgaggaccgacgggtccctacgtcgaccctactacccgaagtaccggtagttacgagggtacggacgtacgggttcgggtacgtacggggaactaacggtacctttacccaccgttacctacccgaacctagtacgacgtaacgtacggtaacgtcggtacgtaccgtaaggtaacgtttacgtttagacgttaacgttacgttacgttaacgtccggtataaacggtcgtaagttccgggtacggtcccggacccggttcggtaccgttcggggtaccggttacgggaccgggtaacggtaaccgttaggggttacgaaacggttccgtaaacggtaaaccggttacggtcgttacgggtaccgaccgttacccgacgttntaccccggtttcg

SEQ ID NO: 180411 - DNA, 159 bp, Homo sapiens
  misc_feature: GYAE6OF01DABHA.51.86.H09.1.454.CMB.1.raw
  modified_base (159)..(159): a, c, t, g, unknown or other
  misc_feature (159)..(159): n is a, c, g, or t
tcagcgatcgtatacacgaccggtgctcgatttagtgctatagacttgggtttggggaggtgtgtcacaagatttgggctctgggcacagcggccctgggctgcctggtcaaggactacttcctcgtagcactctgagcgggctggcaaggcgcatagn

SEQ ID NO: 180412 - DNA, 159 bp, Homo sapiens; identical to SEQ ID NO: 180411
  misc_feature: GYAE6OF01D86JZ.51.86.H09.1.454.CMB.1.raw
  modified_base (159)..(159): a, c, t, g, unknown or other
  misc_feature (159)..(159): n is a, c, g, or t

SEQ ID NO: 180413 - DNA, 159 bp, Homo sapiens; identical to SEQ ID NO: 180411
  misc_feature: GYAE6OF01BVJ4X.51.86.H09.1.454.CMB.1.raw
  modified_base (159)..(159): a, c, t, g, unknown or other
  misc_feature (159)..(159): n is a, c, g, or t

SEQ ID NO: 180414 - DNA, 181 bp, Homo sapiens
  misc_feature: GYAE6OF01BDUVF.51.86.H09.1.454.CMB.1.raw
  modified_base (160)..(181): a, c, t, g, unknown or other
  misc_feature (160)..(181): n is a, c, g, or t
tcagcgatcgtatacacgaccggtgctcgatttagtgctatagacgttgggtttggggaggtgtgtcacaagatttgggctctgggcacagcggccctgggctgcctggtcaaggactacttcctcgtagcactctgagcgggctggcaaggcgcatagnnnnnnnnnnnnnnnnnnnnnn

SEQ ID NO: 180415 - DNA, 159 bp, Homo sapiens; identical to SEQ ID NO: 180411
  misc_feature: GYAE6OF01AX3C8.51.86.H09.1.454.CMB.1.raw
  modified_base (159)..(159): a, c, t, g, unknown or other
  misc_feature (159)..(159): n is a, c, g, or t

SEQ ID NO: 180416 - DNA, 160 bp, Homo sapiens
  misc_feature: GYAE6OF01B4LXU.51.86.H09.1.454.CMB.1.raw
  modified_base (159)..(160): a, c, t, g, unknown or other
  misc_feature (159)..(160): n is a, c, g, or t
tcagcgatcgtatacacgaccggtgctcgatttagtgctatagacttgggtttggggaggtgtgtcacaagatttgggctctgggcacagcggccctgggctgcctggtcaaggactacttcctcgtagcactctgagcgggctggcaaggcgcatagnn

SEQ ID NO: 180417 - DNA, 160 bp, Homo sapiens
  misc_feature: GYAE6OF01DWCBI.51.86.H09.1.454.CMB.1.raw
  modified_base (160)..(160): a, c, t, g, unknown or other
  misc_feature (160)..(160): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatagn

SEQ ID NO: 180418 - DNA, 161 bp, Homo sapiens
  misc_feature: GYAE6OF01A3AGS.51.86.H09.1.454.CMB.1.raw
  modified_base (159)..(161): a, c, t, g, unknown or other
  misc_feature (159)..(161): n is a, c, g, or t
tcagcgatcgtatacacgaccggtgctcgatttagtgctatagacttgggtttggggaggtgtgtcacaagatttgggctctgggcacagcggccctgggctgcctggtcaaggactacttcctcgtagcactctgagcgggctggcaaggcgcatagnnn

SEQ ID NO: 180419 - DNA, 191 bp, Homo sapiens
  misc_feature: GYAE6OF01B7E1T.51.86.H09.1.454.CMB.1.raw
  modified_base (164)..(191): a, c, t, g, unknown or other
  misc_feature (164)..(191): n is a, c, g, or t
tcagcgatcgtatacacgaccggtgctcgatttagtgctatagacgttgggtttgggggaggtgtgtcacaagatttgggctctgggcacagcggccctgggctgcctggtcaaggactacttccctcgtagcactcgtgagcgggctgggcaaggcgcatagnnnnnnnnnnnnnnnnnnnnnnnnnnnn

SEQ ID NO: 180420 - DNA, 159 bp, Homo sapiens
  misc_feature: GYAE6OF01BJ907.51.86.H09.1.454.CMB.1.raw
  modified_base (158)..(159): a, c, t, g, unknown or other
  misc_feature (158)..(159): n is a, c, g, or t
tcagcgatcgtatacacgaccggtgctcgatttagtgctatagacttgggtttggggaggtgtgtcacaagatttgggctctgggcacagcggccctgggctgcctggtcaaggactacttcctcgtagcactcgagcgggctggcaaggcgcatagnn

SEQ ID NO: 180421 - DNA, 160 bp, Homo sapiens; identical to SEQ ID NO: 180417
  misc_feature: GYAE6OF01A5YSD.51.86.H09.1.454.CMB.1.raw
  modified_base (160)..(160): a, c, t, g, unknown or other
  misc_feature (160)..(160): n is a, c, g, or t

SEQ ID NO: 180422 - DNA, 161 bp, Homo sapiens
  misc_feature: GYAE6OF01AOBKY.51.86.H09.1.454.CMB.1.raw
  modified_base (160)..(161): a, c, t, g, unknown or other
  misc_feature (160)..(161): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatagnn

SEQ ID NO: 180423 - DNA, 162 bp, Homo sapiens
  misc_feature: GYAE6OF01D0YRR.51.86.H09.1.454.CMB.1.raw
  modified_base (160)..(162): a, c, t, g, unknown or other
  misc_feature (160)..(162): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatagnnn

SEQ ID NO: 180424 - DNA, 163 bp, Homo sapiens
  misc_feature: GYAE6OF01BTMN5.51.86.H09.1.454.CMB.1.raw
  modified_base (160)..(163): a, c, t, g, unknown or other
  misc_feature (160)..(163): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatagnnnn

SEQ ID NO: 180425 - DNA, 159 bp, Homo sapiens; identical to SEQ ID NO: 180411
  misc_feature: GYAE6OF01BGKU9.51.86.H09.1.454.CMB.1.raw
  modified_base (159)..(159): a, c, t, g, unknown or other
  misc_feature (159)..(159): n is a, c, g, or t

SEQ ID NO: 180426 - DNA, 175 bp, Homo sapiens
  misc_feature: GYAE6OF01E4PBO.51.86.H09.1.454.CMB.1.raw
  modified_base (162)..(175): a, c, t, g, unknown or other
  misc_feature (162)..(175): n is a, c, g, or t
tcagcgatcgtatacacgaccggtgctcgatttagtgctatagacttgggtttgggggaggtggtgtcacaagatttgggctctgggcacagcggccctgggctgcctgggtcaaggactacttcctcgtagcactctgagcgggctggcaaggcgcatagnnnnnnnnnnnnnn

SEQ ID NO: 180427 - DNA, 164 bp, Homo sapiens
  misc_feature: GYAE6OF01BBYQT.51.86.H09.1.454.CMB.1.raw
  modified_base (159)..(164): a, c, t, g, unknown or other
  misc_feature (159)..(164): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatgnnnnnn

SEQ ID NO: 180428 - DNA, 162 bp, Homo sapiens
  misc_feature: GYAE6OF01CSELL.51.86.H09.1.454.CMB.1.raw
  modified_base (157)..(162): a, c, t, g, unknown or other
  misc_feature (157)..(162): n is a, c, g, or t
tcagcgatcgtatacacgaccggtgctcgatttagtgctatagacttgggtttggggaggtgtgtcacaagatttgggctctggcacagcggccctggctgcctggtcaaggactacttcctcgtagcactctgagcgggctggcaaggcgcatagnnnnnn

SEQ ID NO: 180429 - DNA, 160 bp, Homo sapiens; identical to SEQ ID NO: 180416
  misc_feature: GYAE6OF02G7PTR.51.86.H09.1.454.CMB.1.raw
  modified_base (159)..(160): a, c, t, g, unknown or other
  misc_feature (159)..(160): n is a, c, g, or t

SEQ ID NO: 180430 - DNA, 159 bp, Homo sapiens
  misc_feature: GYAE6OF02HPT3U.51.86.H09.1.454.CMB.1.raw
  modified_base (154)..(159): a, c, t, g, unknown or other
  misc_feature (154)..(159): n is a, c, g, or t
tcagcgatcgtatacacgaccggtgctcgatttagtgctatagacttgggttgggaggtgtgtcacaagatttgggctctggcacagcggcctggctgcctggtcaaggactacttcctcgtagcactctgagcgggctggcaaggcgcatagnnnnnn

SEQ ID NO: 180431 - DNA, 171 bp, Homo sapiens
  misc_feature: GYAE6OF02F0ZXN.51.86.H09.1.454.CMB.1.raw
  modified_base (160)..(171): a, c, t, g, unknown or other
  misc_feature (160)..(171): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatagnnnnnnnnnnnn

SEQ ID NO: 180432 - DNA, 167 bp, Homo sapiens
  misc_feature: GYAE6OF02INQME.51.86.H09.1.454.CMB.1.raw
  modified_base (158)..(167): a, c, t, g, unknown or other
  misc_feature (158)..(167): n is a, c, g, or t
tcagcgatcgtatacacgaccggtgctcgatttagtgctatagacttgggtttggggaggtgtgtcacaagatttgggctctgggcacagcggcctgggctgcctggtcaaggactacttcctcgtagcactctgagcgggctggcaaggcgcatagnnnnnnnnnn

SEQ ID NO: 180433 - DNA, 166 bp, Homo sapiens
  misc_feature: GYAE6OF02IEQRH.51.86.H09.1.454.CMB.1.raw
  modified_base (159)..(166): a, c, t, g, unknown or other
  misc_feature (159)..(166): n is a, c, g, or t
tcagcgatcgtatacacgaccggtgctcgatttagtgctatagacttgggtttggggaggtgtgtcacaagatttgggctctgggcacagcggccctgggctgcctggtcaaggactacttcctcgtagcactctgagcgggctggcaaggcgcatagnnnnnnnn

SEQ ID NO: 180434 - DNA, 186 bp, Homo sapiens
  misc_feature: GYAE6OF02I51VS.51.86.H09.1.454.CMB.1.raw
  modified_base (161)..(186): a, c, t, g, unknown or other
  misc_feature (161)..(186): n is a, c, g, or t
tcagcgatcgtatacacgaccggtgctcgatttagtgctatagacttgggtttgggggaggtgtggtcacaagatttgggctctgggcacagcggccctgggctgcctggtcaaggactacttcctcgtagcactctgagcgggctggcaaggcgcatagnnnnnnnnnnnnnnnnnnnnnnnnnn

SEQ ID NO: 180435 - DNA, 164 bp, Homo sapiens
  misc_feature: GYAE6OF02GOSJL.51.86.H09.1.454.CMB.1.raw
  modified_base (160)..(164): a, c, t, g, unknown or other
  misc_feature (160)..(164): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatagnnnnn

SEQ ID NO: 180436 - DNA, 159 bp, Homo sapiens; identical to SEQ ID NO: 180411
  misc_feature: GYAE6OF02F4IA3.51.86.H09.1.454.CMB.1.raw
  modified_base (159)..(159): a, c, t, g, unknown or other
  misc_feature (159)..(159): n is a, c, g, or t

SEQ ID NO: 180437 - DNA, 161 bp, Homo sapiens; identical to SEQ ID NO: 180422
  misc_feature: GYAE6OF02G6OWT.51.86.H09.1.454.CMB.1.raw
  modified_base (160)..(161): a, c, t, g, unknown or other
  misc_feature (160)..(161): n is a, c, g, or t

SEQ ID NO: 180438 - DNA, 160 bp, Homo sapiens; identical to SEQ ID NO: 180416
  misc_feature: GYAE6OF02FILW4.51.86.H09.1.454.CMB.1.raw
  modified_base (159)..(160): a, c, t, g, unknown or other
  misc_feature (159)..(160): n is a, c, g, or t

SEQ ID NO: 180439 - DNA, 161 bp, Homo sapiens; identical to SEQ ID NO: 180422
  misc_feature: GYAE6OF02GHH4Q.51.86.H09.1.454.CMB.1.raw
  modified_base (160)..(161): a, c, t, g, unknown or other
  misc_feature (160)..(161): n is a, c, g, or t

SEQ ID NO: 180440 - DNA, 170 bp, Homo sapiens
  misc_feature: GYAE6OF02FSSDV.51.86.H09.1.454.CMB.1.raw
  modified_base (160)..(170): a, c, t, g, unknown or other
  misc_feature (160)..(170): n is a, c, g, or t
tcagcgatcgtatacacgaccggtgctcgatttagtgctatagacttgggtttgggggaggtgtgtcacaagatttgggctctgggcacagcggccctgggctgcctggtcaaggactacttcctcgtagcactctgagcgggctggcaaggcgcatagnnnnnnnnnnn

SEQ ID NO: 180441 - DNA, 163 bp, Homo sapiens; identical to SEQ ID NO: 180424
  misc_feature: GYAE6OF02G254F.51.86.H09.1.454.CMB.1.raw
  modified_base (160)..(163): a, c, t, g, unknown or other
  misc_feature (160)..(163): n is a, c, g, or t

SEQ ID NO: 180442 - DNA, 514 bp, Homo sapiens
  misc_feature: GYAE6OF01DGPBA.39.14.B03.1.454.CMB.1.raw
tcagtcgcactagtcacgaccggtgctcgatttagtgtgagtagttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaacgcccccaaactcatcatttatgaggtcagtaatcggccctgagggtttctaatcgtcttctctggctccaagtctggcaacacggcctccctgaccatctctgggctccaggctgaggacgaggctgattattactgcagctcatttgctaatcagtgagtctttatgtcgttaggaaggttcgggaacctaaggtcaagtccgtacctaggtcacgaccaacgaccctaacccg

SEQ ID NO: 180443 - DNA, 532 bp, Homo sapiens
  misc_feature: GYAE6OF01CNGKO.39.14.B03.1.454.CMB.1.raw
  modified_base (383)..(383): a, c, t, g, unknown or other
  misc_feature (383)..(383): n is a, c, g, or t
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtgttataactatgtctcctggtaccacagcaccaggcaaacgcccccaaactcatgattatgagtcagtaactcggcctgtagggtttctaagtcgtcttctcgtggctaccgtaagtctcggaccaaccgaccggcccttcccgngtaccctatcctcgtcgggctccgaggtctggaacggacggagtctgtacttacttactgcacgtctacatactacagcagcagctactcgttgtggtagttcgggacggaggaccagcgtacgacccgtctaggtccacgtcccacgg

SEQ ID NO: 180444 - DNA, 612 bp, Homo sapiens
  misc_feature: GYAE6OF01DEHWU.39.14.B03.1.454.CMB.1.raw
  modified_base (221)..(221): a, c, t, g, unknown or other
  misc_feature (221)..(221): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaancagcagtgacgtttgttaggttataactattgtctctggtaccaacacgcaccaggacaaacgaccccaaacncatgatttangagtcagtaatcgcctgtagggtttctaagtcgtcttctgtcgctactaagtcgtagactaaaccgcggtccctcccgtacgacctactcctcgtcggtcctaccgacggtcttagggacgggtacggacgggtcttaggtaacttttaacgttacgttacgacgtacgtacttacaagttacttaaacgaacgaccagtaccacgtacttaacttcggttagttacggttacggtttccgggagggtaacggaccgtaaacggtccgtacggtacccgttacgtaggtaccaccgtccggtaaccgg

SEQ ID NO: 180445 - DNA, 549 bp, Homo sapiens
  misc_feature: GYAE6OF01DUFJT.39.14.B03.1.454.CMB.1.raw
  modified_base (266)..(266): a, c, t, g, unknown or other
  misc_feature (266)..(266): n is a, c, g, or t
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
tcagtcgcactagtcacgaccggtgctcgatttagtgtgagtagttccgcgggggggtctcaggaggcagcgctctcaggacatctccaccatggcctgggctctgctgctcctcaccctcctcactcagggcacaggtcctgggcccagtctgccctgactcagcctgcctccgtgtcgtgggtctcctggacagtcgatccaccatctcctgcactggaagcagcagtgacgttggtgttataactatgtctcctggtaccaanagccaccaggacaaacgacccccaaactcatgatttangaggtcagtaatcggccctagtagggtttctaatcgtcttctctgctacaagtctgcaacacgccctccncgaccatctctcgggctccgaggtctaggaggtacggagcgttagtatttatactgcacgtctcgaattataacgagacagacagctacttcgttgtaggttacgttcgggacgggacgggaaccgaacgtcgtacggtacccgttaccgtaggacctacggccccgtaaacggg

SEQ ID NO: 180446 - DNA, 694 bp, Homo sapiens
  misc_feature: GYAE6OF01DOLHO.39.14.B03.1.454.CMB.1.raw
  modified_base (231)..(231): a, c, t, g, unknown or other
  misc_feature (231)..(231): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacgagggtcctgggcccaggttctgccctgactcagcctgcctccgtgtcgtgggtctccgtggacagtcgatcaccgatctcctgcacgtgggaancagcagtgtacgttggtgttataactatcgtctctggtaccaacagcaccaggacaaaccgacccccaaactcatacgtatttacgtggaggtcgaagtaaacgtccgggtacccgttcggtacggggttttactaaacgttccgttactttcgttcgtcggtaccttaccgtaaaggttccgttacgggacctaaccgtacccggtcccttccccgtacggaccctacgttccgttaccggtcggggtccttacccggaggtcctcgggaaacgggcggaacgggacttaggtaactttaacgttactcgtacgtagtccttaacaagttaactaaccgtaacgtacaaggcctacgaccttacgtcgtttggttacggttacggttaccggggacgggtaacgggacccgtaggcccgtacggtacccgttacgtacggtaccgcggtacccggtaaccgg

SEQ ID NO: 180447 - DNA, 530 bp, Homo sapiens
  misc_feature: GYAE6OF01EO2IQ.39.14.B03.1.454.CMB.1.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (242)..(249): a, c, t, g, unknown or other
  misc_feature (242)..(249): n is a, c, g, or t
  modified_base (251)..(252): a, c, t, g, unknown or other
  misc_feature (251)..(252): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(260): a, c, t, g, unknown or other
  misc_feature (258)..(260): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
tcagtcgcactagtcacgaccggtgctcgattttagtgtgagtagttccgcggggtacggaggccctccgaccgaagggcccaatcggtcgttccccctggcacccctcctccgaacgaggcaccctctgggggtccacccacgccggccctgggcctggccctggtcgaaggactacgttccgacctacgtgcgactgagcgggactggccaacggcgcatagncagnagngcngancncnnnnnnnngnnananannntntgacanagancncgcncgcngtgtgnanananananagagagcgcanagagactcngagctctctcgcgcncncgcncgacgacgacgcgcgtactacgtactactactacgagagtacgacgagacgaggacggagacgtacgtacgtactactacgtacgtacgaagaagacgtagtagtagtacgtacgtacgtagtggtggtcggacggacgacgacgtacgtacgtcgtacgtacgacgtacgacgacgcgtccgtccgtccg

SEQ ID NO: 180448 - DNA, 505 bp, Homo sapiens
  misc_feature: GYAE6OF01C9GGP.39.14.B03.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (298)..(298): a, c, t, g, unknown or other
  misc_feature (298)..(298): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (416)..(416): a, c, t, g, unknown or other
  misc_feature (416)..(416): n is a, c, g, or t
tcagtcgcactagtcacgaccggtgctcgatttagtgtgagtagttccgcgggggggtctcaggaggcagcgctctcaggacatctccaccatggcctgggctctgctgctcctcaccctctcactcagggcacaggtcctgggcccagtctgccctgactcagcctgcctcgtgtctgggtctcctggacngtcgatcaccatctcctgcactggaancagcagtgacgttggtggttatactatgtctcctggtaccaacagcaccaggccaaacgcccccaaactcatgatttangagtcagtaatcggccctcgtagggtttctagtcgtcttctccggctcaagtctgcacacgcctcctgaccntctctagacctcaggctgaggacgngctgacttatattgcagctanaatatactgtatcaatggtactccagtggctcggttcgggcggaggtaccagttccggaccgtcgtacggtcagacccaggcctcccgg

SEQ ID NO: 180449 - DNA, 834 bp, Homo sapiens
  misc_feature: GYAE6OF01B96AE.39.14.B03.1.454.CMB.1.raw
  modified_base (223)..(223): a, c, t, g, unknown or other
  misc_feature (223)..(223): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtgttataactatgtctccgtaggtaccaacacgccacccgaggaccaaacgaccccccaaactccatgtaatttagtggaggtcaagtaactccggccctacgtacgggtttctaacgttcgtctttcctcgtcggtcctaccgtaacggttcgtacggacaaacccgtaccggtccccttacccgtacgtaccctacgttcccgtaccggtccgggggtccttacccggacggggtacctacggggaacgggtaacccgggtacgggttacccttaggttaaccttttaaacgttttaaccgttccggtaaccgtaaccgttaccttaacccgttaaacgtttaaaccgttaaaacccggtaaacggtacccgtaaccgggtaaccctaacgggtaccccgtttaaaccgtttcccgggtttttacggggtttaaccgggttttaccgggggttttaaccccgggggaacccggggggtaaaccggggtaaaccccgtaaacggggttcccggttaacccgggtttaacccccgggttaacccgggttaacccgggttaccccggaaacccgggttacccccggtaaacccgggg

SEQ ID NO: 180450 - DNA, 752 bp, Homo sapiens
  misc_feature: GYAE6OF01CRUYC.39.14.B03.1.454.CMB.1.raw
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
tcagtcgcactagtcacgaccggtgctcgatttagtgtgagtagttccgcgggggggtctcaggaggcagcgctctcaggacatctccaccatggcctgggctctgctgctcctcaccctcctcactcagggcacgagggtcctgggcccagtctcgccctgactcagcctgcctccgtgtcgtggtctccgtggacagtcgatcacctatcctcctgcacgtggaancagcagtgacgtttggagttataactatgtctctggtaccaacngccaccacgacaaacgaccccaaactcatacgtatttatgaggtcaagtaacgtcggaccctcgtaacgggtttctaacgttccgtctttcgtcgtcggtaccttacgaacgtcgttacgggaccaaccggtaacccggtcccttaccccgtacggtaaccctaacgtttacccgtccggttcgggtccccttaccgaaccggtcgtaacgggtaacgggaccgtacgggtacgttagttaacgtttattaaccgtaggtaccgagttcctaactaagtttaacctaaacgtaccggacttaacggaccgtaacggtaccttaaaccgttccggtttaggtttaccgggttaacggtttaccggggaacccgggggtaaaccggtaacccgggtaaaccggttcccgtttaaacccgggtaccccggtttacccggtaaaccgggttcctaaacccgggtccccggttaaaaccccgggg

SEQ ID NO: 180451 - DNA, 657 bp, Homo sapiens
  misc_feature: GYAE6OF01EYIPL.39.14.B03.1.454.CMB.1.raw
  modified_base (222)..(222): a, c, t, g, unknown or other
  misc_feature (222)..(222): n is a, c, g, or t
  modified_base (301)..(301): a, c, t, g, unknown or other
  misc_feature (301)..(301): n is a, c, g, or t
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtgttataactatgtctcctggtaccaacacgcacccgagacaaacgccccaaatcatgatttangagtacagtactcgccctagtagggttactaagtcgtacttctcgtcggctacaacgttcgaggtacctaaccgtaccggcccttcccgagaccctactccgttcctgggcccttacgacggtacgtaggaacgggacgacgggtcttagttaactttaacgttaccgtagtacctagtccttacgaattaacgtactaacgacctaagacccgagtaccgtaccgtttacgtttaacgggtgggttaaaccggttttcggggaaccgggttaacgggaaccgtaaacgttccggttaacccgggtaacccgtttaccggttaacggtacccgtaaccggtccccggtaaaccggg

SEQ ID NO: 180452 - DNA, 586 bp, Homo sapiens
  misc_feature: GYAE6OF01DTS9E.39.14.B03.1.454.CMB.1.raw
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacggttgggggtatgactatgtctctggtaccagcaatatccaggcacacgacccccaaatcactctatttatgaggtcaagtaatccggcctgtagggtttctaatcgtcttctctggctcagtctggcaacgacggcctcccgtgacctatctcgtcgggcctcccgaggctaggacggacgaggtctagtattagttactgctagtccgtatagtttgactaatcgtaaggtcgaggttctttagtcgttcgttacgggtaacggttacggggaaccgtaacgggtacctacggttaccggttacccgttaagggtaccctaaccgggccccgtaaaccgggtaaccccccg

SEQ ID NO: 180453 - DNA, 566 bp, Homo sapiens
  misc_feature: GYAE6OF01ER74S.39.14.B03.1.454.CMB.1.raw
  modified_base (402)..(402): a, c, t, g, unknown or other
  misc_feature (402)..(402): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggacaaacgcccccaaactcatgatttatgaggtcagtaatcggccctcgtaggggtttactaatcgcttctcgtgctccaagtctggacaacacggcctccctcgaccatctcgtagggcctccgnggtcgtggaggacggagcgtagtattacgttacgtgcgagtctactaactaactaacaacgacgacgacacgcctacttcgtttaggtacggttagttccgggacgggacgggaccaacggtcgtaccggtaccgtaccgttacggcgaccgcccggtaaccgg

SEQ ID NO: 180454 - DNA, 726 bp, Homo sapiens
  misc_feature: GYAE6OF01BQDTF.39.14.B03.1.454.CMB.1.raw
tcagtcgcactagtcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctgccctgactcagcctgcctccgtgtcgtcgggtcctccgtggactgtcgatcaccatcctcctgcacgtggaagcagcagtgtacgttggtagttataactatgtctccgtggtaccaacacgccaccacggaccaaaccgacccccaaactctaagtcgtactttagtagtacggtacgtaagtaacgtccggtcccgttagggttacggggttttactaacgttccggttccttacgtccgttcggtacctaccgtaacgttaccgtacggtaccgaaaccggtcccgtaccccgtccctacggtaaccctacgttccgtaccggtacgggtcccttcgggaacggtccggtacgggaacgggaccggtacgggtacgttacggttaacttttacgttaacccgtcgtacgtaccgtacttacgtaaacttacgaaacgtacgaccgtaacgcaccgtactacgtttccgttggttacggtacgtaccggggtacgggtaacggaaccgtacggttacccgtacggtacccgttacctaagggtacccaaccggtcccggtaacccgg

SEQ ID NO: 180455 - DNA, 784 bp, Homo sapiens
  misc_feature: GYAE6OF01CF7Y5.39.14.B03.1.454.CMB.1.raw
tcagtcgcactagtcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatccaccatcctcctgcacgtggaacgcagcaggtgtacggtttggtaggttaataactatcgttcctccgtacggtaaccaacacgaccaccgacggaccaaaccgacccccaaactcatagtatttagtaggtaggtactaacgtaacgtccggtccctacggtacggggtttactaacgttccgtacttcgtcgtcggtcctaccgtaacgttcgtacggaccaaaccggtacccggtacccctacccgtacgaccctacgttccgtccgtcgggtccctacccgtaggtccgtacgggacgggaccggtaggtaccgttagtaacgtttaccttacggtacgaccgttaacgtctttacgttacgttttaccgaaccgttaacgttaccggttaaggttacgggtaccggtttaccggttttaggttaccgggttttaccgggttaaccggggtaacggggttaacccggggtaaaccgttaagggtcccgttaaacgttcccggtttaacccggttaaccgggtacccgtaacccggtaaccccccggaaacccgggtaaccccctaaaacccccgg

SEQ ID NO: 180456 - DNA, 664 bp, Homo sapiens
  misc_feature: GYAE6OF01E3ZAG.39.14.B03.1.454.CMB.1.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactggaancagcagtgacgttggtgttatactatgtctctgtaccaangcaccgagacaacgccccaaactcatnattngagtcagtactcgcctgtagggttcagtcgtcttctcgtcgctacgaagtctaggaccaacgaccggtccctcccgtacgacctactccgttacggtcgggtcctccgaggtcgtacgggacggacggaggtcttacggtattttaaccgttacgtcggtacctacgtaccttataacgttaactaaccgaaagccaacgtacgacgtaccctacgtttcggtttacgggtaaccgggtttacgggttcccggggaacgggggtaaaccgggacccggttaaacggtcccgggttaaccgggtaacccccggtttaccgggtaaacccgggttcccgaaaaccccgggtccccggtaaaccccggggg

SEQ ID NO: 180457 - DNA, 622 bp, Homo sapiens
  misc_feature: GYAE6OF01DYPTL.39.14.B03.1.454.CMB.1.raw
  modified_base (179)..(179): a, c, t, g, unknown or other
  misc_feature (179)..(179): n is a, c, g, or t
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagtcgcactagtcacgaccggtgctcgatttagtgtgagtagttccgcgggggggtctcaggagggcagcgctctcaggacatctccaccatggcctgggctctgctgctcctcaccctcctcacgtcagggcacagggtcctgggcccagtctgccctgactcagcctgcctcgtntctgggtctcctggacngtcatcacatctctgcactggaancagcagtgacgttggtggttataactattctctggtaccacagacaccagcaacgaccccaaactcatagtaatttagtagtacggtacagttaacgtcgtcccttacgtaggggtttactaagtccgtctttctcgtcgtacctaccgtaagtctcgactaccgaccgcctacccgacgtacctatccgtcgtacgggcctcgacggtcgtaggacggacgacggtctacgttattacgttactaggcctagtcctactaagttaactacgaacgctaacgtctacgactacttcgttagttacgttacgttacgggtacggtaaccggtaccgtaaggtcccgtacggtaacccggttaccgtaacgggtaccgaccggtaacggtacccggtaccccgg

SEQ ID NO: 180458 - DNA, 651 bp, Homo sapiens
  misc_feature: GYAE6OF01DX0AT.39.14.B03.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaagcagcagtgacgttggtagttataactatgtctcctggtaccaacagcaccaggacaacgcccccaatcatgtattangagtcagtatcggccctgtagggttacaagtcgtcttctcgtgctaccgacgtcgaggaccaacgtaccggtcccttccccgtaggaaccctagttcccgtacggtcgggtcccttaccggaaggtccgtagggaacgggtaccggacggtacttagtaacttttacgttaaccgtcgactaggtccttaaccgtaaattaaccgtaacgtaacggacgtacgtaccgtacgtacctacgtttccggttaggttacgggtttacgttccggggacgggtaacgggacccgtaaggtcccgtaccggtcccggttaaccgttaacggtccgaaccggtcccgtaaaccggg

SEQ ID NO: 180459 - DNA, 816 bp, Homo sapiens
  misc_feature: GYAE6OF01B7B62.39.14.B03.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacngtcgatcaccatctcctgcacgtggaancagcagtgtacgttgggtagttaataactatcgtctccgtaggtaccaacagaccaccgaggaccaaaccgacccccaaactcatagtactttagtaggtacggtacaggttaacgtccgggtaccccttacgttacggggttttactaacgttccgtacttccttacgtcggtacctaccgtaacggttcgtacggaccaaacccgacccggtcccttaccccgtacgtaaccctaacttcccgttaccggttccggggtacccttaccccgggtacgggtacccgtttaaggggaaccggggtaaccgggtacggggttacccgtttaacggtttaagttttaacccgttttaacgtccgggtacccgtaccgggttaacccttactaaaccgtttaaccgtaaaaccgtaaccggttaaccgaaccgtacgtaaaccggtcccgtttaaacccggtttcgttttacgggttcgggtttaaaccggggttccgggggtaaacgggggtaaccggggaaccctaacgggtccccggttaccgtaacccggttccggtaacgggtacccgtaccggtacccggtaacccggg

SEQ ID NO: 180460 - DNA, 783 bp, Homo sapiens
  misc_feature: GYAE6OF01DZYNB.39.14.B03.1.454.CMB.1.raw
  modified_base (291)..(291): a, c, t, g, unknown or other
  misc_feature (291)..(291): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactggaagcagcagtgacgttggagttatactatgtctctcgtacaacagcaccagacaacgccccaaactcatnactttatgagtcagtatcggcctcgtagggtttctaatcgtcttctacgtcggtactaccgaagtccgtcgggccaaaccgtaccggtccccttcccgtacggaaccctacgtttccgttccggttcgggggtcccttacccggtaagggtcccgttaagggaacggggaaccggtacgggtaccgtttacggtaacgtttttaattaaccggttacggtaccgtaccgtacgtttacgtaaacgtttaacggacccttaaaggtttaccgttaacggtcgggtaacgggtttacccttaaaggttttccgggttaccgggttttaaccggggtaaaggggtttaaacccgggggtaaacccgttaaaaccggggtttcccggtaaaccgttttccccggggtttaaaccccggttaacggggtttaaccccgaaacccgggtttaacccccccgggtaaaaccggcccccccccgttaaaaacccccccgg

SEQ ID NO: 180461 - DNA, 666 bp, Homo sapiens
  misc_feature: GYAE6OF01D41O9.39.14.B03.1.454.CMB.1.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacctatctcctgcactggaancagcagtgacgttggtgttataactatgtctctgtaccanacgcaccagacaacgaccccaaactcatgtatttagtgaggtacagtaacgtccggtaccgttacgtagggtttactaacgtccgtactttcctcgtcggtcttaccgtaacgttcgtacggaccgaaaccgtaccggtccccttcccgtacggaccctacgttccgttccgtcgggtacctccgacggtcgtacggaacggacggaacggtccgttagtaactttacttacgtcgtactaacgtctaactaactaactacgtaaagtccaacggcgtacgtccgttacgttacgttgggttacgggtttacggttccggggacgggaacgggtacccgtaaaggtcccgtacggtaacccggttaccgtaacgggtacgaacccggtacccgtaacccggg

SEQ ID NO: 180462 - DNA, 792 bp, Homo sapiens
  misc_feature: GYAE6OF01ALY3R.39.14.B03.1.454.CMB.1.raw
  modified_base (231)..(231): a, c, t, g, unknown or other
  misc_feature (231)..(231): n is a, c, g, or t
  modified_base (268)..(268): a, c, t, g, unknown or other
  misc_feature (268)..(268): n is a, c, g, or t
  modified_base (399)..(399): a, c, t, g, unknown or other
  misc_feature (399)..(399): n is a, c, g, or t
  modified_base (682)..(682): a, c, t, g, unknown or other
  misc_feature (682)..(682): n is a, c, g, or t
  modified_base (735)..(735): a, c, t, g, unknown or other
  misc_feature (735)..(735): n is a, c, g, or t
  modified_base (744)..(744): a, c, t, g, unknown or other
  misc_feature (744)..(744): n is a, c, g, or t
  modified_base (751)..(751): a, c, t, g, unknown or other
  misc_feature (751)..(751): n is a, c, g, or t
tcagtcgcactagtcacgaccggtgctcgatttagtgtgagtagttccggcgggggggtcgtcgaggaggcagcgctctcaggacatcctccaccatcggcctagggcctctcgcttcgccttcctaccaccctcctccacgtccagggccacgagggttccgtggacccagtctcggcccctgaacctctacgcctgcctccggttgtcgtgggttcctcctagggaccngttcgacttaccacctatccgtccgtaggaccgtacnggggtaaccgcacgggtcctaggttcggtaacggttggggttagttaaccttaacgttactttccgtccttagggtaacctaacgtacggacctacccgtagggaccttaaaaccggcccctaaaccgtanaccgtgtaacgttttacagggtaccgtcggtaacgttaacgccggtacccctggttaaacgggtttcctaagttcccggtctttacgtaccgtacgtccgtaaccgttacgtacgtacggttccaaaccggtcgtaaccctaccggtcgtaacctacgtcgtttaccggcgtacctaccgtacgggccttacggacgtaaccggtacggaccgttaacggtaccttacccttaagtcccggtaacgttcgaccgtaactacttaaccgtacgaccggttaacncggttaaccaagttacccgaatttccggtcgttacggtaggtttaacccgggngggtaaccncggtacncggtacgtacggtacctacgggactaccgtaccgcgtaccg

SEQ ID NO: 180463 - DNA, 736 bp, Homo sapiens
  misc_feature: GYAE6OF01DUIQI.39.14.B03.1.454.CMB.1.raw
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctcgtgtcgtgggtctccgtggacagtcgatccacctatcctcctgcacgtaggaancagcagtgtacgttggtagttataactatgtctctcgtacacanccacgngacaacgacccaancatanattangagtcagtactcgcctacgtagggttactagtcgtacttctcgtcgtctacctaagtcgtcggaccgtaacncccggtccctcccgtacgtaacctcgttccgttaccggtccggttcctacccggtacggtcgtaacgggaacgggaccggtagggtctttacggtaatttaacgttccgttacgaaccgttcgtaaccttcgtaaacttaaccgttaaaccgaacgtaccgtaacggacgtaaccgacccgtttaccgttacgggttacggtttacgggttaaccggggttaccgggggttaaaccgggggacccgggtaaaaccccgtaaacgggggtttaaccccgttcccggggttaaaacccggtttacccccgggttaacgggtaaccccgtaacccgggtaacccccgggttaaaaccccgggg

SEQ ID NO: 180464 - DNA, 611 bp, Homo sapiens
  misc_feature: GYAE6OF01DZ1BK.39.14.B03.1.454.CMB.1.raw
  modified_base (137)..(137): a, c, t, g, unknown or other
  misc_feature (137)..(137): n is a, c, g, or t
  modified_base (272)..(272): a, c, t, g, unknown or other
  misc_feature (272)..(272): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
  modified_base (596)..(596): a, c, t, g, unknown or other
  misc_feature (596)..(596): n is a, c, g, or t
tcagtcgcactagtcacgaccggtgctcgatttagtgtgagtagttccggcgggggggtctcaggaggcagcgctctcaggacatctccaccatggcctgggctctgctgctcctcaccctcctcactcagggcacngggtcctgggcccagtctgccctgactcagcctgcctccgtgtctgggtctcctggacagtcgactcaccatcctcctgcacgtggaagcagcagtgtacgttggtgttaataactatcgtctcctgtaaccaangccaccaggacaaacgccccaaatctatgtatttaagngtagtactagtaacncggccctagtacggtttactaactccgtctttctcgtcggcctaccgtagtcctacggacctaaacggaccggtccccttaccgtacgacctacttccgttcgtacgggtcttaccggacgccgtaaggacggacggacgtctagtatttacgttacncgactacgtactntaactataacgagtacacgctagtcctagttccttaagttggtacgtccgggtaggacggttaccgaaggtcgaacccggtacctaccgtaggtacccgngtaccccgtaaccgg

SEQ ID NO: 180465 - DNA, 977 bp, Homo sapiens
  misc_feature: GYAE6OF01BDVAU.39.14.B03.1.454.CMB.1.raw
tcagtcgcactagtcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctcgccctgactcaggctcgcctccgtgtctgggtctctaggacaggtcgatccacctattcctcctgacctacgtacggaacctaggacctaggttacggtaacggggtttggggggttaactcggtaaccttagtcggttccgttacccgtagggtaacccaaggtactaaaacgttacgttacccgacgggaccaacccgtaccgtaaccccccgtaaaacttccgtaacttaccctttaatttttagtacggtaagggttaacctaaacggttaacccgtcccgggtaccccgttggttaaccgggggttttactaaacgtcggttcctttccgtacggtcggtacctaccgtagtcgtacggacctaacggaccggtcccttaccgacgtaccgtaccgtccgttccggtacgggtcccgtaccggacggtaccgttacgggaacgggtaacgtacggggtacttaccgggtttaatttaaccgttaccggtttaaggacccgttacggttaacccgttaacggtttaaccggttttaccgtaaaccgggttaaacgtttaccgtaaacgggggtttaccggttaaaccgggtttccgttttaaagggttttacccgggtttaacccggggttttaaacggggggtaaaaccgggggttttaccccgggggtaaaaacccgggtttaaacccggggtttacccggttaaacccgggttttaacccccgtttaaccgggggttaaacccgggtttaacccccggggaaaccccggttaaaccccccggttaaaaccccggggggttaaaaccccccccc

SEQ ID NO: 180466 - DNA, 739 bp, Homo sapiens
  misc_feature: GYAE6OF01D8ZMR.39.14.B03.1.454.CMB.1.raw
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcacgtggaagcagcagtgtacgttgggtagttataactagtcgtctccgtaggtaaccaacgacgccaacccgaggaaccaaaaccgaccccccaaaactctaagttagtaattttagtacggtacggtacgtaacgttaacgtcccggtaccccgttacggttaacgggttttactaacgttcgtcctttacgtcgtacggtcctaccgtaacgttcgtacggacctaaccggtaccgtccccttccgtacgaacccttacgttccttccggtacgggtcccttaccggaacggtccgttagggaacgggacgacggtcgttagttaacttttaacgttacgcgacgtacgtactaacgtaacttagaaccgtaagaccaggaccgtacgtacccgttattcgggtttaggttacgggttaacgggttcccggggaggtaaccggggtaacccaacgggtcccgttaacccggttacccgggttacgttacggtacccgaaccgggtccccgtaaacccgggg

SEQ ID NO: 180467 - DNA, 729 bp, Homo sapiens
  misc_feature: GYAE6OF01EQAI3.39.14.B03.1.454.CMB.1.raw
  modified_base (266)..(266): a, c, t, g, unknown or other
  misc_feature (266)..(266): n is a, c, g, or t
tcagtcgcactagtcacgaccggtgctcgatttagtgtgagtagttccgcggggggggtctcaggaggcagcgctctcaggacatctccaccatgggccctgggctctgctgctcctcaccctctcactcagggcacgagggtcctgggcccagtctcgccctgactcagcctgcctccgtgtcgtgggtcctccgtggacagtcgatccacctattcctcctgaccactaggaacgcacgcaggtgacggtttggtgttataatnttgtcctcgtcgtaccaacagccaccgagaccaaacgcccccaaagtcatcgtaatttagaggagtacctagtaacgtccggtcccgtaggttagggttactaacgtcgtcttcgtcgtcggctacgtaacgtcgtacggacccaacgtacccggtccccttaccgtacggaaccttacgttcccgtacggtccgggcccttaccggtaggtaccggtaacgggaagggtaaccgacgggtacgttactaaagttttacgaccttcggaaccgacgtacttaacgtaaacttaacgtaacccgtaaagtccgaacgggttaccaccggtaaccttaccggtttggtttagggttcgggtttaaacgggtcccggggtaaggggaaccggttaacccgaaggttccgtaaccccgggttacccgggtacgtaccggttaaccgacccggtccggtaaacccggg

SEQ ID NO: 180468 - DNA, 866 bp, Homo sapiens
  misc_feature: GYAE6OF01CJE25.39.14.B03.1.454.CMB.1.raw
tcagtcgcactagtcacgaccggtgctcgatttagtgtgagtagttccggcggggggggtctcaggaggcagcgctctcaggacatcctccaccatggcctgggctctgctgctcctccaccctcctcactcgagggcacgacgggtccgtcgggccctagtctcgccctgacctcacgtcctcgtcccgttcgttcgtccgttcgggtcctccgtaggactacgtcgtactaccaacctacttccgttcctagacctacggtaggaacgccgtagtacgtacggtaggtttaacggttgggttaaggttaacttaacgttacgttcggtccttaccggtaacggtaaaccaaacgccgaaccgaacccgaacggaaaccccaaaacccggaaccccctaaactactaacttacggttaaacgtttcggtaggtaacgttaacgtaaacgttaaccggtccccgttaccggttacgggttaaccgggttactaccgttccgttcgttccgttacgaccgtacctaaccggtacgtaccgtaccgaacccgacggttaccccgtccctaaccgacgtacctactccgtcgtaccggtaccgtaccggtacggtcggtacggtacgggtacggacgggtacgttacgttaacgtttaacgttaccgtacgtacgtaaccgtacctaacgtaacgtaacgtaacgtaaccgtacgacgaacgtttttttttaccgaccgtttacgttacggttacggttacgggttacgggtaccgggtaacgggaaccggtaaccggtaccgtaccggttaacccggtacccggtaacggttacccgtaacccggtacccggtaacccggtaccccgg

SEQ ID NO: 180469 - DNA, 671 bp, Homo sapiens
  misc_feature: GYAE6OF01EI2ZC.39.14.B03.1.454.CMB.1.raw
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
  modified_base (539)..(539): a, c, t, g, unknown or other
  misc_feature (539)..(539): n is a, c, g, or t
  modified_base (567)..(567): a, c, t, g, unknown or other
  misc_feature (567)..(567): n is a, c, g, or t
  modified_base (571)..(571): a, c, t, g, unknown or other
  misc_feature (571)..(571): n is a, c, g, or t
  modified_base (590)..(590): a, c, t, g, unknown or other
  misc_feature (590)..(590): n is a, c, g, or t
tcagtcgcactagtcacgaccggtgctcgatttagtgtgagtagttccgcggggggggtctcaggaggcagcgctctcaggacatcctccaccatcggcctgggctctgctgcctcctccaccctcctcactcgagggcacgagggtccgtcgggcccagtctcgccctgacctcacgcctcgcctcgtcgtcgtgggtcctcgtgactgtcatcaccntcctctnacagtagagcgagcngtgtagttggttagttaataactntcgtctaccgtcgaaccaacacgaccaccgacgaaccaaacccgacccctaactctattagatttagacgtacggtactagtacgtccgggtaccttaacgggttacggttactacgttcgttccgttcgtacgtcgtacctacgtacgtcgtacggacccgaaccgtacccggtcccttcccgtacgaccttcgtcccgttacggtcgggacctacccggtagggaccggtaggaccgggtaagtccggttaattggttactttaacggttcngtacctacgtactataactaacgacganacgngtacacgtaccttaggttnttacgggtacgttcgggtaccgggaggtaccgacgtaacggttcccacggttaccgcgtaccggacgtccggaccgtcggg

SEQ ID NO: 180470 - DNA, 652 bp, Homo sapiens
  misc_feature: GYAE6OF01BZWDW.39.14.B03.1.454.CMB.1.raw
  modified_base (136)..(136): a, c, t, g, unknown or other
  misc_feature (136)..(136): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (265)..(265): a, c, t, g, unknown or other
  misc_feature (265)..(265): n is a, c, g, or t
tcagtcgcactagtcacgaccggtgctcgatttagtgtgagtagttccgcggggggggtctcaggaggcagcgctctcaggacatctccaccatggcctgggctctgctgctcctcaacctcctcatcagggcacngggtcctgggcccagtctgccctgactcagcctgcctcgtgtctgggtctcgtggacagtcatcaccntctccngcatggaancancagtgtacgttggtagttatactatgtctcctgtaccaacacnccaccaggaccaaccaccccaaactcatacgtatttagtaggtacggtacgtaacgtacgtcggtcccgtacgtacgggttactaagtcgtcttctcgtcgctacgagtcgtgaccacgtacggcctaccgtcgactatccgtacggtcgtccacggtacgacgtacggaacggacggtacgtacgtacgttaagtttacttaccgtcgtacgtacgtctcgtttaagttcgaacgttaacgttacgtagttacgtacgggttacttaggttccggttaccggtttaacgggacgggttacgggtaaaccgtacggttcgttaaccggttcgtttaccggtacggttaacccggaccgtaacccgacccggaacccttaaaccccgg

SEQ ID NO: 180471 - DNA, 629 bp, Homo sapiens
  misc_feature: GYAE6OF01BELMH.39.14.B03.1.454.CMB.1.raw
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (468)..(468): a, c, t, g, unknown or other
  misc_feature (468)..(468): n is a, c, g, or t
  modified_base (533)..(533): a, c, t, g, unknown or other
  misc_feature (533)..(533): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctctcactcagggcacgagggtcctgggcccagtctcgccctgactcagcctcgccctcgtgtctcgggtctccgtggacaggtcatccgaccntctcctgctacgtaggaacnccagacagtcggtacgttggtagtttactaacttctttctccgtaggtaccaacacgaccaacccgaggaccgaaaaccgccccctaaaactcaacgtgtatttagtgagtcgtaagtaacgtccggtccgtacgtaagggttttactaacgtcgtctttcgtcgtacggctaccgtaagttcgtcggaacctaccgacccgtcccttaccgcgacctactcgtccgtaggtccncgtagtccgtaggacggtacgcggtacgtagttatagtctgctagtactctaatacacgatacgngacagacctgttcttggtacggttacgtacgggaacgtacggacgtacgaccgtcggtaaaccgttccgtaccggacaccggaccgtacgtccccg

SEQ ID NO: 180472 - DNA, 744 bp, Homo sapiens
  misc_feature: GYAE6OF01BR5Z2.39.14.B03.1.454.CMB.1.raw
  modified_base (232)..(232): a, c, t, g, unknown or other
  misc_feature (232)..(232): n is a, c, g, or t
  modified_base (365)..(365): a, c, t, g, unknown or other
  misc_feature (365)..(365): n is a, c, g, or t
tcagtcgcactagtcacgaccggtgctcgatttagtgtgagtagttccgcggggggggtctcaggaggcagcgctctcaggacatctccaccatggcctgggctctgctgctcctcacccctcctcactcagggcacagggtcctgggcccagtctcgccctgactcagcctcgcctccgtgtcgtgggtcctccgtggacagtcgatccaccatcctcctgcacgtggaanccagcaggtggtacggttggtgttaataactatgtcctccgtacggtaacccaacacgccaaccgacggaaccaaaccgacccccaaatcatgtaatttacaggtagtacgtaacgtacgtcccggcctaggngggtctacttacgtccgttctccgttcgtcgtcctaaccgtagtccgagggtaaccacgtacccggcccttacccgactacccgtacttcccgttacggtcggtcccgtacccgtacggtcgtaacgggaacggaccgggtacggtactacgggttaaactttaccgttacggttccgtacgtaacgtcttaacgttaactttaacgtaaccgtaaacgtaaccgttaaagttaacgttacggtttcccggtttaccgggtttaccggggacggggtaacccggtaaccgtacggtacccggtaccggttaacccggtaccgtacgggtacccgaacccggtacccggtaaccggtcccccgtccccgggtaccccccg

SEQ ID NO: 180473 - DNA, 607 bp, Homo sapiens
  misc_feature: GYAE6OF01AZ9I7.39.14.B03.1.454.CMB.1.raw
  modified_base (398)..(398): a, c, t, g, unknown or other
  misc_feature (398)..(398): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgccttccgtgtctgggtctcgtggacagtcgatcgaccatcctccgtagcacgtggaagtcaggtagtgacggtttggtgttaataactatgtctcctggtacaacagcaccacggacaaacgcccccaaacgtcagtacatttagtcgaaggtctaagtaagtccggccctcgaacggggtttctaagtcgtcttctctggctcaagtcgtagacaacgacgtcccnccgtcgaccactctcgcgggtcctcgacgcgtcggacggtaccgaagtccgttagatttaacttacgtcgtcacgtactatactaatacgtaagacgaacgctacgctacgttgtttcggtacggtttacggtcgggaccgggtacggaacgtaacgtccggtaccgtacccggtcgtaacggtaccgaccgacccgtacgggtccccg

SEQ ID NO: 180474 - DNA, 826 bp, Homo sapiens
  misc_feature: GYAE6OF01E5KOG.39.14.B03.1.454.CMB.1.raw
  modified_base (233)..(233): a, c, t, g, unknown or other
  misc_feature (233)..(233): n is a, c, g, or t
tcagtcgcactagtcacgaccggtgctcgatttagtgtgagtagttccggcggggggggtctcaggaggcagcgctctcaggacatctccaccatggcctgggctctgctgctcctcaccctctcactcgagggcacgagggtcctgggcccagtctcgccctgactcagcctgcctcgtgtcgtgggtctccgtggacagtcgactccacctatcctcctgcacgtggaacncagcgtaggttcggtacggtttaggtacgtttaataacttattcgttcctccgtacggtaacccaacgacgaccgaaccccgaggaacccaaaacccgtaccccctaaaactcgtaattacgttaattttaacgtaggtacggtacgtaagttaaccgtccgggtaccccttacgggttacgggttttactaacgttccgttacctttccgttcggtcggtacctaccgtaacgtccgtacggaaccgaacccggtacccggtccccttcccgtaccgtaaccgtacttcccggtacgtaccgggtccctaccggtacggtacgtacgggtaccgggaaccggtacggtaccgttaaggttaacttttaacgttacgtacgtaccgtacgttctttacgtttacgttacgtacgtaaacgttcggtaaaggttcggttaacggttaccgttttaggttcccgggtttaacggtaaccggggttaaaggggtaccgggtaaaccgttaacgggttccgttaacgttccccggttaacggttacggtaacccgaaccccgggtaaccccgtaaacccggtacccctaaaccccgg

SEQ ID NO: 180475 - DNA, 695 bp, Homo sapiens
  misc_feature: GYAE6OF01ANSS3.39.14.B03.1.454.CMB.1.raw
  modified_base (577)..(577): a, c, t, g, unknown or other
  misc_feature (577)..(577): n is a, c, g, or t
  modified_base (619)..(619): a, c, t, g, unknown or other
  misc_feature (619)..(619): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctggcctgacacagcctgcctccgtgtctgacgtactccgtggacaggtcgatccaccattcctcctagcctacgtacgggaaccaggcaggtggtacggtttggtagtacttaattaatttacgtcgttaccttccgttcggttacccaaacgtacgtctattaccgacggtacgacggtacccgtacccccgtaaaaccttactttaagtttagtacggtacgggtttccgtttccgggtcccggtacccgtttacgggttacggggttttaccgttacggttcccgtccgttccgtccccggtccttaaccgtacggttcgtacggacctaacccgacccggtcccttcccgtacgacctacgttctacgtacgtacctccggacgtcgtggaacggtacgtaggacgtacgtacttatntacgcacgtcctactatactacgtagtatactacgtagtacncgtcgtcgcgtcggtacggacggtacgtacgtcggtacgtccgtactacgggaccacgccgtacggccgtacccgg

SEQ ID NO: 180476 - DNA, 740 bp, Homo sapiens
  misc_feature: GYAE6OF01DIK3T.39.14.B03.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (600)..(600): a, c, t, g, unknown or other
  misc_feature (600)..(600): n is a, c, g, or t
  modified_base (623)..(623): a, c, t, g, unknown or other
  misc_feature (623)..(623): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctctacactcgagggctacgacgggtcctagggcccagtctcgccctgactcgacgtcctgcctcgtgtcgtaggtcnccgtgacagtcatcacatccgctgactagtcggaancagtcaggtcggtacgttgggtaagttaactaacgttacgtcggtccttacccgtaggttaaccaaacaccggacccgaaccgaacggaccccaaaaccgaacccccgtaaaacgtccaacgttagtaactttagtacggtaggtccgtaaacgttacgtcccgtacccgtaggtttacgggttactacgtcgttaccgttcgtacgtcgtacctacggtaacgttcgacgtacgtaactacgtcggtcccttaccgtacgtaccgttactcccgttcggtacggtacctcggtaacggtcggaacggtaacggccgtaagtccgttaagtaacgttttaacgcgtaccggtattaggaccctttanaaagttaaccaaagaccggttanaacgggtcaacgtaccgttccttagggttacgttacggtaccgggtaggggacccgtaaagggaccaacggttaccgtccgggtaaacccgtccggtacgtcccgtaaacgcccggg

SEQ ID NO: 180477 - DNA, 518 bp, Homo sapiens
  misc_feature: GYAE6OF02JAM8C.39.14.B03.1.454.CMB.1.raw
  modified_base (134)..(134): a, c, t, g, unknown or other
  misc_feature (134)..(134): n is a, c, g, or t
tcagtcgcactagtcacgaccggtgctcgatttagtgtgagtagttccgcgggggtctcaggaggcagcgctctcaggacatctccaccatggcctgggctctgctgctcctcaccctcctcactcagggcacngggtctggggcccaggtctaggccctgaactacgagcctgcctccgtgtctgggtctcctggacagtcgatcaccatctcctgcactggaagcagcagtgacgttggtggttataactatttctcctggtaccaacagcacccaggcaaagcccccaaactcatgatttatgaggtcagtaatcggccctcaggggtttctaatcgtcttctctggctccaagtctggcaacacgcctccctgaccatctctgggctccaggctgagacgaggctagattatacgtgccagctcatactacaaagcagcagccattctgtgtagttcggcggtaacggaccaagtcctaggacccttcgtacggtcaacgtcccgaaggtcccg

SEQ ID NO: 180478 - DNA, 489 bp, Homo sapiens
  misc_feature: GYAE6OF02H4LI8.39.14.B03.1.454.CMB.1.raw
tcagtcgcactagtcacgaccggtgctcgatttagtgtgagtagttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaaagccccccaaaactcatgatttatgaggtcagtaatcggcctcaggggtttctaatcgcttctctggctcaagtctggcaacacggcctcctgaccatctctgggctcaggctgaggacgaggctgattattactgcagctcatatacaagcagcagcatcttgtgtagtcggacggaggaccaagctgaccgtctaggcagccaacgg

SEQ ID NO: 180479 - DNA, 504 bp, Homo sapiens
  misc_feature: GYAE6OF02GF91T.39.14.B03.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccngcagtgacgttggngcttataattatgtctcctggtttccaacagcattcaggcagcgccccgaaactccttaatttatgaggtctttcgtcggcccctcaggggtttctagtcgcttctccggctccaagtctggcaacacggcctccctgaccatctctacgactccaggcttgaggacgaggctgactattatgcagctcatatactgaagtcaatggtactcactggctgttcggcggaggacctagttgaccgtctaggtcagccaggctccgg

SEQ ID NO: 180480 - DNA, 620 bp, Homo sapiens
  misc_feature: GYAE6OF02IS75Z.39.14.B03.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccaggtctgccctgactcagcctgcctccgtgtctgggtctcctggacagtcgatcaccatctctgcactggaagcagcagtgacgttggtgttataactatgtctcctggtaccaacagcacccaggcaaacgcccccaaaactcatgatttangaggtcaagtaatccggcctcgtagggtttactaatcgtacttctctggctaccaagtcgtacggacaaccgaccggcccttcccgtgacccatccgtcgtcgggcctccgaggtctaggacggacggaggcgtagtacgtttacttactggtaccaggtcctacgaattaacgtaactaacggtacaacggacgtaacggacctaacgttcgtttaggtcgggttaacgttccggggaccggaacggggtaacccaaggtccgttacggtacccggttacccgttaccgggtacctaccggtaccccgtaacggg

SEQ ID NO: 180481 - DNA, 735 bp, Homo sapiens
  misc_feature: GYAE6OF02JOK9I.39.14.B03.1.454.CMB.1.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (305)..(305): a, c, t, g, unknown or other
  misc_feature (305)..(305): n is a, c, g, or t
tcagtcgcactagtcacgaccggtgctcgatttagtgtgagtagttccgcgggggggtcggtcgaggaggcgagcgctctcatgacatctccaccatggcctgggctctgctgctcctcaccctcctcactcagggcacaggtctgggcccagtctgccctgactcagcctgcctccgtgtctgggtctcctggacagtcgatcacanctccngcactggaaccagcagtgacgttggtggttacaactatgtctctggtaccaacaacaccccggactaaacgcccccgaagtcatcgatttangtacgtccactaaactccggacccctacgtaggggtcgttactaaactcgtccttactccgttagggcctcccgaaagttccgtgggtcctaaaccgaccgggtccctcccccgttggaaccctactccttcgtcgggtccctaccgtacgggtcctggtaacgggtaccggaacgggtacttacggttaacgtttacgtttaaccttcggtccgtaaaggccttaacggtacttaactttacgaaacgttacctaacgggttaaaacttaacggtttacgtttaccccgtttttacggggtaacccgggttaacgggggtaacccgtaacggtaacccgttacgggttaaaccccggttccgttaacgggtacctaaccggacccggtaaccggacccgttacccggtcccccttacccggggttaccc

SEQ ID NO: 180482 - DNA, 523 bp, Homo sapiens
  misc_feature: GYAE6OF02GQO4U.39.14.B03.1.454.CMB.1.raw
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggacaaacgcccccaaactcatgatttangagtcataancgcctntagggttctatcgcttctctggctcagtctgacacacgcctcctcgaccatctcgtcggcctccgaggctagaggacgagtctgtattactactgcagctnatatacgancgancgancctactcttgtggttacgtcgggtacgggaacgggaccacggtcgtacggtacccgttaccgtagtccgaccgacccgtaacgg

SEQ ID NO: 180483 - DNA, 501 bp, Homo sapiens
  misc_feature: GYAE6OF02F89Y6.39.14.B03.1.454.CMB.1.raw
  modified_base (303)..(303): a, c, t, g, unknown or other
  misc_feature (303)..(303): n is a, c, g, or t
  modified_base (448)..(448): a, c, t, g, unknown or other
  misc_feature (448)..(448): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaagcccccaaactcatgatttangaggtcagtaatcggccctcagggtttctaatcgcttctctggctcaagtctggcaacacggcctccctgaccatctctgggctccaggctgaggacgaggctgatttattactgcagctacatactaacaagcagcagcacttnttgtggtagtcggacggaggaccaagctcgaccgtctaggtcacgccctaagg

SEQ ID NO: 180484 - DNA, 496 bp, Homo sapiens
  misc_feature: GYAE6OF02F561G.39.14.B03.1.454.CMB.1.raw
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaacgcccccaaactcatgatttangaggtcagtaatcggcctcgaggggtttctaatcgcttctctggctcaagtctgcaacncggcctcctgaccatctctgggcctcgaggctgaggacgaggctgattattactgcagctnatatacaagcagcagctactcttgtgtgttcgggcggacggacagcgtagaccgtctaggtcacgccaacgg

SEQ ID NO: 180485 - DNA, 652 bp, Homo sapiens
  misc_feature: GYAE6OF02IT5JP.39.14.B03.1.454.CMB.1.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctccgtggacagtcgatcaccatctcctgcactggaagcagcagtgacgttggtaggttataactatntctccgtgtacaacagcaccagacaaacgccccaaactcatntattatgagtcagtaacnccggtcctgtagggtttcaactcgcttctcgtcgtactacgaagttcgtacggaccaacgtaccggtccctccccgtagaccctactccgtcgtacgggcctccgacgggtctaggacggaaccgacgggtccgttaagtaagttttaacttcgacgtccgtaacgtcctagtaaacttaacgtaaacaacggtaaccaacgggtacctaacgtacctaacgtttccgttggttaacggtttacggtacggggtaacggtaaccggggaaacctaacgggcccgttacggtacccggttaccgtaaccgggtaccgaccggtaacccgtaaccgg

SEQ ID NO: 180486 - DNA, 505 bp, Homo sapiens
  misc_feature: GYAE6OF02ILIEW.39.14.B03.1.454.CMB.1.raw
  modified_base (430)..(430): a, c, t, g, unknown or other
  misc_feature (430)..(430): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgagactcctggacagtcgatcaccatctcctgcactggaaccagcagtgacgtttggtggttacaactatgtctcctgtaccaacacaccccggcaaacgcccccgaagtcatgatttatgacgtcactaatcggccctcgaggggtgtctaatcgcttctctggctccaagtctggcaacacggcctccctgaccatctctgggctccgaggctggacggacgaggctagatttatactgcagctnatattcaagcaagtatactgttcctttcggcgaggacagctcgaccgtcgtagcacgccaggctcgcccgtgtcc

SEQ ID NO: 180487 - DNA, 538 bp, Homo sapiens
  misc_feature: GYAE6OF02IJSS1.39.14.B03.1.454.CMB.1.raw
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagccgccccgaaactcttaatttatgtagttctttcgtcgccctcgagggtttcagtcncttctccggctccaagtctgcaacncggcctccctgaccatcctctacgacctccaggctggaggacgaggctagacttattattgctagctcattatactgtaagtacaattggtactaccgagtggtcttcggtcgggcgggtacgggtacctaaggttcgaccgttcgtacggtccgacgccgtacggctaccccgg

SEQ ID NO: 180488 - DNA, 507 bp, Homo sapiens
  misc_feature: GYAE6OF02HMEYU.39.14.B03.1.454.CMB.1.raw
  modified_base (302)..(302): a, c, t, g, unknown or other
  misc_feature (302)..(302): n is a, c, g, or t
  modified_base (417)..(417): a, c, t, g, unknown or other
  misc_feature (417)..(417): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaagcccccaaatcatgatttangagtcagtaatcggccctgaggggtttctaatcgcttctctggctcaagtctggacaacgacggcctcctcgaccatctctggcctcaggctgaggacgaggctgattattacgngcagtctcatatacaagcagcagcctatcttgtggttagttcgggacggacggaccagcgtacgaccgtcgtacggtcacgccctaacgg

SEQ ID NO: 180489 - DNA, 554 bp, Homo sapiens
  misc_feature: GYAE6OF02JEFCY.39.14.B03.1.454.CMB.1.raw
  modified_base (224)..(224): a, c, t, g, unknown or other
  misc_feature (224)..(224): n is a, c, g, or t
  modified_base (364)..(364): a, c, t, g, unknown or other
  misc_feature (364)..(364): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtggttataactatgtctcctggtaccaacacgccaccaggacaaacgaccccaaactcatgatttatgaggtcagtaactccggcctcgagggtttctaagtcgtcttctctggtctaccagtcngacaacaccggcctccctcgacctactcctcgtcgggcctccgaggctaggacggacggaggtctagtatttactactcgcagtctacatactacgaagcgagccagtcctacgttcttggtggttacgttccgggacggacgggaaccgagtccgtcggtacccgttccgaggtccacggcctaacggg

SEQ ID NO: 180490 - DNA, 491 bp, Homo sapiens
  misc_feature: GYAE6OF02G9C39.39.14.B03.1.454.CMB.1.raw
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaagcccccaaactcatgatttatgaggtcagtaatcggccctcaggggtttctaatcgcttctctgctcagtctgcacacggcctcctgaccatctctgggctccgaggctgaggacgaggctgattattactgcagctcatatacaagcagcagcactcttgtggtattcggcggacggacagctgaccgtcctaggtcacgcccgacgg

SEQ ID NO: 180491 - DNA, 613 bp, Homo sapiens
  misc_feature: GYAE6OF02JVH8F.39.14.B03.1.454.CMB.1.raw
  modified_base (311)..(311): a, c, t, g, unknown or other
  misc_feature (311)..(311): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctccgtgaccacgtggaacgccagtctaggtgacgttggtaggttataactatgtctcctggtaccaacacgcaccagcaacgaccccaaatcatgatttangagtcaagtactcgcctacgtagggtttacaatcgtcttctcgtcggtcctacgaagtcgtcggaccaacgtacccggcccttacccgtacgacctacgttcctcggtcgggcctaccgagtcgtacggaggaccgtaggtactagttacgttaagtctacggctacggtccttactacgttcgtacctaacgttacgtagtacgtaaggttctttaagtcgtacgttacggtaacggtcgggaacctaagggtcctacgtcgttaccgtacgtacgtacgacccgtaccgaccctaacccg

SEQ ID NO: 180492 - DNA, 523 bp, Homo sapiens
  misc_feature: GYAE6OF02G18IU.39.14.B03.1.454.CMB.1.raw
  modified_base (401)..(401): a, c, t, g, unknown or other
  misc_feature (401)..(401): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaacgcccccaaactcatgatttatgaggtcagtaatcggccctcgaggggtttctaatcgcttctctggctcaagtctgcacacggcctcctgaccatctctcgggctcaggctgaggacgngctgattattactgcagctctatttgactaatcagtgagtcttagtgtcgttacggaaggttcgggaacctaaggtctacgttcgtaccgttaggtccacggacccacggccctaaaccccg

SEQ ID NO: 180493 - DNA, 653 bp, Homo sapiens
  misc_feature: GYAE6OF02JDHSC.39.14.B03.1.454.CMB.1.raw
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctccgtggacagtcgatccacctatcctcctgccacgtggaagcagcaggtgacgttggtagttataactatgtctccgtggtaaccaacacgaccaccaggacaaaccgaccccaaancatagtattangagtcaagtaactccggtcctaggtacgggtttactaacgtccgtcttactcgtacggtcctacgtaacgtcgtacggacaaccgaccggtccctccgtacgacctattcgtcgtcgggacctccgaggtcgtaggacggacgacggtcgtagttaacttaacgttacgtcgtacgtacgtacctactaacttaacgaacgtaacgcgaacgaccgacgtactaccgttcgttggttacggttacgttccggggaccggaacgggtaaccctacggtaccgttaccggtacccggttaccttaaggggtacccgaccggtaccccggtaaccggg

SEQ ID NO: 180494 - DNA, 644 bp, Homo sapiens
  misc_feature: GYAE6OF02IT31X.39.14.B03.1.454.CMB.1.raw
  modified_base (224)..(224): a, c, t, g, unknown or other
  misc_feature (224)..(224): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtagttataactatgtctctcgtacaacagccaccagacaaacgccccaaactcatgtatttatgaggtactagtaactcggtccctgtacgggtttactaagtcgtacttctcgtcggtctacgtaacgttcgtcgacctaacgaccggtccctacccgtacgacctacttccgtacgtcgggtcctccggacgtcgtacggacgggacgaggtcgttagtactttaacgttacgtcgactacggtcttatacgtttagtactaactacgtagtacggtacgtctttacgttacggttccgtttaacgggaacggttacgggaaccttaacggtccgttaacgttacccgttaccggttacggtaccgtaacccggtaccccgtaaccggacccgtaacccccgg

SEQ ID NO: 180495 - DNA, 681 bp, Homo sapiens
  misc_feature: GYAE6OF02JA7T5.39.14.B03.1.454.CMB.1.raw
  modified_base (267)..(267): a, c, t, g, unknown or other
  misc_feature (267)..(267): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaanagcacccaggacaaacgaccccaaactcactagtatttaatgtagtcagtaacgtccgccttcgtaggggtttctaacgtcgtcttcgttcgtcggtaccttccgtaaacgtccgttagggaccaaaccgtacccgggtcccttccccgtcggtaaccctacgttcccgtcgttcggggcccttacccgacggtacgttacgggaacgggtaccggtaggtccgtagttaacgtttaactttaccgtacgttaccgacgttaccgtacgtaacttaaacgttaaccgaacggtaccgtaagacgtaccgaccttaacgtttccgttagttcgggtaacgttcgggacggtacgggaaccgtaacgtccggtacgtaccggtacccgttagggtacctaccggtaccgtaaccgg

SEQ ID NO: 180496 - DNA, 562 bp, Homo sapiens
  misc_feature: GYAE6OF02I54XM.39.14.B03.1.454.CMB.1.raw
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
  modified_base (456)..(456): a, c, t, g, unknown or other
  misc_feature (456)..(456): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtgttataactatgtctctgtaccaacagccaccgaggaccaaacgcccccaaactcatgtattatgagtcagtaactcggacctcgtagggttctaatcgtcttctctgctcagtcngacaacnccgcctcctgaccatctcncggtctccgaggcctagacggacgagctgtatttattctcgcagtctactaatactaacgaacgtcacgcgacnctactttccgtgttacggttacgttccggggaccgggtaacgggaacccgtaagtccggtacgtaccccggtacgttaccggtacgacccggtaccgtaacccggg

SEQ ID NO: 180497 - DNA, 589 bp, Homo sapiens
  misc_feature: GYAE6OF02ILJID.39.14.B03.1.454.CMB.1.raw
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctcctgcactggaancagcagtgacgttggtgttataactatgtctcctgtaccaacngcaccaggccaaacgcccccaactcatgatttangagtcagtaatcggccctcgaggggtttctaatccgtcttactcgtcggtctcctaagtcgtggaccaacgaccggtccctccctacgaccctactccgtacgtcgggctccgacggtcgtggacgggacgaggtcgttagtaatttacgtacgttcgactagtctacaattacctacgaacgtcagacacgaccttactcgttgtacggttagtccgggacgggtacgggaaccagtccggtacggacccgttaccgttacggtccaccggtacccgtaaccggg

SEQ ID NO: 180498 - DNA, 523 bp, Homo sapiens
  misc_feature: GYAE6OF02GLNW3.39.14.B03.1.454.CMB.1.raw
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaagcagcagtgacgttggtggttataactatgtctcctggtaccaacagcacccaggcaaacgcccccaaactcatgatttatgaggtcagtaatcggcctcaggggtttctaatcgcttctctgctcaagtctgcacacgcctccctgaccatctctggctccaggctggacggacgagcgtgattattactgcagctcaatataactaagctagcacgcaccttcttgtggtacgtttcgggacggtacgggaccaagccgtacggtaccgtccgtaggtccgtacgccccgtaacggg

SEQ ID NO: 180499 - DNA, 735 bp, Homo sapiens
  misc_feature: GYAE6OF02JEZAH.39.14.B03.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagtcgcactagtcacgaccggtgctcgatttagtgtgagtagttccgcgggggggggtctacaggacggcagcgctctcaggacatctccaccatggcctgggctcgtgctgctcctcaccctcctcactcagggcacagggtcctgggcccagtctcgccctgactcagcctgcctcgtgtctggtctcctggacngtcgatcaccatctctgcacgtggaancagctagtcgacgttggtaggttataacgtagtcgtctccgtacggtaaccaacgaggaccaaccgaggtaccgaaaaccgacccccgtaaacgtacaagtcgtaatttaacgtacggtaacggttaactaaacgttaaacgttccggaccccgttaacggttaacggggtttacctaaacgttccggttaccttacgtttccgtacggtaccgttaccgaacggttcgtacgacctaaacgcccggtacctacccgtacgaaccctacgttcgtacgcggtaccgttacgacggtctaggaacgggtacgacgcgttagtacgtttactacgtagccgtacgtaccgttacgtacgtttacgactaacgttacgtaacgttggtaccgttaacgttacgttacggttacgttaacggggtaacggtacgggtaacgtaacggttcgtaaccgttacggttaccgttaaggtacccgacggtaacccgtaccggtacccctaaacccgg

SEQ ID NO: 180500 - DNA, 733 bp, Homo sapiens
  misc_feature: GYAE6OF02J3AV0.39.14.B03.1.454.CMB.1.raw
  modified_base (268)..(268): a, c, t, g, unknown or other
  misc_feature (268)..(268): n is a, c, g, or t
  modified_base (325)..(325): a, c, t, g, unknown or other
  misc_feature (325)..(325): n is a, c, g, or t
  modified_base (578)..(578): a, c, t, g, unknown or other
  misc_feature (578)..(578): n is a, c, g, or t
  modified_base (601)..(601): a, c, t, g, unknown or other
  misc_feature (601)..(601): n is a, c, g, or t
  modified_base (643)..(643): a, c, t, g, unknown or other
  misc_feature (643)..(643): n is a, c, g, or t
tcagtcgcactagtcacgaccggtgctcgatttagtgtgagtagttccggcggggggggtctcaggaggcagcgctctcaggacatcctccaccagtcggcctgggcttctgctcgccttcctccaccctcctcactcgagggcacggtacgggtcctacgggccctaggtcctcgaccctgacctcgacgtcctcgtccctacgtgtcgtcgggtctccgtggactggtaccactccacctcttcctacgcgaccgtacgtaggacncgagtcgtaggtcgtcgttaggtacttaactattccgtcgtaccacgtacgaacccngacgaccgaaccgtacgaacctaaaccccgtacctaagtcttagttacgtaggttacgcggtaacgtccgttaacgtacggcccgttaccggttaggtttacggtacctaccgtcccttgtaccgtcggacgtaccctaacgggtctacccggacggtaaccccgcccttacccggttccttaccgtacaccgttttcgcccggttaaggccgaccgtaacgggtagtcgaacgggtacggtatacggtttanctttaacgtcgtaggtccgtaancgttaacagtaccgagtaaccggatccggagtacctacggtnttacggtacggttacgcgggtaacggccggtagaaccgtacgtacggtacccgttacgggacctacgaccgtacccggacgttcccggcc

SEQ ID NO: 180501 - DNA, 657 bp, Homo sapiens
  misc_feature: GYAE6OF02HFRX7.39.14.B03.1.454.CMB.1.raw
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccntctctgcactggaagtcgcgtagtggtacgttggtacgttaataactntcgtctccgtcgtaaccaacgacgcccaacccgaggaccaaaccgtaacccccgtaaactcgaacttacgttaactttacgtacggtacggttacgaaggttaacgtcccggtccctacgggttacggggtttacctaagtcccgttacttcgttcgtcgggtcctaccgtacgtccgtaggacctaacgtacccggccctccgtacgacctacgtccgtcgtcggtccacgacggtcgtaggacggacgacggtactcgttaacttacgttcgtcgactctctactaatacgtacacgtcacgacacgtctacgtcttaggtcgttacgtcgggacggaacggtacgacgtcgtaccggtaccgttacggtacggtccgaccgtaccggtacgtccccgg

SEQ ID NO: 180502 - DNA, 662 bp, Homo sapiens
  misc_feature: GYAE6OF02H4U68.39.14.B03.1.454.CMB.1.raw
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatactccaggcaacaccgcccccaaaactcactactatttactggtaggtactaagtaactccggccctacgtacggggtttctaacgtcgtctttctctcgacctacgaacgttcgtacggaccaaccgaccggtcccttaccccgttacgaacctacgtttacctcgtcgggtcccttacgacggtcgtagggacgggtaccgtaaggtcgttagttaacgtttaacttacgttcgaccagtccgttactagttttcgaactaagttcctaaggtggtaaggttactttaggtacgttcgtttacggggaaggttaccgggaaccgtaacggttaccacgttcccggttacgttacgggtccaaccggttaccccgaacggtaacccccg

SEQ ID NO: 180503 - DNA, 574 bp, Homo sapiens
  misc_feature: GYAE6OF02JG7AS.39.14.B03.1.454.CMB.1.raw
  modified_base (225)..(225): a, c, t, g, unknown or other
  misc_feature (225)..(225): n is a, c, g, or t
  modified_base (298)..(298): a, c, t, g, unknown or other
  misc_feature (298)..(298): n is a, c, g, or t
tcagtcgcactagtcacgaccggtgctcgatttagtgtgagtagttccgcgggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcaggtgacgttggtgttataactatgtctctggtacacagcaccaggcaaacgccccaaatcatgattangagtcagtaactcggacctacgtagggtttacaaagtcgtcttactgcggtcctacaaagttccgtggacctaaacgaccggtaccctcccgtagaccctaatccgttacgtcgggccttacgacggtcgtagggaacggaacggtggcctaggaactttattactgcagtctgaacttacgtaacaacggcacgacacgtaacactttgtcggttagacgttccggaggtaacggaccagtcgtacgaccgtcgtaggtcgacgaccctaacggg

SEQ ID NO: 180504 - DNA, 700 bp, Homo sapiens
  misc_feature: GYAE6OF02HZXZE.39.14.B03.1.454.CMB.1.raw
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagccagcagtgacggttggtaggttataactatgtctccgtaggtaccaacagaccaccaggacaaaccgaccccaaactcaatagtactttaagtagacggtactaagtaacgtcccggtaccgttacgtaaggggttttactaaacgttccgtacgtttccgttccgttacggtccttaccgtaaacgttcgtacggaccaaccgaccggtacccttacccgtacgaaccctacgttccgttaccgtcgggtacctccgtaggtccgttagggacgggacggacggtcgttagttaactttaacttacgtcgacacgtactacgtactaactaacgaacgcgtacgacgaacgtcctacgttaccgtttaggtacgggtttacggtacgggtaccggggtaacgggtaacccgtaacggaccgttacggtacccgttacccggttaaccgggtaccaccggtacccgtaacccggg

SEQ ID NO: 180505 - DNA, 506 bp, Homo sapiens
  misc_feature: GYAE6OF02FYYMU.39.14.B03.1.454.CMB.1.raw
  modified_base (225)..(225): a, c, t, g, unknown or other
  misc_feature (225)..(225): n is a, c, g, or t
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (366)..(367): a, c, t, g, unknown or other
  misc_feature (366)..(367): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtggttataactatgtctctggttaccaacagcaccaggcaaacgcccccaaactcatgattangtagtcagtaatcggcctcgaggggtttctaatcgcttctctggctcagtcngcancgctccnncanctnggctcagctgagcgagctagattattacngacagctnaatatacaagcagcacnctactcttgtggtacgttcgggacgtacgggactaacggcgtacgtaccggtaccgttaggccgtacgcccgtaacggg

SEQ ID NO: 180506 - DNA, 646 bp, Homo sapiens
  misc_feature: GYAE6OF02JAEYW.39.14.B03.1.454.CMB.1.raw
  modified_base (226)..(226): a, c, t, g, unknown or other
  misc_feature (226)..(226): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (500)..(500): a, c, t, g, unknown or other
  misc_feature (500)..(500): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctctcactcagggcacgagggtcctcgggcccagtctgccctgactcagcctgcctccgtgtctggtctctggacagtcgatcaccatctcctagcacgtggaancagcgtacgtggacgtttgggtagttaatactatgtctcgtgaaccaancgacacaggacaaacgccccaaanctatgtaatttnagacggtactagtaacgtccggtacctcggttaagggttctaagtccgtcttctacgtcgacttacacgtcgtaggaccaacgccgtcctccgtacgacctacgtctcgacgggtcctaccggagtccgtaggaacggtcgacgtcttaaggtacttaataccgagtactacggtcttagttacggttnaaccgttacgtacgtagttaggacggttattacgttacggttccgttaacgggtaagggtcccgggtaaacctagggtaccgttaacgggtttactacgggtttaccgaccgtacccggaccccggtttaacggacccccctaacg

SEQ ID NO: 180507 - DNA, 563 bp, Homo sapiens
  misc_feature: GYAE6OF02FZ6JD.39.14.B03.1.454.CMB.1.raw
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaancagcagtgacgttggtgttataactatgtctcctgtaccaacagcaccaggcaaagcccccaaactcatcgattangagtcagtatcgcctgtagggttctagtcgtcttcgtccggctccgaagtcgtaggacaacgcggaccctccgtacgaccatcctactacgacctccgaggtccaggacggacggagcgttagacttattagttgctagctacagtactacgtgaagttactaagtggtactccgagttcggtacgttggtacgggcgggtaacggacgtaacggttcgacccggttactaggtcccgaacgacccgtaaggccttaccccggg

SEQ ID NO: 180508 - DNA, 716 bp, Homo sapiens
  misc_feature: GYAE6OF02ITS3B.39.14.B03.1.454.CMB.1.raw
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatcctccgtgccacgtggaacgcagcaggtgacgttggtaggttataactatgtctccgtagtaccaacacgaccaccgaggaccaaaccgaccccaaactcaacttgtaatttagaggtaacggtctaagtaacgtccggtcctacggttaacgggtttactaacgttccgtcttacgttcgtacgtaccttaccgaacgttcgtacggaccgtaacgtacccggtcccttcccgtacgtaccctacttaccgtcccgtggtccctacgtacggtcgtacgggacggaaccggtcggtacgttaagtacttttaacgttaccgtcggtaccgacgttaccaccgttaaagttaaccgtaaacgaacgtaactaaccggtactaccggtaacctaccgttttagtcgggtttagttaaccgggttccgggaacgggtaacccggaacgtacgacggttacccgtacccggtaccggtacggacccggtaccgtaacccggtaccggg

SEQ ID NO: 180509 - DNA, 538 bp, Homo sapiens
  misc_feature: GYAE6OF02FKF5U.39.14.B03.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
  modified_base (455)..(455): a, c, t, g, unknown or other
  misc_feature (455)..(455): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaancagcagtgacgttggtgttataactatgtctcctggtaccaacagccaccaggcaaacgcccccaaactcatgattangagtcagtaatcggcctagtagggttctaatcgtcttctctcggctccaagtcgtggacaacnccggcctcctgaccacgtctcgtcggcctcgaggctagaggaacggnggtcgtgatttattacgtgcagctacattactacagacagcanctactgttgtaggtacgttcgggacgggtacgggacgtaacgcgttacggaccggttccgtaggtaccacggacccgtaacgg

SEQ ID NO: 180510 - DNA, 589 bp, Homo sapiens
  misc_feature: GYAE6OF02GHL31.39.14.B03.1.454.CMB.1.raw
  modified_base (302)..(302): a, c, t, g, unknown or other
  misc_feature (302)..(302): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctctggtaccaacagcaccaggccaaacgccccaaactcatgatttangagtcagtaatcgcctgtagggtttctaagtcgtcttctctggtctaccaagtctggacaacgacggtccctccctagacctatctcgtgggtcctaccgaggtctaggacggacgaggcgttagtaactttagttaccgtgactacgtctactaataacgtaacgaagtactagacacgtactacgttcgttaggttagggttacgttcggggaccgggtaacggggaacccaacggtccgtacggtacccgttaccgtaacggtccgtacggacccgtaaccggg

SEQ ID NO: 180511 - DNA, 706 bp, Homo sapiens
  misc_feature: GYAE6OF02JA6NC.39.14.B03.1.454.CMB.1.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
tcagtcgcactagtcacgaccggtgctcgatttagtgtgagtagttccgcgggggggggtctcaggaggcagcgctctcaggacatctccaccatggcctgggctctgcttctcctcaccctcctcactcagggcacagggtcctgggcccagtctgccctgactcagcctgcctccgtgtctgggtctcctggacagtcgatcaccatctcctgcactggaancagcagtgacgttggtggttataactatgtctcctggtaccaanagccaccaggacaaacgacccccaaactcatgattttacgtaggaggttacaggttaacgtcccggtacccttcggtacgggggttttacctaaacgtccgtcctttacctccgttgggtaccctaccgtaagttccgtaggaccaaaccgaccggtcccctcccgtacgaaccctagttcctccggttcgggccctacccgagggtaccgttgggaacgggtacggacgggtcctaggttaactttaacgttacgttacgcgtacggtccttacattaacttaccgaaagtccgaacggacctagacccttacgttacgtttcgggttacggttacggttccggggtacggggtaaccgggtaccgtaacggtccggttaacgtaccccggttaccgtaacgggtaccgaaccgggtaccccgaacgggttcccccg

SEQ ID NO: 180512 - DNA, 738 bp, Homo sapiens
  misc_feature: GYAE6OF02GX176.39.14.B03.1.454.CMB.1.raw
  modified_base (226)..(226): a, c, t, g, unknown or other
  misc_feature (226)..(226): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctcgcctccgtgtcgtgggtctccgtggacagtcgatcaccatctctgcactggaancagcagtgtacggttggtagttaatactatcgtctctacggtaaccaacgagaccaaccgaggaaccaaaacccgacccccaaaactccaagttacgtaatttagtaggacggtactaaggtaacgtcccggtacccgttacggttacggggttttacctaacgttccgtaccgtttcgtacgttacgggtaccttaccgtaacggttcccgttacggacctaaaccggtacccgtccccgttacccgtaccggaacctacgtttaccgttccggtacgggtaccctacccgggtacggtcgtacggggaacggtaccggacggtacgttaacgtaacgttttacgttacggcgtacgacgttactaaccgtaattaacgtaacgaacgcgaacgccacgtacctacgttgttacggttacggtaacggtccggggtaaggaaccggtacgtaacggtaccgtaccggtaaccggttccggaacggtacccgaccggttaacccggtaccgg

SEQ ID NO: 180513 - DNA, 597 bp, Homo sapiens
  misc_feature: GYAE6OF02FPH5F.39.14.B03.1.454.CMB.1.raw
  modified_base (294)..(294): a, c, t, g, unknown or other
  misc_feature (294)..(294): n is a, c, g, or t
  modified_base (411)..(411): a, c, t, g, unknown or other
  misc_feature (411)..(411): n is a, c, g, or t
  modified_base (455)..(455): a, c, t, g, unknown or other
  misc_feature (455)..(455): n is a, c, g, or t
tcagtcgcactagtcacgaccggtgctcgatttagtgtgagtagttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtgttatactatgtctctgtaccacagcaccaggcaacgccccaaatcatgatttangagtcagtaagtcgccctcgtagggtttcaatccgacttctcgtggcctccgaagtcgtggaccaaccgacccggtcccttccctagaccctacttccgtacgtcgggtcctaccgnggtccttaggaacgggtacgagggtcttagtactttacttacgngacctagccttacattaacacgaagtcgaagcgacgcctacgttacgtttggagggtttacggtccggggacgggtaacgggacccgaaggtcccggtacggtacccgttcccggtaagggacccaccggtaccccgaacgg

SEQ ID NO: 180514 - DNA, 711 bp, Homo sapiens
  misc_feature: GYAE6OF02HIMVU.39.14.B03.1.454.CMB.1.raw
  modified_base (166)..(166): a, c, t, g, unknown or other
  misc_feature (166)..(166): n is a, c, g, or t
  modified_base (224)..(224): a, c, t, g, unknown or other
  misc_feature (224)..(224): n is a, c, g, or t
  modified_base (318)..(318): a, c, t, g, unknown or other
  misc_feature (318)..(318): n is a, c, g, or t
  modified_base (522)..(522): a, c, t, g, unknown or other
  misc_feature (522)..(522): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactnagcctgcctccgtgtctgggtctcctggacagtcgatcaccatctcctgcactggaancagcagtgacgttggagttataactatcgttctctacggtaccaagacgccaccgaggaccaaaccgaccccaaactctaatcgtacttttagnggtacggtactaacgttaacgtccggtcccttacggtaggggttttacctaagtccgtctttccgtcgtcggaccttaccgaacgttcgttacgggaccaaaccggtccggtcccttcccgtacgacctacgtaccgtcgttacgggcctccggaggtccgtaggagggaaccggtacggtacttaggtaactttaagttccgngactaacgtcgtactaagttaacgtaacgtaacggactaacgtacgtacggtaaccttacgtaccggttttacgggtaacggtttacggttaccgggggtacggtaaccgggttaacccgaggtttacccggtacggtaccccggttacccggacggtttacccaacccgggtaccccgttaacccggg

SEQ ID NO: 180515 - DNA, 695 bp, Homo sapiens
  misc_feature: GYAE6OF02HAF48.39.14.B03.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacgagggtcctgggcccagtctgccctgactcagcctgcctcgtgtctggtcctctggacngtcgatcaccatcctcctgcacgtggaacncagcaggtgacgttggtacgttataactatgtctccgtagtaccaacacgccaccgagacaaacgacccccaaatcatacgtattacgtgacgtacaagttacgtccggtaccgtacggtacgggtttactactcgtaccttctcgtacgtctaccgacgttcgtacggaccaccgaccggtccctcccgtacgacctactccgtcggtggccctaccggacgtcgtaggacgggtacggacgtgtacggttaactttacgtaccgtacgtacgtacgtaccttaactaagttaaaccgtaaccgaaacggtccgtaaggaacccctaaggtaacccttaccgttacgttttaccgggtagggttttaacccggaccggggttaacgggaaccggtaacctaaccgggttaccgtacccggttacccggtcccggttaacggtaacccggaccgacccggttaacccgg

SEQ ID NO: 180516 - DNA, 594 bp, Homo sapiens
  misc_feature: GYAE6OF02GSE5X.39.14.B03.1.454.CMB.1.raw
  modified_base (498)..(498): a, c, t, g, unknown or other
  misc_feature (498)..(498): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatcctcctgcacgtggaacgcagcagtgacgttggtagttataactatgtctctcgtaccaacagcacccgaggacaaacgacccccaaactcatacgtatttagtaggtacgtcaagtaactccggccctcgtacgggtttactaacgtcgtcttctctcgtctaccaagtcgtagacctaacgccggaccctcccgacgacacgtctacgtcggcctccgaggtcgtaggacgggtacgacggtcttagtattactacgtagcagtctactaatactaacgaagtacngactacgactacgttcgtagtcgtacgtcgggaccggacgggaactacggccgttacggtaccgttaccggttaacgccgaccgtacccgtaccgg

SEQ ID NO: 180517 - DNA, 741 bp, Homo sapiens
  misc_feature: GYAE6OF02HQUS1.39.14.B03.1.454.CMB.1.raw
  modified_base (223)..(223): a, c, t, g, unknown or other
  misc_feature (223)..(223): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtctggtctctggacagtcgatcaccatctctgctacgtggaancagcagtgacgtttggtaggttactaactatcgtacgtcctaggtacctaacagacaccaggacaaacaccccgaaactcaacgtagtatttaagtgtacggttacgaacgttaagtccggtacccttacgtaagggggttttacctaagtccggtcctttcgtcttcggtaccttaccgttaaacggtcgttacgggaacaacccgtaaccgggtccccgtccgtcgtaacccgtaacttccgttacgtccgggtaccttacccggaaggtccgttacgggacgggaaccggacggtaccgtttacgtaaagttttaaacgttaaccggttcgggacctacgttacccggttagtaagttttaccggaataaaccgtttagacggtttacggaggttaacctttacgttacggtttaccgtttaggaacggtttaacgggaaccggtaaggtccgtaacgttccggttacgttaaccgggacctaacggtaccccgaaccggacccctaaaccccgg

SEQ ID NO: 180518 - DNA, 682 bp, Homo sapiens
  misc_feature: GYAE6OF02F4Z8W.39.14.B03.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctccgtgtcgtgggtcctcctggacagtcgatcaccatctctncactgaancancagtgacgttggtagttataactatcgtctctacggtacaacacgcaccgacggacaaaccgaccccaaactacagtcgtaatttagtgtacggtacagttaacgtccggtccctagttacgggtttctaaacgtcgtcttctacgtcggtcctacgtaacgtcgtacgacctaaccgtaccgtccgtcccgtacgacctacttccgttacgtcgggtcctaccggacgtacgtacgggtaacggacggtacggtcgttaggtaactttacgtaacgttcgtaaccgtagtaccttagaaacttaactaacgtaaccgagaacgtccgaacgttaccgttacgttaccggtttagttacgggttaacggtttcggggaaccgggtacgggtaaccgacggttaccgtacggtacccggttacccggtacggtacccgaccggtacccggtaaccg

SEQ ID NO: 180519 - DNA, 636 bp, Homo sapiens
  misc_feature: GYAE6OF02GQGF8.39.14.B03.1.454.CMB.1.raw
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatcctcctgccactaggaagcagcagtgacgttggtgttataactatgtctcctggtaccaacagcacccaggcaaacgacccccaaactacatcgtatttatagacggtacagttaatccggtccctacgtagggtttctaagtccgcttctctggtcctaccgtaagtctcggaccaacgaccggtccctacccgtacaccacttacgtcgtcgggacctccgacggtctagggacggaccgaggtcgtagttaacttattaccgtgtacaggtccttctaattactacgaaagtcgtaaagttaacgttacttacgttccgtttacgggacggtacgggtacctaacggtccgttacccggtaacccgttaccgtacggtaaccgcggtaaccccgaggtaccgtacccggtcccccgttaccccgg

SEQ ID NO: 180520 - DNA, 716 bp, Homo sapiens
  misc_feature: GYAE6OF02FJNW4.39.14.B03.1.454.CMB.1.raw
  modified_base (214)..(214): a, c, t, g, unknown or other
  misc_feature (214)..(214): n is a, c, g, or t
  modified_base (220)..(221): a, c, t, g, unknown or other
  misc_feature (220)..(221): n is a, c, g, or t
  modified_base (230)..(230): a, c, t, g, unknown or other
  misc_feature (230)..(230): n is a, c, g, or t
  modified_base (320)..(320): a, c, t, g, unknown or other
  misc_feature (320)..(320): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctcctcactcgagggcacgagggtcctgggcccagtctcgccctgactcacgcctcgcctcgtgtcgtgggtctcgtggacagtcgatcactntcctcnncacgtgacnacgctagtgtacggttggttagttaacatgtcgttcctcggtaacgtaccaacgcgtaccgaccgaggacccaaacccgaccccgaactnagttagtacttagcggtaagtacaggttaacgtcccgtcgttacgggttacggttactacgtccgtattcgtagccgtactacgacgttacagaacccgtacccgtcccggactttcccgagtaaccctcgtttaccggcggttcggccctacgggacgtacggtacgggtaaccggcgggtatttcggtaagttaaaccgtttctcggtaccgactacgttacctagtaacttaaacacggaacgtcaaccgtactacgtcttaaccgtttgggtaccgtaagggttaccggggccggggtaaacgggtaacccgggtaccgtaacgggttcccgtaaccccgggtttcggaaacccgggttcgaacccgttacccggggtaacctccccggggg

SEQ ID NO: 180521 - DNA, 748 bp, Homo sapiens
  misc_feature: GYAE6OF02IBE8D.39.14.B03.1.454.CMB.1.raw
  modified_base (511)..(511): a, c, t, g, unknown or other
  misc_feature (511)..(511): n is a, c, g, or t
  modified_base (607)..(607): a, c, t, g, unknown or other
  misc_feature (607)..(607): n is a, c, g, or t
tcagtcgcactagtcacgaccggtgctcgatttagtgtgagtagttccgcgggggggggtctcaggaggcagcgctctcaggacatcctccaccatggcctgggctctgctgcctcctccaccctcctcactcgaaggggccacgacgggttccgtcgggccctagtcctcgcccctgactccacgccttcgccttccggtcgtcgtcgggtctccgtacggactagtcgactcacctatcctctcgacacgtggaacgcacgtcgacggttgtacggttggttacgttaactaacgttactcgttcgtaccgtacgaacctaacgcgaccgaaccgacggtaaccaaaccgaacccctaaactacgtaacgttacgtacgttttacgacggtacggtacgtaacggtaccgtccggtccgttacggtacggtttaactacgtaccgttcttcgttacgtacggtcctaccgtagtccgtcgtacccaacgtccgtaccctaccgtgtacnctcgtcggtcgtacctcgacggtcgacggacggacggtacggacgttacgtactttaacgtcgtacgtcgaacttctaagtaactaactacgtaanaccgttacgctaaccggtacttcggtttacggtacggtaacggtttcggtaccggggtaacgggtaaccggacccgtaagggtcccttaacgggtacccgttaccgggtaaccggtaccggttaaccgaccggtaacccgg

SEQ ID NO: 180522 - DNA, 675 bp, Homo sapiens
  misc_feature: GYAE6OF02JD6XZ.39.14.B03.1.454.CMB.1.raw
  modified_base (574)..(574): a, c, t, g, unknown or other
  misc_feature (574)..(574): n is a, c, g, or t
tcagtcgcactagtcacgaccggtgctcgatttagtgtgagtagttccgcgggggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctcctggacagtcgatccacattcctccgtgacacgtaggaagccagcagtgtacgttggtaggttataactatgtctcgtacggtaccaacgacgaccaccgaggactaaaccgaccccaaactcgtaatacgttaatttacgaggtacggtacgtaacgtaacggtcccgtccgttacggtaacggggttttactaacgttccgtacttaccgtcgtcggtacctaccgtaacgttcgtacgacgtaaccgtaccggtccctaccgactaccgtacttccgttcggacggttaccctccggacggcgttacgggacggacgggtacggtcttacggttaacttacgttacgtcgacgtacggtactacgtaattaccgaanaacggcacgaacgtactacgtactttcgtcggttggtacggtcggacggtaggtaaccgacgtaggtccgtacggttacacgggtaccacgtacgtaccgg

SEQ ID NO: 180523 - DNA, 997 bp, Homo sapiens
  misc_feature: GYAE6OF02I5PGD.39.14.B03.1.454.CMB.1.raw
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctggcctgacacagcctgcctccgtgtctgacgacctcctgggacagtcgactccaccatcctccgtgctactcgggaaccaggcctaaggtcgtacggtttggtagtactttaatttaaattagttcgtttacccttcccgttacgggtttaaccccaaactacggtaccttaaacgttttccggaaacggggccttaacccgggaccccgggtaaacccccccggtaaaaaacctttacctttttaaaacgttttaacgttacgggttaaccggggtttttccccgtttttcccgggtaccccgggttaacccccgtttcggggtttaaccggggggttttttaccgttaaaccgggtttcccgttacccggttttaacccgtttcccccggggtaaccctttaccccggttaaacgggttccggtttaccggggaaaccctaacccggtaccccgggtacccccgtttcccccgtaacgtaacccctacctttacccgttaaccgttaacggtaacccgttacccggtaccgggtaccggttaacgggtaaaccgggtaacccgggtaacggggtacccggtttaaccgttaaaacgttttagttttaaccgttacgtacgttaaaccggtacctttaaccgtaatttaaaccgttacgttaaggttaaaccggttacgttaaaaggttccggttaaaccttcccggtaaccttacgggttcgtttaccggggttacggggaaccgggttacggggaacccgttaacgggttacccgttaccggttacggttacggtaccggttacccggaacccggtaccggtcccggttacccccgg

SEQ ID NO: 180524 - DNA, 861 bp, Homo sapiens
  misc_feature: GYAE6OF02IKCI5.39.14.B03.1.454.CMB.1.raw
  modified_base (719)..(719): a, c, t, g, unknown or other
  misc_feature (719)..(719): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacgagggtcctgggcccagtctcgccctgactcacgcctcgccctccgtgtctgggtcctccgtaggacagtcgactccaacctatcctacctcgacacgtaggaacgcagctaaggtcggtacggttgggttacgttaataacttacgtcgttcctaccggttacggtaaccaaacgtacggacccgaacccgacgggaaaccccaaaacccggtaacccccctaaattaccgtaagttacggttaaatttaggtacggtaacggttaactaaacggttaacgttacccgggtcccgtaacgggtttaacgggttaacctttaacggtcctttacgttctacggttcggtaccctaacgtaacggttcgtaccgggtaacctaaaccggtacccggttcccttaccgtaacgtaccgtacctttcccgtacgggtacgggtcccctaaccggtacggtacggttaaccgggaacgggtaaccgtacggtccgttaaacgtttacggttttaaactccggtcgaacggtaccgtaactttaacccgtaaagttacccgaaacgtacgtaaccggacgtaaccnccggttacctaccggtttaggttaccgggtttaaagggtcccgggtttaaccggggaaccgggtaccgtaaacccggtcgtaaccgttccggttaacccgttaccggttacccgggaacgtacccccgtggtaacccccggg

SEQ ID NO: 180525 - DNA, 766 bp, Homo sapiens
  misc_feature: GYAE6OF02GCPSV.39.14.B03.1.454.CMB.1.raw
tcagtcgcactagtcacgaccggtgctcgatttagtgtgagtagttccgcgggggggggtctcaggaggcagcgctctcaggacatctccaccatggcctgggctctgctgctcctcaccctcctcactcagggcacgacgggtcctcgggccctagtctgcccctgactcacgcctgccctccgtgtcgtcgggtcctccgtggactagtcgatccaacctacttcctcctcgacctacgtacgggaaacgcgaacgtccgtagtaccggtcggtttggggttacggttaactaaacctgttcgttcctaccgtcgggtaaccaggtactaattaccgtaccgaggcctaaccgtaaccgtaccccctaaactctacgtactagtttacgtggacgtactaagtacgtcgccgttcgtacggttactactcgtctcgtcgtacgtcgtacgtacgtcgtacgaaccaccggtaccgtcccgttacccgtacgtaaccgtacgttccgttacccgggtcggtacccgtaccgggtaacgtcggtaacgggaccggtaacggtacggttcccgttaagtttactttaaccggtagttcccggtaatccggttaacttcgttaggtttaacacgtaacttacgtcgggtaacgttcgtactttcggttacgtccggtttaacgggtaacggtcggtaaacccgtaacggtttcgtaacggttacccgttacggtaaccgtaccggtacccggtacccgtaaacccggg

SEQ ID NO: 180526 - DNA, 673 bp, Homo sapiens
  misc_feature: GYAE6OF02IBJEG.39.14.B03.1.454.CMB.1.raw
  modified_base (199)..(199): a, c, t, g, unknown or other
  misc_feature (199)..(199): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacagggtcctgggcccagtctgccctgactcagcctgcctccgtgtcctgggtctcctggacngtcgatcaccatctcctncactggaancagnagtgacgttggtggttatgatatgtctccgtaggtaccagactaatactaccgaggcaccgacgaccccccaaaactcatacctattttagtagtacggtacaagttaacgtcccggcccgttacggttacgggttttacctaattccgtccgtttctccgttacgtccaccgtagtccggttacggacctaacgacccggtcccgtacccgtcgtaacccctacttccgttcccggtcgggccttaccgaacgggtccgtaggaaacgggtacggtaggtccgttgttaaacgttaactttaccgtacaccgttaacgcccttagtaacttttacgaacttaacgtcgacgttaggagttcttaagtttccggtaacggtttaggaacggtacggtaacctaggtcctagtttaccgcccgtaggtaccaccggtaaccccg

SEQ ID NO: 180527 - DNA, 722 bp, Homo sapiens
  misc_feature: GYAE6OF02JN72A.39.14.B03.1.454.CMB.1.raw
  modified_base (169)..(169): a, c, t, g, unknown or other
  misc_feature (169)..(169): n is a, c, g, or t
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (229)..(229): a, c, t, g, unknown or other
  misc_feature (229)..(229): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
tcagtcgcactagtcacgaccggtgctcgatttagtgtgagtagttccgcgggggggggtctcaggaggcagcgctctcgaggacatctccaccatggcctgggctctgctgctcctcacccgtctcactgagggcactagggtcctggcccaggtctcgccctgactnagcctgctcgtntctggctccgtggacngtcgatcactntccnctagccacnggaacncngcagtagtcgttgagttaactatatcgtcctacgtcgtaacaacgctaaccaccgtaaggaacctaaccggaccctaagactgtacgtattacgnggtaacggntaacgtaccgtcgtacccgtagttacggtaactacgttcgtccttaagtcgtacgtcctacgtaagtccgtacgaaccgtaacgcccgtacccgtccgttaacgacgtaacgttcctacggtcggtaacctccgacggttacggtcgaacggtcgaagtaccgtagttaaacttcgtcgaacgttcaaactccgtaagtaactaacgtaaccgtacgtaggtaccgttaccggaacgttaccgttacgttaccggggtttagtttaacccgggtgggtaaacccccggggttaaaggtaaccgggttaaccccggaacgtttcccgggtaaacccggtttccggtaaaccgggtaccggtaccgttaaccccgggtaacttccccgggg

SEQ ID NO: 180528 - DNA, 812 bp, Homo sapiens
  misc_feature: GYAE6OF02FMLQF.39.14.B03.1.454.CMB.1.raw
  modified_base (355)..(355): a, c, t, g, unknown or other
  misc_feature (355)..(355): n is a, c, g, or t
  modified_base (701)..(701): a, c, t, g, unknown or other
  misc_feature (701)..(701): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctcctcactcagggcacgagggtcctgggcccagtctgccctgactcagtcctgcctcgtgtcgtgggtctccgtggacagtcgatccaccattcctcctggactacgtaggaagccagacgtaggtcggttaacgtttggttacggtttaactaacgttagtcgttactccgtacggtaacctaacacgaccctaccgaaggaccgtaaaccgaccccaaacgtactaacgtntaaattttagaggttacggtacaacggttaacgttcccgggtaccgtttacgggtacgggtttttaactaaccggttccgttcgtttaccggtttaccggtaccggttaccctaccggtaacggtttcggtaccggtaaccgttaacccgacccgggtccccttaccccgtcgtaccgaactttcccgggtcttaccgggggtaccctacccgggacgggttacgtaagggcccggggtaaccgtcggggaaccggtttattaccgttttaacgttaccgtacgggtacctaccggtaaccttggtaaactaccggttaagaaacccgttggaccgtaccggtacnccgtttaggttaccttcggggttacgttacgggtacgggggtaccgaacgggttaaccgaccgggtccttacggacccgttacgaacggtaccaccggtaccgtacccggg

SEQ ID NO: 180529 - DNA, 720 bp, Homo sapiens
  misc_feature: GYAE6OF02HGV7U.39.14.B03.1.454.CMB.1.raw
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (668)..(668): a, c, t, g, unknown or other
  misc_feature (668)..(668): n is a, c, g, or t
tcagtcgcactagtcacgaccggtgctcgatttagtgtgagtagttccgcgggggggggtctcaggaggcagcgctctcaggacatctccaccatcggcctgggctctgctgctcctcaccctcctcactcacgggcaacgacgggtcctgggccctaggtctcgaccctgactcacgcctgcctcgtgtctcgggtctcgtggacagtcatccaccatcctcctgcacgtggaagcagcaggtcgtacggttggtagttataactatcgtctaccgtacggtaaccaacgacgccaaccgaaggaaccaaaacccgtaaccccctaaatccaagtagtaacgtttaagtcggaacggtacgtaacggtaaccgttccggtacccgttacggttacgggttttaactacgttcccgttacgttccgttacggttccggtaccttaaccggtaacgttcgtaccgggtaaccaaacccggtacccgggttccctacccgtacgtaccctaacgttccgtccgggtcgtaaccgtccggagtccgtagggaacggtacgtagtcgttagttaactttacgtccgngtacncgtacctaactaattaacacgaacacgacgataacggacttacgttgtaggtacggtcggtaccggggaggaaccggtanaccggttacgtccggaccgttaccggttaacgccgtaccggccggtaacccg

SEQ ID NO: 180530 - DNA, 782 bp, Homo sapiens
  misc_feature: GYAE6OF02F69YO.39.14.B03.1.454.CMB.1.raw
  modified_base (234)..(234): a, c, t, g, unknown or other
  misc_feature (234)..(234): n is a, c, g, or t
tcagtcgcactagtcacgaccggtgctcgatttagtgtgagtagttccgcggggggggggtctcaggaggcagcgctctcaggacatctccaccatggcctgggctctgctgctcctcaccctctcactcagggcacagggtcctgggcccagtctgccctgactcagcctgccctcgtgtctgggtctccgtggacagtcgactcacctatcctcctgacctacgtaggaacncgagtcgtaggttcgtacggtttggttaggttaacttaacttaagtcggttccttaccgtacggttaaccaaacgacgaccgaacccgaaggaacccaaaacccggacccccctaaaacctcgtaacgtacgttaactttacggtaggtaacggtaccgtaaacgttaacggttacccggtcccgttacggttaacggggttttaactaaacggttccggttaccttccgtttccgttccggtacccgtttaccgtaacggttaccgttacgaaccgtaaacccggtcccgttacccgtaccccgtacgtaccctacgttaccgtccggtaccggtccgtaccggcgggtacgtacgggacggtacggtacggtcgttagtacgtttacgtacgtcgaccgtacggtcttaacgtataccgtaagaacgtacacggtactacggtcttacgttcgttgttacggtacggttccggggaaccggacggtacccgtaagtcccgtacggtaccgttccggtaacgtccggtaccggacccgtaacccggg

SEQ ID NO: 180531 - DNA, 413 bp, Homo sapiens
  misc_feature: GYAE6OF01CQZRS.13.41.D08.1.454.CMB.1.raw
  modified_base (409)..(413): a, c, t, g, unknown or other
  misc_feature (409)..(413): n is a, c, g, or t
tcagtcacgtactacacgaccggtgctcgatttagtcacgcgagaaagggaaaggggctggagtgggtttcatatatcactggtgatagtgcttccacatattacgcagactctatgaagggccgattcaccatctccagagacaatgccaggaactcgctgtatctgcaaatgaacagcctgagagccgaggacacggctgtctattactgtgcgaaagccagggggcgtttatgactactggggccagggaatcctggtcaccgtctcctcagcctccaccaagggcccatcggtcttccccctggcaccctcctccaagagcacctctgggggcacagcgccctgggctgcctggtcaaggactacttcctagtacgtgactgagcgggctggcaaggcgcatagnnnnn

SEQ ID NO: 180532 - DNA, 154 bp, Homo sapiens
  misc_feature: GYAE6OF01EG3MM.13.41.D08.1.454.CMB.1.raw
  modified_base (154)..(154): a, c, t, g, unknown or other
  misc_feature (154)..(154): n is a, c, g, or t
tcagtcacgtactacacgaccggtgctcgatttagtcacgcgagaaagggaaagggacacgactggagattaaacgaactgtggctgcaccatctgtcttcatcttcccgccatctgatagtacgtgactgagcgggctggcaaggcgcatagn

SEQ ID NO: 180533 - DNA, 440 bp, Homo sapiens
  misc_feature: GYAE6OF02H6XYT.13.41.D08.1.454.CMB.1.raw
  modified_base (432)..(440): a, c, t, g, unknown or other
  misc_feature (432)..(440): n is a, c, g, or t
tcagtcacgtactacacgaccggtgctcgatttagtcacgcgagaaagggaaaggggctggagtgggtttcatatatcactggtgatagtgcttccacatattacgcagactctatgaagggccgattcaccatctccagagacaatgccaggaactcgctgtatctgcaaatgaacagcctgagagccgaggacacggctgtctattactgtgcgaaagccaggggggtcgttttattgactacgtgggggccaagggaatcctggtcaccgtctcctcagccctccaccaagggcccatccggtccttcccccctggccaccctcctccaacgacgccacctcgtgggggcacgagcggcccgtgggctcgccgtggtacaaggacttaccttcctagtacgtgactgagcgggctggcaggcgcatagnnnnnnnnn

SEQ ID NO: 180534 - DNA, 155 bp, Homo sapiens
  misc_feature: GYAE6OF02GPFH8.13.41.D08.1.454.CMB.1.raw
  modified_base (154)..(155): a, c, t, g, unknown or other
  misc_feature (154)..(155): n is a, c, g, or t
tcagtcacgtactacacgaccggtgctcgatttagtcacgcgagaaagggaaagggacacgactggagattaaacgaactgtggctgcaccatctgtcttcatcttcccgccatctgatagtacgtgactgagcgggctggcaaggcgcatagnn

SEQ ID NO: 180535 - DNA, 128 bp, Homo sapiens
  misc_feature: GYAE6OF01DZBSR.16.33.C11.1.454.CMB.1.raw
  modified_base (128)..(128): a, c, t, g, unknown or other
  misc_feature (128)..(128): n is a, c, g, or t
tcagtgtactactccacgaccggtgctcgatttagagtgagctcgttgggttggcacagcggccctgggctgcctggtcaaggactacttccgagtagtacactgagcgggctggcaaggcgcatagn

SEQ ID NO: 180536 - DNA, 179 bp, Homo sapiens
  misc_feature: GYAE6OF01BN5QT.16.33.C11.1.454.CMB.1.raw
  modified_base (171)..(179): a, c, t, g, unknown or other
  misc_feature (171)..(179): n is a, c, g, or t
tcagtgtactactccacgaccggtgctcgatttagagtgagctcgttgggttaggggaagaggaagactgaccggtccccaggagttcaggtgctggcacagcggccctgggctgcctggtcaaggactacttccgagtagtacactgagcgggctggcaaggcgcatagnnnnnnnnn

SEQ ID NO: 180537 - DNA, 251 bp, Homo sapiens
  misc_feature: GYAE6OF01BEMIX.16.33.C11.1.454.CMB.1.raw
  modified_base (250)..(251): a, c, t, g, unknown or other
  misc_feature (250)..(251): n is a, c, g, or t
tcagtgtactactccacgaccggtgctcgatttagagtgagctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgagtagtacactgagcgggctggcaaggcgcatagnn

SEQ ID NO: 180538 - DNA, 253 bp, Homo sapiens
  misc_feature: GYAE6OF01EMBR9.16.33.C11.1.454.CMB.1.raw
  modified_base (251)..(253): a, c, t, g, unknown or other
  misc_feature (251)..(253): n is a, c, g, or t
tcagtgtactactccacgaccggtgctcgatttagagtgagctcgttggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgagtagtacactgagcgggctggcaaggcgcatagnnn

SEQ ID NO: 180539 - DNA, 174 bp, Homo sapiens
  misc_feature: GYAE6OF01C1E0K.16.33.C11.1.454.CMB.1.raw
  modified_base (173)..(174): a, c, t, g, unknown or other
  misc_feature (173)..(174): n is a, c, g, or t
tcagtgtactactccacgaccggtgctcgatttagagtgagctcgttgggtttgggggaagaggaagactgacggtcccccaggagttcaggtgctgggcacagcggccctgggctgcctggtcaaggactacttccgagtagtacactgagcgggctggcaaggcgcatagnn

SEQ ID NO: 180540 - DNA, 523 bp, Homo sapiens
  misc_feature: GYAE6OF01E09BM.16.33.C11.1.454.CMB.1.raw
  modified_base (416)..(416): a, c, t, g, unknown or other
  misc_feature (416)..(416): n is a, c, g, or t
  modified_base (473)..(473): a, c, t, g, unknown or other
  misc_feature (473)..(473): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggagtgggggagattgatcccagtgactctcacatcaactacacgcccgtccttccaaggcccacgtcaccatctcagctgacaagtccatcagtactcgccttcngcagtgcgcagcctggacgcctcggacaccgcatatatactgtgcgacgtccgttancgcgcagtctcactactactacgtacgtctaggacgtcgtgggcaacggg

SEQ ID NO: 180541 - DNA, 546 bp, Homo sapiens
  misc_feature: GYAE6OF01BJWXI.16.33.C11.1.454.CMB.1.raw
  modified_base (412)..(412): a, c, t, g, unknown or other
  misc_feature (412)..(412): n is a, c, g, or t
  modified_base (486)..(486): a, c, t, g, unknown or other
  misc_feature (486)..(486): n is a, c, g, or t
  modified_base (520)..(520): a, c, t, g, unknown or other
  misc_feature (520)..(520): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatgggggagattgactcccagtgactctcacatcaactacagcccgtctccaaggccacgtcaccatctcagctgacagtccatcagtactcgtccttcngcaggtcgcgcacgccgtggacgccctcggaccaccgccaatactacgttactggtcgcgtacgttccggttanccgccgctagctacgactactactacgtacgtcncggtacgtcgtcggggacctaacggg

SEQ ID NO: 180542 - DNA, 542 bp, Homo sapiens
  misc_feature: GYAE6OF01CK8H1.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggagtggggagattgatcccagtgactctcacatcaaactacagcccgtcttccaaggccacgtcaccatctcagctgacaagtccatcagtactgccttcctgcagtggcgcagacgtggacggcctcggacaccgccatatattactgtcgcgtagtccggttatccgccgcagtactacactacctactacgtacggtcgttaggacgttcgtgggggcctaaacgggg

SEQ ID NO: 180543 - DNA, 631 bp, Homo sapiens
  misc_feature: GYAE6OF01C6EC9.16.33.C11.1.454.CMB.1.raw
  modified_base (445)..(445): a, c, t, g, unknown or other
  misc_feature (445)..(445): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacgtaggttttccagctacgtggatcaccgtgggtgccgccagaacggcccggtaaaggccgtaggagtgggagtggggagtagttgactcccgagtgactctcacatacaactacacgcccgttacctaccgaaggcccacgtccaccatcctcacgctagactaacgtccatcacgtacctcgtccctttccngactaggtcggaccgcgacggccgtgggaccggcccgtacggacccacccgacctatattacgttactggtcgaccggtacggttaccggttactccggccgtacgacgtactacctaacttaccttaaccgttaccgtacggttcgtacgggtaccggttccggtcggggtaccgtaaaccgggg

SEQ ID NO: 180544 - DNA, 564 bp, Homo sapiens
  misc_feature: GYAE6OF01DH2AI.16.33.C11.1.454.CMB.1.raw
  modified_base (461)..(461): a, c, t, g, unknown or other
  misc_feature (461)..(461): n is a, c, g, or t
  modified_base (499)..(499): a, c, t, g, unknown or other
  misc_feature (499)..(499): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaaggttctggatactaggttttccagctactggatcacctgggtgccgccagaacggcccggtaaaggcctggagtggagtggggaggattgactcccgagtgactctcaacataccaaactacaacgtccccgttaccttaccgaaacggcccaacgtcaaccactctcagctagaaccaacgtccaatacagtacctcgtccctttcctgcgtaggtcggcncgaggccctgggacgcctcggaccaccgcatatattangtgacgtcgtccgttncgccgnagatcacttacactactcgtctaggacctggtgggccaacggg

SEQ ID NO: 180545 - DNA, 253 bp, Homo sapiens
  misc_feature: GYAE6OF01DJCKE.16.33.C11.1.454.CMB.1.raw
  modified_base (249)..(253): a, c, t, g, unknown or other
  misc_feature (249)..(253): n is a, c, g, or t
tcagtgtactactccacgaccggtgctcgatttagagtgagctcgttgggggccaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccctctcgagtagtacactgagcgggctggcaaggcgcatagnnnnn

SEQ ID NO: 180546 - DNA, 170 bp, Homo sapiens
  misc_feature: GYAE6OF01AU8DV.16.33.C11.1.454.CMB.1.raw
  modified_base (170)..(170): a, c, t, g, unknown or other
  misc_feature (170)..(170): n is a, c, g, or t
tcagtgtactactccacgaccggtgctcgatttagagtgagctcgttgggttggggaagaggaagactgacggtccccaggagttcaggtgctgggcacagcggccctgggctgcctggtcaaggactacttccgagtagtacactgagcgggctggcaaggcgcatagn

SEQ ID NO: 180547 - DNA, 539 bp, Homo sapiens
  misc_feature: GYAE6OF01A0E1U.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtgggatgggggagattgatcccagtgactctcacatcaactacagcccgtcttccaaggccacgtcaccatctcagctgacaagtccatcagtactcgcccttcctgcagtggcgcacgcctggacggccctcgggaccaccgccaatactattactgtcgcgtacgttccggttatccgccgcagctcactactactactacggtctaggacgtcgtggggccaacggg

SEQ ID NO: 180548 - DNA, 625 bp, Homo sapiens
  misc_feature: GYAE6OF01ETF42.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggatctctgaggatctcctgtaaggttctggatactaggttttccagtctacgtggatcgacctgggtgcgccagaacgacccggtaaagccgtggagtggagtgggggaggagttgactcccgagtcgactctcacatacaactacacgtcccgtacccttaccgaacggcccaccgtaccaccgtacttcctcacgtcctagaactaacgtcctaatccaagttacctcgtccctttcctcgacgtacggtcggccgcgacgccgtgggacggcctcggaccaccgaccatactattacgtgtcgcgtacgttccggtacgtccgccgagacgtacgtaccaacttaccttacctacggtacccggttcgtacgggtaccggttcggtacggggcccgtaaacgggg

SEQ ID NO: 180549 - DNA, 563 bp, Homo sapiens
  misc_feature: GYAE6OF01BS3W7.16.33.C11.1.454.CMB.1.raw
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (505)..(505): a, c, t, g, unknown or other
  misc_feature (505)..(505): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggatctctgaggatctcctgtaagggttctggatacaggttttccagctactggatcacctgggtgcgccagaacgcccggtaaaggcctggagtgggagtgggggagattgatcccgagtgactctcacatcaactacacgcccgtccttaccgaaggcccacgtccaacctatctacagctagaactaacgtccatcagtactgccttccngccagtcggcgcaggcctggacgcctcggaccnccgcaatactattaccgngtgcggtagttccggtatccgccganagactacaacttactacctacgtacggtctacggtactcggtcggggccaaaccgggg

SEQ ID NO: 180550 - DNA, 689 bp, Homo sapiens
  misc_feature: GYAE6OF01DCAE7.16.33.C11.1.454.CMB.1.raw
  modified_base (289)..(289): a, c, t, g, unknown or other
  misc_feature (289)..(289): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctctggctgttctccaaggagtctgtgccgaagtgcagctggtgcagtccggagcagaggtagaaaaacggcccggggagtctctgaggatctctggtaagggttctaggatacgtaggttttccagctacgtggatcaccgtgggtncgccaagaacggacccggtaaaggccgtagggaggtggaggtgggggagtagttggactcccgagtcgactctacactatacaactacgacgtcccgtcctaccgaacggcctacgtcaccactctacgagctagaactacgtccaatctaagtaccgtcgtcccttccgtcgcgtacgggtcggccgacgtacggtcccgtagggtaccggaccccgttacgggaacccaacccggtacctaagttaactttaccgttacgttggtaccgcgggtacggttcccggttagtccgacccggactaacggtacctaccgtaaccttaaaccttacccgttaaagttacccgggtcgttacgggtaacccgttcggggtaccggggaacggtaaacccgggg

SEQ ID NO: 180551 - DNA, 680 bp, Homo sapiens
  misc_feature: GYAE6OF01EBJCB.16.33.C11.1.454.CMB.1.raw
  modified_base (258)..(258): a, c, t, g, unknown or other
  misc_feature (258)..(258): n is a, c, g, or t
tcagtgtactactccacgaccggtgctcgatttagagtgagctcgttgggtttggggagtctccttcaccacccagctgggatctcagggcttccttttctgtccctcctccaggatggggtcaaccgccatcctcaccctcctcctggctgttctccaaggagtctgtgccgaagtgcagcgtggtgcacgtccggagcgagaggtagaaaaacggcccggggagtctcgtagaggatcctacgtgttaagggttcnggtactacgtaggttttccagtcgtacgtggactcgaccgttgggtcgccgtcgaaggaaccgaacccggtaaacggccgtagggacggttaggaaggtaggggagtatcggaccgtccgagtcgacttcacaactactaccaactaccgaccgtccccgttaccgtaccgaacggcctacgtaccaacctctcgtaccagtccgtaagaacctacgtccaacgtcgtaacgtcctccgtcccttcgagcgtaggccgcgtacgtacgccgtggaccgtccgtacgacccacgactaatacgttgtaccgtgtacgtctacgggttaccctaggtcccgaccggagtacgtccgtactaacgttaacctaacgttaccggtacggttcgacggttaccggtcggtaccgggaccgaaccggg

SEQ ID NO: 180552 - DNA, 699 bp, Homo sapiens
  misc_feature: GYAE6OF01A4E0E.16.33.C11.1.454.CMB.1.raw
  modified_base (289)..(289): a, c, t, g, unknown or other
  misc_feature (289)..(289): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctcctgtaagggttctggatacgtaggttttccagtctacgtggatcacgtgggtcncgcagaacgcccggtaaagccgtggagtggagtggggagtatgactccgagtcgactctcactactacaactacacgtccccgtaccttaccgaacggcccacgtccaacctactcctacgacgtcctacgaacctaacgtaccataccgagtacctcgtcccttctgacgtacggtcggaccgcgacgtccgtacgggacggtccccgtaccggacccacccggacctaacgttaacttaacgttaccgtggtacggtacggtacggttacccggttacgtcccggcccggtaaccgtacgtaacgttacccaaaccgttacccttaaccgttaaccgttacccgggtttaccgttacggggtaacccggtttccggggtcgggggtaacccccggtaaaacccggggg

SEQ ID NO: 180553 - DNA, 622 bp, Homo sapiens
  misc_feature: GYAE6OF01A694T.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatactaggttttccagctactggatcacctgggtgcgccagaacgcccggtaaaggcctggagtggagtggggaggattggactcccagtcgactctcacactacaactacacgtccccgtcttaccgaacgccctaacgtccaaccgtatcctcagctacggaacaacgtccatcaagtactcgtacccttcgtgctaggtcggcgctagccgtgggacgccgtacggaccaccggacctattactacgtttaccgtggtcgcggtacgttccggttatccggacccgtagacgtacttacgaaccttaccttaaccgttaccgtacggttacctacgggtaccggtcggttacgggggcccgtaaacggggg

SEQ ID NO: 180554 - DNA, 845 bp, Homo sapiens
  misc_feature: GYAE6OF01AI6VI.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaacccgccatcctcaccctcctcctggctgttctccaaggagtctgtgccgaagtgcagcgtggtgcgaggtccggagcaggaggtagaaaacggccgggatctgtgaggactctccgtggtaaggttctggtatacgttacggttttccgagtcgttacgtggtactccgaccgtgggtcgccgacgaggaccggtacccggtaaggccggtagggtacggtgggagggtgggggtaagtgttacggaccgtccggtagtaccggtaccttccgtaccgtaacttaacgtaacctaaacccgtaccgtacccggttccccgttacccgttacccggaaaccggtaccctacccgtaccctaacccgttactccgtaccgtacggtaccctaacgtaacctaaccgtacctaactaccggtaaccggtttcctaccccggttaccctttcccggtacggtacgtacggggtccgacccgggtacgtacccgggccggtaccgggccgtacccggtacccggacccgaaccctaccgttaagtacctttaacgttcgtaccggttaccgggtaccggttaccgttacccgggttacgtcccggtaccggtacccgtacgttaccttaccccgttaaaccggttaacccttaccggtaacccggtttcggtaacccggttcccgggtaccgggtaccggttaacggggccccggtaaacccgggg

SEQ ID NO: 180555 - DNA, 256 bp, Homo sapiens
  misc_feature: GYAE6OF01BG6CY.16.33.C11.1.454.CMB.1.raw
  modified_base (248)..(256): a, c, t, g, unknown or other
  misc_feature (248)..(256): n is a, c, g, or t
tcagtgtactactccacgaccggtgctcgatttagagtgagctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctggtcactctgttcccgccctcctcgagtagtacactgagcgggctggcaaggcgcatagnnnnnnnnn

SEQ ID NO: 180556 - DNA, 624 bp, Homo sapiens
  misc_feature: GYAE6OF01EMOSS.16.33.C11.1.454.CMB.1.raw
  modified_base (162)..(162): a, c, t, g, unknown or other
  misc_feature (162)..(162): n is a, c, g, or t
  modified_base (440)..(440): a, c, t, g, unknown or other
  misc_feature (440)..(440): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggngtctgtgccaaagtgcagctggtgcagtccggagcagaggtagaaaaagcccggggagtctctgaggatctcctggtaagggttctggatacgtaggttttccagctacgtggatcaccgtgggtcgcgccagaacgccccggtaaaggcctagggagtgggagtgggggagtattgatcccgagtcgactctcacgatacaactacacgtccctctcgaaggcccacgtcaccatcctacagtctagaacagtccatcacgtactcgtacccttcgngctaggtcggcgcgacgtccgtagggaccgcctccggacacccggcctaagtactactttacgtcgtacgcggtacgtccggttacgtcggaccgcgtaacggtacttaccctacttaccgttacttaaccgtacggttccgtacgggtaacgttcccggttcgggggacccgtaaaccggggg

SEQ ID NO: 180557 - DNA, 679 bp, Homo sapiens
  misc_feature: GYAE6OF01B53ID.16.33.C11.1.454.CMB.1.raw
  modified_base (229)..(229): a, c, t, g, unknown or other
  misc_feature (229)..(229): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcgaggaggtagaaaaacggcccggggatctcgngaggatcctcgtaggtaaggttctaggatacgtaggtttccagctacgtggactcgaccgtgggtcgccgacgaggaacgaccggtaaaggccgtaggaggtgggaggtggggagtagtcgactcccgagtcgtactcacactactacaacgtacaccgtcccgtacctacgaacgccctacgtaccacctactcgtacacgtcgtacgaacgtacgtccagtacctacgttaccgtccgttcccttcgtcgacgtaggtccgacgcgaccggtccgtacgggaccgtcccgtacggaccaccgctaacttacttacgttacgtcggttcgaccggttaccgttaccggtacgcccgggtcctacgtacggtactaccgtaaccttaacctacccgttacgtaccggttacgtacggtaccggttccggtaccggggaccgtaaaccggg

SEQ ID NO: 180558 - DNA, 578 bp, Homo sapiens
  misc_feature: GYAE6OF01CRJ4X.16.33.C11.1.454.CMB.1.raw
  modified_base (331)..(331): a, c, t, g, unknown or other
  misc_feature (331)..(331): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
  modified_base (479)..(479): a, c, t, g, unknown or other
  misc_feature (479)..(479): n is a, c, g, or t
tcagtgtactactccacgaccggtgctcgatttagagtgagctcgttgggtttgggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctggtaagggttctggatacaggttttccagctactggatcacctgggtcgcgccaagacggcccggtaaaggccgtggacgtggagtgggggaagnttggactcccgagtgactctcgacatacaactcacgcccgttccttaccaaggcccacgtcaccatcncagctgacacgtcatcagtactcgccttacngcagtggcgcagccgtaggacgcctcggaccgcgccattactattacgngtagcgtacgttcggttatccggacctacgagtacgtacacgttacgtacttaaccggtacggttcctgggtaccgtccgagggggcccctaaacgggg

SEQ ID NO: 180559 - DNA, 695 bp, Homo sapiens
  misc_feature: GYAE6OF01CFLNZ.16.33.C11.1.454.CMB.1.raw
  modified_base (484)..(484): a, c, t, g, unknown or other
  misc_feature (484)..(484): n is a, c, g, or t
  modified_base (541)..(541): a, c, t, g, unknown or other
  misc_feature (541)..(541): n is a, c, g, or t
tcagtgtactactccacgaccggtgctcgatttagagtgagctcgttgggtttggggagtctccttcaccacccagctgggatctcaggcttcctttctgtcctcctccaggatggggtcaaccgccatcctcaccctcctcctggctgttctccaaggagtctgtgccgaagtgcagcgtggtcgcacggtccggagcagaggtagaaaaggccgggagtctcgtgagatctctagtaggtgtagatacgtacgtttcagtctacgtgtactacctacgtggtacgcgtaccgaagaaccggaccggtaacggccgtaggaggtcgggtagggtacggggaggtacgttacggactaccgaggtcgacctctactactataacctaacctacgaccgtcccgtacctaccgaacgccacgtaccaactacgtcacgacgtacgtacactaccgtacacgtacctagtactccggtccttaccngaccgtagggtaccgcggtactacggtcccggaacggaccgtccgtaaccggaaccncgtaactaattaactttccgggtacttcgggtaacgtccggtaacgttcccgggttacacccggaccgaggttaactacgtaccctaactaaacttaacccggtacgttccggtataccggggaccgttacgggcgggtaacccggtaaaccgg

SEQ ID NO: 180560 - DNA, 887 bp, Homo sapiens
  misc_feature: GYAE6OF01BWEUT.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctggtgccgaagtgcagcgtggtgcgacggtccggagcgaggaagggtaaggaaaaacggcccgggggagttccgtcgtaggaggacttccgttaccgttagggttaacgggttcgtaggaacgttacgttacggttttccgaggtcttacgtaggtactaccgtaccggttggggtcgaccggtaccgaacgggaaccggtaacccggggtaaaagggtccggtaggggtaagggttacggggaaggggtagggggaacggttaagttacggtaccgttacccggtaaggttaccgtaaccttccgtaccaactaactaccgtaaacctaacgacccggttccccgttaaccgttaacccgaacggtacccgttaaccgaccctaacctacttcccgtaacgacgtaccgtacgtaaccgtacgtacctacgtaccgtaaggttccctccgttcccttacccgtacgacggtacgggtcggaccgtcggtaaccggccgggttacgggaccgtcccggtacgacccgtacccgtacttaagttaaccgtttagttaccggtacggttccggtacggtttaccgggttaccggtttccgcccggtaaccgtaccgtaacgtacccgttaccgtaaacctttacccgtaaacccggtttaccggtacgggttaccgttacgggaaccggtttccgggaaccggggtaaacccggtaccccgggg

SEQ ID NO: 180561 - DNA, 703 bp, Homo sapiens
  misc_feature: GYAE6OF01CJ9KV.16.33.C11.1.454.CMB.1.raw
  modified_base (579)..(579): a, c, t, g, unknown or other
  misc_feature (579)..(579): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacgcccggggagtctctgaggatctcctgtaagggttctggatacgtaggttttccagctacgtggactccaccgtgggtgccgccaaggaacgacccggtaaaggccgtggagtggagtggggagtattcgactcccgagtcgactctcacatcaactacacgtccccgtaccttaccgaacggccctacgtacccaacctacttcctactacgctacgaacaacgtcccaatcctaagttacctcgtccctttaccgtgacgtaggtccggcgacgtacggccgtgggaccgtcccgtacggacccgacccgaccgtaattacgttacgtttaacgtggttaccggtacgtacggttacccggttacncccggtccgacgtaacgtaccgttacctaaccgtttaaccgttaaccgttaaccggtttacccgggttaccgttacggggtaacccggtttccggtaccgggggtaacccgtaaaacccggggg

SEQ ID NO: 180562 - DNA, 784 bp, Homo sapiens
  misc_feature: GYAE6OF01CDYTF.16.33.C11.1.454.CMB.1.raw
  modified_base (187)..(187): a, c, t, g, unknown or other
  misc_feature (187)..(187): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctctggctgttctccgaaggagtctgtgccgaagtgcagtctggtncgacgtccggagcgagaggtacgaaaaacggcccgggatctctggagagtcctcttaggtaacggttcgaggtacgtacgttacggttttaccgagtactacgtacggactccgtaccgtggggtcgaccggaccgtaacggaaccggacccgggttaaaaggcccggtaggtaagggttcggggaacgtagggggtagtacgttacgacgttacccgaggtagtacctcgtacactacaacctaacctacgtaccgtccccgttactaccggaacgtaccaacctacgtaccaaccgtacttacgactacgtcgtaacgaaccttaacgtcccacgtacgacgtaccgttcgcccttacgtacaccgtaggtcggcccgagtccgggccggttacggaccgtcccggaaccggacccgtaaccccgaacctaacgggttttaataccgtttaacgtcgttaccgggtacgttaaccgggtacgttttaacccggccggaacccgtacgtaaacgtaccaccttaaacggttaccctaaccgttaccggtaaccgttaccgtacggggtcccttaggggtcccggggttaaacccgg

SEQ ID NO: 180563 - DNA, 705 bp, Homo sapiens
  misc_feature: GYAE6OF01DAHDE.16.33.C11.1.454.CMB.1.raw
  modified_base (295)..(295): a, c, t, g, unknown or other
  misc_feature (295)..(295): n is a, c, g, or t
  modified_base (430)..(430): a, c, t, g, unknown or other
  misc_feature (430)..(430): n is a, c, g, or t
  modified_base (602)..(602): a, c, t, g, unknown or other
  misc_feature (602)..(602): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggatctgtgccgaagtgcagctggtgcagtccggagcaggaggtagaaaaaggcccggggatctcgtgaggtatctcgtaggtaaggttctaggatactaggttttcagtctacgtggtaactcgtaccgtgggtnccgacgaaggaacggtacccgggtaaggcccgttagggaaggttgggaaggtggggaaggtagttgacgtacccgagtcgtactctacacatacaactacacggtccctaccgtacgaacggccacgtacacctntactcgacgctacgacgtaacgttccactacgtagttacctcgtcccttacgtgcgtaagtcggactgtacggcgtggaacccggtcctacgggaccctaccggactaagtttaagtaccgtttacgtagcgggtaacccgttacggtttacccggtacgtaccggacccgngtaaacggtactaacccctaacgttaacccgtttaacggtaacccgtacggtttaccgtagggtaccccggtttacggcggggtaaaccccggtaaaccgggg

SEQ ID NO: 180564 - DNA, 602 bp, Homo sapiens
  misc_feature: GYAE6OF01BZ5SV.16.33.C11.1.454.CMB.1.raw
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
  modified_base (509)..(509): a, c, t, g, unknown or other
  misc_feature (509)..(509): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctcctggtaagggttctggatacgtaggttttccagtctacgtggatccaccgtgggtcgccgcaggacgacccggtaaaggcctggagtggagtggggagtattgactccagtcgactctcgacactcaacctacacgtccccgttccttaccgaaacggcccgacgtccaaccctatcctcagtctacgaacaacgtccatcaacgttctcgcctttcngtcagcggcncgtagccgtggcggcctcggacctccgctatactattacgtgtacgngttacgtaccgttcgtccgactcgagtactctaacctctacttaccgttacggttccgtacggtaccgtcggtccgggaacccggtaaccggg

SEQ ID NO: 180565 - DNA, 839 bp, Homo sapiens
  misc_feature: GYAE6OF01DQI4W.16.33.C11.1.454.CMB.1.raw
  modified_base (166)..(166): a, c, t, g, unknown or other
  misc_feature (166)..(166): n is a, c, g, or t
tcagtgtactactccacgaccggtgctcgatttagagtgagctcgttgggtttggggagtctccttcaccacccagctgggatctcagggcttccttttctgtcctcctccaggagtggggtcaaccgccatcctccaccctcctccgtggctgttctccgaaggngtctgtcgaccgaagtgacagctggtgacgacggtccggagcgaggaggtaaggaaaaacggcccggggagtcgtcgtaggaggtacttccgtccgtagggttaacgggtttctaggtacttacgttacggtttccgagtctacgtggtactacgtacggtggtcgccgacgaaggaaccggtaaccggtaagccggtaggagggtagggacgggtaggggaaggtagtcgtaccgtccgagtcgactcgtacactacacaaccgtacgaccgtcccgttacctaaccggaaccgtcccgtaacctaccgaacctactaccgtacaacgctacgaactaccgtccaattaccggtaactcccgtaccgttcccgttacgtactcgggtacggtaccggcgtaccggtaccgtaccgggttacgggacccgggtaccccgtaacgggtaacccccaaccggttaaacccttaagttacgttttaaccgtaccggtggttaacccggttacgggttacccggttacccggttcggaacccgtaccgtacgttaaaccgtacccgttaaccgttaacccttaaacgtacccgggtttaaaccggttcccgggtaacgggttacccgggttacccggttaacccggggtaaaccggggtaccccgggtaaacccggg

SEQ ID NO: 180566 - DNA, 807 bp, Homo sapiens
  misc_feature: GYAE6OF01EMMT0.16.33.C11.1.454.CMB.1.raw
  modified_base (372)..(372): a, c, t, g, unknown or other
  misc_feature (372)..(372): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaacgcccggggagtctctgaggatctccgtgtaagggttctaggatacgtacggttttccagtctagtggatccgaccgtgggtgccgaccgaggaaccgacccggtaaaggccgtagggagtggagtgggggagtagtgactccgagtcgtactctcacgtanaccaacgtaccacgtccccgttaccgttaccaaacgggtccccaaccggttaccaaccctaacgttacccgtaccgtaacggtacccttaacggtaacccgtaacgttccccaacgtttacccgtaacggttacccgttacggttcccccttttaccgtacggtccggtacggttccgggaccgtacccgacgggtacccgtccggggaaccggtccccgtaccgggacccgtaacccgggtcctaaagttaccgttaacgtttaaccgcgggttacggtccggttaacggttacccgggtttaacgcccggtacccggaacgtaaccgtcttaacccgtaacccttaaccgttaaccggttaacccgtttccgggtacggtttaccgggaaccgggttcccggttaccggggggaacccttaaaacccgggggg

SEQ ID NO: 180567 - DNA, 835 bp, Homo sapiens
  misc_feature: GYAE6OF01E35PY.16.33.C11.1.454.CMB.1.raw
  modified_base (180)..(180): a, c, t, g, unknown or other
  misc_feature (180)..(180): n is a, c, g, or t
tcagtgtactactccacgaccggtgctcgatttagagtgagctcgttgggtttggggagtctccttcaccacccagctgggatctcagggcttccttttctgtcctcctccaggatggggtcaacccgccatcctccaccctcctcctggctgttctccaaggagtctgtgccgaagtgnagcgtggtgcaggtccggagcgaggaggtaagaaaaacggcccggggagtcgtcgtagaggtacttcctccgttaggttaacgggttcgtaggtaacgtacgttacggttttccagtccgttacgtaggtaatccgtaccgttggggtaccgaccgacccgaagggtaaccggaacccgggtaaacggccgtagggaggtagggagggtaggggaggtagttcgaccgtaccgagtacgaccttctacactactaccgaactacgaccgtccccgttccgtaccgacggaccctacgtaccacctctctacgacgtcgtaacgaccgtacgtaccacgtaccgtacgttccgtaccgttcccgttacgtccggacgtggtccggccgtaccgtaccggtcccggtacgggaccccggtcggtaaccccggaacccgtacccgtaccttaaacgttactttaaccgtttacggttacggtaccggtaaccgggtttaccggttacccgggttacgtacccggtacccgtaactaaccgttaccgttacttaaaccccgtttaccgtttaacccggttacccggtttacccggggttaccggttacgggggtaccccgggttacggggtaccccgggaaacccggggtaacccgggg

SEQ ID NO: 180568 - DNA, 723 bp, Homo sapiens
  misc_feature: GYAE6OF01A6CUB.16.33.C11.1.454.CMB.1.raw
  modified_base (161)..(161): a, c, t, g, unknown or other
  misc_feature (161)..(161): n is a, c, g, or t
  modified_base (491)..(491): a, c, t, g, unknown or other
  misc_feature (491)..(491): n is a, c, g, or t
tcagtgtactactccacgaccggtgctcgattttagagtgagctcgttgggtttggggagtctccttcaccacccagctgggatctcagggcttccttttctgtcctcctccaggatggggtcaaccgccatcctcaccctcctctggctgttctccaggngtctgtgccgaagtgcgagcgtggtgcgacggtccggagcaggaggtaacggaaaaacggccccggggagtcctacgtaggaggtacttccgttccgtaggttaacggtttcgtaggtacttacgttacggttttcacgtcgtacgtgtactaccgaccgttgggtcgccgaccgacggaaccggacccggttaaggccgtgggaaggtagggtacgggtagggtaggtgtaccgtcgtaccgagtcgcgtacctcgaacgtactaaccgaactacggcccgtacccgttcctaaaccggaccggttcccaccgtacctaacctctaccncgtaacgccgttaaccgaactaacgtccgtactacgtaccgttccgtacttcccgttcgtacgtcggtacgtccggactaccggaccgtcggacgggccgtccgaccgtaaccgtccgacttaactcgttacgtaggtcgtcgggtacctcggttaccgtcgtcgccgtagacgctactccgtaacctactacgtccggtagtaccggtagtacggtcccggagtaacccgg

SEQ ID NO: 180569 - DNA, 731 bp, Homo sapiens
  misc_feature: GYAE6OF01A5TJX.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagcgtggtgcaggtccggagcaggaggtagaaaaacggcccggggtatcctctggacggtatccgtaccgttaggttaagggttctaggtaacttacgtacggttttccagtccttacgtggtactccgtacggttgggtcgaccgaccgaacggaaccggtacccggtaaggtccggtaggaggtagggagggtaggggagtagtacgacgtaccgtagtcgtacctctactaactactaacctaacgtaccgtaccgtacccgtaccgtaccgaaccgtccctaccgtaccacctactctacgtacgtctacgaaccgtacgtactatccgtacgttcctccgttcccgtcgtacggtacgtcggtcggaccgtccgtacgggtaccggtacgggacccgtacccggtaccgacccaccgtactaacgttacgttacttcgtacggttcgtaccggtccgttaccgtcgtccgtaccgacgtacgtacctaccgttaactacgttaccgtacgtccggtacgtaccggtaggtccggacggtaaccggacg

SEQ ID NO: 180570 - DNA, 698 bp, Homo sapiens
  misc_feature: GYAE6OF01ALVKE.16.33.C11.1.454.CMB.1.raw
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
  modified_base (470)..(470): a, c, t, g, unknown or other
  misc_feature (470)..(470): n is a, c, g, or t
tcagtgtactactccacgaccggtgctcgatttagagtgagctcgttgggtttggggagtctccttcaccacccagctggatctcagggcttccttttctgtcctcctccaggagtggggtcaaccgccatcctccaccctcctcctggctgttctccaaggagtctgtcgccgaagtgcagcgtggtgcacggtccggagcgaggaggtaagaaaaaccgggccgggagtctcgtgagtactctcgtaggttaggttgtgatacgttacggtttcagtctatgactcgacgtggtcncgacaaggacggaccggtacgcgtggngtgaggtgggagtattcgactccgaggtactactctccaanactaactactaccacgtccccgtactaccgacgacccaacgtaccactactccctnaacgtcaacgtacactacctntacgacgttctccgtctactgtaccgngaccgcgtacggccgtccggtacggtacccggacccgtaccggaacccgtaaccctcgttaagtttacgttaccgttacggttcgtaccgtaaccggttaccggtaccgttaaccggtcccgacgtaccgtaacccttaccttaaccctaacggttaaccttcccggtaacggttacgttcccggggaacggttcgggaacccggggacggtaaccccggggtaaacg

SEQ ID NO: 180571 - DNA, 797 bp, Homo sapiens
  misc_feature: GYAE6OF01EVN3B.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaacggcccgggagtcgtctgagagtactctacgtaggttacgttgagtactacggttcgttacgactactacggtgtacaccgtggtgcgccgacgaacggaccggtaacggacgtcggtaggtggaggtagggggtaggtagtgtacgtaccgtacgtagtcctctacacactactaacctacgccgtacccgtaccgttaccacggaccctaccgtacctacccaactcttaccgacgtacgtaccgtaacgtaaccgtaccgttacctaccgtaaccgttaccgttacccgttccccgtttacccttccgggacgtaacgggttcccggtacccggaacccgtccgggttaacccgggtccgggggtaccgggacccccgtttaccgggacccggtaaccccctaccggtaacttaagttttaaccgtttaacgttcggtaggtacccggtacggtttacccgggttaccgtacccgtcggaacccttaacggtctaaacccgttaccctaacgtttaacccttacggttaacccgtgggttacccggtaacggtccgggttcccggggaaacggtaaccccggg

SEQ ID NO: 180572 - DNA, 742 bp, Homo sapiens
  misc_feature: GYAE6OF01DOSWG.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctctggctgttctccaaggagtctgtgccgaagtgcagctggtgcgaggtccggagcaggaggtaagaaaaacggcccggggagtctcgtggaggactcttccgtaggtaaggttcgtagtattacgtacggttttcagtctacgtgactcgaccgttgggtcgacgaccgaaggaacggtaacccgggtaaacggtccgtagggtacggtagggtaagggttaggggggtaacggtagttacgaccgtacccgtaggtacgtacctactacgaactaacgtaccaaacctaccgaccggtccccttaccgttaaccgaacggtccctaccgtaccaacctaccgtctaccgtacgtcgtaacgaacgtaaccgtacactacgtaacgttaccgtcgtaccttccgtcgacgtaggtcggccgacgtcggtccggtacgggaccgtccgtaacggacccgtacgactaattactcgttacgtgtacgtcggtacgttccggtaaccgtcgacccgtagaacgtaccttactaaaccgttacttaaccgtacggttcggttaccggtacggccggttacgggaccggggacgtaaacccggg

SEQ ID NO: 180573 - DNA, 915 bp, Homo sapiens
  misc_feature: GYAE6OF01AUGJO.16.33.C11.1.454.CMB.1.raw
tcagtgtactactccacgaccggtgctcgatttagagtgagctcgtttgggtttggggagtctccttcaccacccagctgggatctcgagggtcctttccttttctcgttcctcctaccgaggagtcggggtaccaacccgccactcctcctacccctcctccgtggtcttcgttcctaccgaaggtcgtctgtcgacgtaagtcgcgacgtcgtggtcgacgacggtccggagacgagggaacggtaacggaaaaccgggccggggtacgttcctacgtaggacgtacttccgttacgtaggttacggttacgtaggtacttacggttacggtttcacgtactacgtaggtactaccgtacggtgggtaccgaccgtaaccgaacggtaaccgggtaacccggtaacggtccggtagggtacggtacgggtagggtacgggggtagttacggtacgtaccgtaccgtacggtcgttacctacgtaccgtactacctaaccgtaaaccgtaccgtacccgttacccccgttaccgtaaccgtaacccggtacctacccgtaacccgtaaccgtaccgtccgtaccgtcgtaccgtaacggtaacccgttaccgtaccgtacttacggtacgttacccgttcgttaccccggttacgtacggtacggtacgggtcggacccgtacggtaccggaccggtaccggaccccgggtaccgacccggtaaccccgacgttaaccttaacgttaaccgttacggttaccggtcggtaaccgggtaccgtttacccgggttacccgtaccgtaccgtaccggtacgtaccgtaacgttaaccctaacgttacccgtacgttaacccggtccgggttacgttaccggttaccggacggggtaaccgggtacccgaaacccggg

SEQ ID NO: 180574 - DNA, 252 bp, Homo sapiens
  misc_feature: GYAE6OF02G8R7L.16.33.C11.1.454.CMB.1.raw
  modified_base (250)..(252): a, c, t, g, unknown or other
  misc_feature (250)..(252): n is a, c, g, or t
tcagtgtactactccacgaccggtgctcgatttagagtgagctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgagtagtacactgagcgggctggcaaggcgcatagnnn

SEQ ID NO: 180575 - DNA, 174 bp, Homo sapiens; identical to SEQ ID NO: 180539
  misc_feature: GYAE6OF02GGBIC.16.33.C11.1.454.CMB.1.raw
  modified_base (173)..(174): a, c, t, g, unknown or other
  misc_feature (173)..(174): n is a, c, g, or t

SEQ ID NO: 180576 - DNA, 561 bp, Homo sapiens
  misc_feature: GYAE6OF02G5KIW.16.33.C11.1.454.CMB.1.raw
  modified_base (420)..(420): a, c, t, g, unknown or other
  misc_feature (420)..(420): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggagtgggggaggattgatcccagtgactctcacatcaactacacgcccgtccttaccaaggccacgtcaccatctcagctgacaacgtccatcagtactcgtcccttcngctagtggccgcacgccgtagggacggcccgtcggaccgacccgccaatacttacttacgtgtgccgtacggttccgttatccgccgcagtctcactactacctacgtaccggtctggaccgtcgtcggggacctaacggg

SEQ ID NO: 180577 - DNA, 736 bp, Homo sapiens
  misc_feature: GYAE6OF02HS8EJ.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctccgtgtaagggttctggatacgtaggttttccagctacgtggactccgaccgttgggtcgccgaccgagaacggtacccgggtaaaggccgtgggaggtggagtaggggggagtagttaggactcccgaggtcgactcgtacactactaccaaactacgacgtccccgttccttaccgaacgggccctaaccgtccaacctactcctaccacggtcctagaacctaacgttcccaagtctaacgttacgtcgtccctttccgtgaccgtaggtcggccgacgtacggtcccgtagggaccgtccggtaccggaacctaaccccggtcctaaacgtttagtaaccgtttacgtacggttccgaccgggttaacggttacccgggttaaccgtccggacccggtactacggtaaccttaccgaaccctttaaccgtaaccgttaaccgtaccggttacgtaccggtaacccggtttccgggtacggggaaccctaaacccggggg

SEQ ID NO: 180578 - DNA, 260 bp, Homo sapiens
  misc_feature: GYAE6OF02H3REI.16.33.C11.1.454.CMB.1.raw
  modified_base (248)..(260): a, c, t, g, unknown or other
  misc_feature (248)..(260): n is a, c, g, or t
tcagtgtactactccacgaccggtgctcgatttagagtgagctcgttgggggcaaagctgccctgaccctttcgggtgcgcagcctgaggatgaggctgagtattactgcttgctctcctatagtggtgttcgggtgttcggcggagggaccaagctgaccgtctaggtcagcccaaggctgccccctcggtcactctcgttcccgccctctcgagtagtacactgagcggctggcaaggcgcatagnnnnnnnnnnnnn

SEQ ID NO: 180579 - DNA, 561 bp, Homo sapiens
  misc_feature: GYAE6OF02FI9KS.16.33.C11.1.454.CMB.1.raw
  modified_base (282)..(282): a, c, t, g, unknown or other
  misc_feature (282)..(282): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtncgccagaagcccggtaaaggcctggagtgggagtggggagattgatccagtgactctcacatcaactacagcccgtcttaccgaaggccacgtcaccatctcagctagacaagtccatcagtactgtccctctgcagtcggcgcaggccctggacggcctcggacacccgcattactaattactgtcgcgtagtccggttatccggccagacgtataccaacgttacctaactacgtacggtcgttaggtaccgtccggtcggggacccgtaaacgggg

SEQ ID NO: 180580 - DNA, 569 bp, Homo sapiens
  misc_feature: GYAE6OF02FQQEV.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccgggggagtctctgaggatctcctgtaagggttctggatacaggttttccagctactggatcacctgggtgcgccagaacgcccggtaaaggcctggagtggagtggggaggagttgatcccgagtgactctcacatcaactacacgtcccgtcccttacgaacggcccacgtcaaccatcctacagctgacaagtccatcagtactcgtccttcctgcagtcggcgcgagccgtggacggcctcggaccaccgccatactacttactgtcgcgtacggttcgttactccgccgcagtactccacctacttacctacgtacggtcgtaggtaccgtcgtcggggaccctaaccgggg

SEQ ID NO: 180581 - DNA, 785 bp, Homo sapiens
  misc_feature: GYAE6OF02INCPM.16.33.C11.1.454.CMB.1.raw
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctcctggtaagggttctggatactaggttttccagctactggatcaccgtgggtgcgccagaacgcccggtaaaggcctggagtggagtgggggaggagttggactcccgagtcgactctcacatcaactacgacgtccccgttccttacccgaacggtcccaaccgttacccgaaccctaacgttcctaccgaacgtccgttacgaacctaacggttccctaattccgtaaacgttacccgttacggtccccctttccgttacggaccgtagggttccgggaccgaccggtaaccggtcccggtacggggaccgggtccccgttaaccgggaacccgtaccccggacccgttaagttaacgtttaaccgtttaccgttcgggtaccgtaccgggtaaccgggtttcccgggtttaactccccgggtacccgtacgacgggtaaccttacccgtaacttaacccgttaacccgtttaaccgttcccgggtaccggtttaccggggacccggtttaccgggtacccgggggggtaaccccgtaaacccgggggg

SEQ ID NO: 180582 - DNA, 176 bp, Homo sapiens
  misc_feature: GYAE6OF02GO3RD.16.33.C11.1.454.CMB.1.raw
  modified_base (174)..(176): a, c, t, g, unknown or other
  misc_feature (174)..(176): n is a, c, g, or t
tcagtgtactactccacgaccggtgctcgatttagagtgagctcgttgggtttgggggaagaggaagactgacggtccccccaggagttcaggtgctgggcacagcggccctgggctgcctggtcaaggactacttccgagtagtacactgagcgggctggcaaggcgcatagnnn

SEQ ID NO: 180583 - DNA, 553 bp, Homo sapiens
  misc_feature: GYAE6OF02G876J.16.33.C11.1.454.CMB.1.raw
  modified_base (283)..(283): a, c, t, g, unknown or other
  misc_feature (283)..(283): n is a, c, g, or t
  modified_base (345)..(345): a, c, t, g, unknown or other
  misc_feature (345)..(345): n is a, c, g, or t
  modified_base (419)..(419): a, c, t, g, unknown or other
  misc_feature (419)..(419): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatactaggttttccagctactggatcacctgggtncgccagaacgcccggtaaaggcctggagtggagtgggggagattgatcccagtgactctcanatcaactacacgcccgttccttaccaaggccacgtcaccatctcagctgacagtccatcagtactgtcccttcngcaggtcgcgcacgccgtggaccgcctacggaccaccgcaactatattctgtgcgtacgttccgttanccgccganacgtatctactacttacgtacgtacggtcgtaggaccgtcggtcgggacctaaccggg

SEQ ID NO: 180584 - DNA, 592 bp, Homo sapiens
  misc_feature: GYAE6OF02I15CS.16.33.C11.1.454.CMB.1.raw
  modified_base (387)..(387): a, c, t, g, unknown or other
  misc_feature (387)..(387): n is a, c, g, or t
tcagtgtactactccacgaccggtgctcgatttagagtgagctcgttgggtttgggggagtctccttcaccacccagctgggatctcagggcttccttttctgtcctcctccaggatgggggtcaaccgccatcctcaccctcctcctggctgttctccaaggagtctgtgccgaagtgcagctggtgcagtccggagcagaggtgaaaaaagcccggggagtctctgaggatctcctgtaagggttctggatactaggttttccagctactggatcacctgggtgcgccagacgcccggtaaagcctggagtggagtggggagattgactcccagtgactctcacatcaactacacgtcctcctaccgaaggccacgtcaccatcncagctagacaacgtccaatcaacgttactcgtacccttccgtgaccaggttcggcgtaccgacgtccggtgggaaccggtcccgtccggacacccggcaagttctatttaccgtgtagcgtacgttccggttagtccgccgcaggtcactactacttacctacgttacggtcgtacggaccgtcggtaccgggaccgtaaccggg

SEQ ID NO: 180585 - DNA, 597 bp, Homo sapiens
  misc_feature: GYAE6OF02HI2HA.16.33.C11.1.454.CMB.1.raw
tcagtgtactactccacgaccggtgctcgattttagagtgagctcgttgggtttgggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggatctctgaggatctcctgtaaggttctggatactaggttttccagtctactggactcaccgtgggtgcgccagaacgcccgggtaaagcctggagtggagtggggagattgactcccagtcgactctcacatacaactacacgcccgtccttaccgaacggcccacgtccaccatctacagcctagactaacgtccatacatactcgccttctgcagtgcgcacgcgtggaggcctcggaccacccgtaccattacgtaacttactagtcgtacgacggtttccgttagtcccgtcccgctacggaatccctaaactacctaacttacggtaaccgttccgtagggtaccggtcgtaccgggggaccgtaaaccgggg

SEQ ID NO: 180586 - DNA, 738 bp, Homo sapiens
  misc_feature: GYAE6OF02GS3NU.16.33.C11.1.454.CMB.1.raw
tcagtgtactactccacgaccggtgctcgattttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcgaggaggtagaaaaaaggcccggggagtctcgtggaggatctccgtggtaagggttcgtaggatacgtacggttttccagctacgtggatcgacgtgggtcgcgccgaagaacgacccgggtaaggcgtggaggtggaggtggggaggtatcggacgtaccgtaggtcgtacgtctaccactactaccaaccgtacaccgtcccgtcccttaaccgaaccggacccacgtccaaccgtactcctacgacgcgtagaaccgtaacgtcctaacgtctaacgtacttccgtccctttaccgtgtaccggacgggtacggccgtaccggtacggtacccgggtacgggacccgggtaccccgtaccgggaaccccgaaccccggtaacctaacgtttattaaacgttaaccgtggtttaacggacggtaacccggtttacgggttcgccggtacccgtaacgacggtaactaccgtaactaaccgttaactaccggtcgtacggtccggtaaccggtcgggtaccggggaaccgtaaccgggg

SEQ ID NO: 180587 - DNA, 874 bp, Homo sapiens
  misc_feature: GYAE6OF02H7G9D.16.33.C11.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggancagaggtagaaaacggcccggggatctcgtgaggatctcctagtagggttcnggtatacgtggttttaccagtctacgtggatcctaccgttggggtcgccgacctaaggaaccgtacccggggtaaaaggtcccgtaggggacggttaggtagggtaggggggtaacggttaggtttacggaacgttccccggtaaggttccggtaccttaccttaccgaactactaccctaacctaccgtaccggtcccccgttacccgtttaccggaaaccggtcccctaaccggttacccaaccctacttcccgttacgacggtccgttaccgaaccgttaaccggtaccctagtacccgtacggtttaaccgttcctaccccgttttaccgtacggcccgtaacggggttccgggaccgtacccggttaaccggttcccgggtaacgggtcccgggtttcccgacccgggtaaccccgtaccccgggtacttaaaccttacgttttaacggttaccgttgggtaacccggttaccgggtacggtttaaccccggtttacggcccgtacccggtacgtagtacctttacccgaaaccgtttaccctttaacccggtaccggttaaccgggttcgttaccggggttaccccgtacggggttcccggggaaacccgtaacccgggg

SEQ ID NO: 180588 - DNA, 768 bp, Homo sapiens
  misc_feature: GYAE6OF02H47HU.16.33.C11.1.454.CMB.1.raw
tcagtgtactactccacgaccggtgctcgatttagagtgagctcgttgggtttgggggagtcctccttcaccacccagctggggatctcaggggcttccttttctgtcctcctccaggatggggtcaaccgccatcctcacctcctctggctgttctccaaggagtctgtgccgaagtgcagctggtgcagtccggagcaggaggtagaaaacggccggggagtctctgaggatctccgtagtaggttctggtatacgtaggttttccagtctacgtggtactccgtaccggtgggtcgccgtaccgaacggaaccggtacccgggtaacggtccggtagggtaggtagggtagggtagggggtaggttacgttacggaccgttaccggtaggtacgtaccttacctacaactactacctaaccgtaccgtaccggttccccgttacccgttaccggaaccggtaccctaccgtaccctacctacttaccgtacgtacgtcctacgaaccgtacgtaccagtacgtacgttacgtcgttcccttcgtcgcgtaggtcggacgcgtacggtcgacgggtaccgtccgtaccggaccacccgtactaacgttacttacgttaccgtcggtaccggtacggttaccggtttaccggttaccgtaccggacccgtacgaaccgtacttaaccgtaccgttaaccgttaccgtaccggtttaccggtaccggttacggttacccggttacgggtaccgggaacccgtaacggg

SEQ ID NO: 180589 - DNA, 608 bp, Homo sapiens
  misc_feature: GYAE6OF02H8ROU.16.33.C11.1.454.CMB.1.raw
  modified_base (221)..(221): a, c, t, g, unknown or other
  misc_feature (221)..(221): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (522)..(522): a, c, t, g, unknown or other
  misc_feature (522)..(522): n is a, c, g, or t
  modified_base (533)..(533): a, c, t, g, unknown or other
  misc_feature (533)..(533): n is a, c, g, or t
tcagtgtactactccacgaccggtgctcgattttagagtgagctcgttgggtttggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagccggggatcncgtgaggatctccgtggtaagggttctggatactaggttttccagctacgtggatcacgtgggtgcgcagagaccggtaaaggcctggagtggagtggggaggtagttgatccgagtgactcgtcactactacaactacagaccccgtccttaccgaacggccacgtaccaccatctacacgctgaacacgtccatcagtactgtcccttcgtgcgtagtggacncgngtccgtggacgtccgtacggaccacgtcctaattactagttaccgtggttacgccggttacggtccggtttanccggacccganacggtactctaaccgtaaccttaccgtacgtacggtcgtcgggtaccgttccggtacggggaccctaaaccgggg

SEQ ID NO: 180590 - DNA, 622 bp, Homo sapiens
  misc_feature: GYAE6OF02G2EIB.16.33.C11.1.454.CMB.1.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (454)..(454): a, c, t, g, unknown or other
  misc_feature (454)..(454): n is a, c, g, or t
  modified_base (509)..(509): a, c, t, g, unknown or other
  misc_feature (509)..(509): n is a, c, g, or t
  modified_base (549)..(549): a, c, t, g, unknown or other
  misc_feature (549)..(549): n is a, c, g, or t
tcagtgtactactccacgaccggtgctcgattttagagtgagctcgttgggtttgggggagtctccttcaccacccagctgggatctcagggcttccttttctgtcctcctccaggatggggtcaaccgccatcctcaccctcctcctggctgttctccaaggagtctgtgccgaagtgcagctggtgcaggtccggagcagaggtagaaaaaggcccggggatctntgaggatcttccgtaggttaaggttcngggatacgtagtttcagtctacgtgactcgacgtgggtcgcgcaagacggccggtaaaggccgtggacgtggaggtggggagtattcgactcccgagtcgacgtctacgacactacaactacgtaccgtcccttcctaccgaacgcctacgtcactctcgctagcagaactacgtaccatctaagtcctcgtacccttcngacgtaggtccgcgacgtgaccggttggaccggtcccgtaccggaccacccggtntaacttacgtacttacgtgtccgtaggtcggttccgttcnccggtacgacaacggcttactaccgtactacgtacggttcgacggttggtaccggtcgtacgggaccgtacgg

SEQ ID NO: 180591 - DNA, 785 bp, Homo sapiens
  misc_feature: GYAE6OF02JIRDR.16.33.C11.1.454.CMB.1.raw
  modified_base (360)..(360): a, c, t, g, unknown or other
  misc_feature (360)..(360): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctcaccctcctcctgctgttctccgaaggagtctgtgccgaagtgcagctggtgacgacgtcggagcgaaggaggtagaaaaacggcccggggagtctcgtagaggtatcctccgtaggtaacggttcgtaggtactacgttacggtttccagtcctacgtggactaccgtacggttgggagccgccgaaggaaccggacccggttaaaggccgtagggaggttaggngggttaggggagtaagtttcggaactccgtaggtacgacttcgactacgtagtaactaacgtacgtaccgtccccgttaccgttaaaccgacgggtacctaccgtaccaaaccgtaactccgtacgaacgtaccgtaacgaaccgtaacgtcccgtaacgtaccgtagtacccgttcggtaccccttacgttacgacggttacggtaccgggacgacggtaacccggtccgttacgggaccgtcccggtacgaccggtaacctcgtacttacgtactcggtacgttaccgcggtaaaccggttccggttacgtccgggcccctaaggtagttaccgtaccttaacgttaacccgttaccgttaacggttacccgtttacggaccgggtttacccgtaccggggtaccggtaaccgtaacccgggg

SEQ ID NO: 180592 - DNA, 1011 bp, Homo sapiens
  misc_feature: GYAE6OF02HK79V.16.33.C11.1.454.CMB.1.raw
tcagtgtactactccacgaccggtgctcgatttagagtgagctcgttgggtttggggagtctccttcaccacccagctgggatctcagggctttcctttttctgtcctcctccaggagtggggtcaaccgccatcctcaccctcctcctggctgttctccaaggagtctgtcgccgaagtgcagcgtggtgcacgtccggagcgaggtaggtaaggaaaaacggcccggggagtcgtcgtagaggtactcgtccgtaggttaagggttcgtaggtaacttacgttacgggtttttaccagtcgtaacggtacggtaactccgtaacggtgggggtccgccgacccgaacgggaaaccgggtaccccgggtaaaacggggtcccgttaggggtaacgggttaggggaaggttaggggggtaaagggtacgttttaaggaacccgttcccggtaaggttacgtacccgtttaccaccggtaactaaccgttaacctaaacccgttaaccgccggttaaccccccgtttaccgttaacccggaaaaccgggttccccgtaaaccgttaccctaaaccccgttcttaccccgttaacgaaccggttacccgtaacggaaaaccccgtttaacggtttacccaaggtttaacccgtacccggtttaaacccgtttcccggtcccccttttacgttacgggaccgtaacgggttcgggaaccccggttcgtaaccgggtccccggtttaacggggacccgttaacccgggtcccgtaaaccccgggaacccgttacgtttaaaccgtaacgtttaaccgttccggtacggttaacccgggtaccgggtaacgttttaccccggggttttaccacccggggaccccgtaacggttacgaaaccgtttacccgtaaaccgtttacccccgtttaaaggaaccccggttttaccggggtaaccggttccgggtaacccccgggtttccgggtaaccgggggtaacccggtaaacccgggg

SEQ ID NO: 180593 - DNA, 660 bp, Homo sapiens
  misc_feature: GYAE6OF02F40E0.16.33.C11.1.454.CMB.1.raw
  modified_base (441)..(441): a, c, t, g, unknown or other
  misc_feature (441)..(441): n is a, c, g, or t
  modified_base (497)..(497): a, c, t, g, unknown or other
  misc_feature (497)..(497): n is a, c, g, or t
tcagtgtactactccacgaccggtgctcgatttagagtgagctcgttgggtttggggagtctccttcaccacccagctgggatctcagggcttccttttctgtcctcctccaggatggggtcaaccgccatcctccaccctcctcctggctgttctccaaggagtctgtgccgaagtgcagctggtgcaggtccggagcagaggtagaaaaacggcccggggagtctctggaggatctcctggttaagggttctggtatacgtaggttttccagtcgtatggactccgaccgtggggtgccgaccgaaggaacgaccccgggtaaaggccgtagggaggtggaggtagggggagtagttcggacgtcccgagtcgactcgtcacacgtacaactacgcgtcccgttcctaccgaacggcccacgttccaacctacttaccncgtacgctacgacaacgtccactactacgtactcgtccttcgtgacgtaggtcgcncgacgccgtgggaccgccgtaccgacgacccgactaatacgttacgttacgtggtcgtacgtacggttccgtacgccgaccgcaaggtcctaacgtaccttaccgtaaccgttaccgtacggttcgtaccggtacggtccggtaccgggaccgtaacccgggg

SEQ ID NO: 180594 - DNA, 743 bp, Homo sapiens
  misc_feature: GYAE6OF02IOXM9.16.33.C11.1.454.CMB.1.raw
  modified_base (409)..(409): a, c, t, g, unknown or other
  misc_feature (409)..(409): n is a, c, g, or t
tcagtgtactactccacgaccggtgctcgatttagagtgagctcgttgggtttggggagtctccttcacccacccagctgggatctcagggcttccttttctgtcctcctccaggatggggtcaaccgccatcctcaccctcctcctggctgttctccaaggagtctgtgccgaagtgcagcgtggtgcaggtccggagcgaggagggtaggaaaaacggccccgggggagtcgtcgtggaggactccgtccgttaggttaagggttcgtaggacttacgttacggttttccagtctacgtggactacaccggtgggtcgccggtaccaggaacggaccgggtaaacggtccgtaggtaggtggaggtagggggagtagttacgacgtccgtaggtcgtacgttcctanaccgtatacctaacgtaccgccggtccccttacccgttaccgaaccggacccgtacgtacccgacctacttaccacgacgtacctacgtaaccgtacgtacccaagtaccgtaacgttccgtccgtaccttccgtagccgtaggtcgcgtacggtaccgtccggtaggaccgcccggtaccggacacccgtacgtaacttacgttacgttacgtcggtacgtacgttcgggtttccgtacgtccgacgtaacgacgtacttaccgtaccttaaccgtaacttaacggttccggttcgtacgggtaccggtacggaccgggaaccgtaacccggg

SEQ ID NO: 180595 - DNA, 554 bp, Homo sapiens
  misc_feature: GYAE6OF01BM1JC.37.20.B09.1.454.CMB.1.raw
  modified_base (144)..(144): a, c, t, g, unknown or other
  misc_feature (144)..(144): n is a, c, g, or t
  modified_base (169)..(169): a, c, t, g, unknown or other
  misc_feature (169)..(169): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (259)..(259): a, c, t, g, unknown or other
  misc_feature (259)..(259): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcggngtgttctaggtggctatttaaaggntcagtgtgagtgagtntgngtntgggagctggcagcctggggtcctgagctctcctgtgcagctctgatcaacttggtgctattggatgnttggtccggccgacgtctcgaggagggcgtggtggtggtcggacgacagtacgaggaggtggtaggtaacgtaaacgtagtgtgtacgtcgtgtcggcggcgtacgtcacactctacacgacgacaaccgaaccaaactactactagtatctacgtactaacgtacgacgtacgtagacgacgtacgacgacgacgtcgtgtagttagttagttagtagtagagtagtagttagtacgtaacgtaagttagtagtagtagtgtagtagtagtgtattagtacgtagtcggtacgg

SEQ ID NO: 180596 - DNA, 546 bp, Homo sapiens
  misc_feature: GYAE6OF01D2LB4.37.20.B09.1.454.CMB.1.raw
  modified_base (171)..(171): a, c, t, g, unknown or other
  misc_feature (171)..(171): n is a, c, g, or t
  modified_base (252)..(252): a, c, t, g, unknown or other
  misc_feature (252)..(252): n is a, c, g, or t
  modified_base (337)..(337): a, c, t, g, unknown or other
  misc_feature (337)..(337): n is a, c, g, or t
tcagtagtgtagatcacgaccggtgctcgatttagtgtagtgtgaaggggagagaggagcccagccctgggattttcaggtgttttcatttggtgatcaggactgaacagagagaactcaccatggagcttgggctgagcgtgtgtttctaggtggctaattttaaaaggngtcagtgtgaggtggaggtgttggagtctgggggaggcttggtacggcctggggggtccctgagctctcctgtgcagcctntggaaataatctttagcaaaatcgccatgatctgggtccgccaggctccagggaagggctggagtgggtctcagccatttccggnaatggtggtggcacgcactacgcagactcgtagacgggccgttcaccgtctccagagacaattccaaagaacacactgtctctgcaatagaacagcctgagagtacgaggagacggccttatattactgtgtgaggtacgtctacgtcccgttactacgcacggcggcgtcggtccgtcggttacgtttgtacgtacgtgggacccggg

SEQ ID NO: 180597 - DNA, 556 bp, Homo sapiens
  misc_feature: GYAE6OF01DCK6I.37.20.B09.1.454.CMB.1.raw
  modified_base (175)..(175): a, c, t, g, unknown or other
  misc_feature (175)..(175): n is a, c, g, or t
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcggtgtcgtttctaggtcggctaattttaaaaggngtcagtgtgaggtgcagctgtcggagtcgtgggggaggcttggacagccgtggggggtccctgacactctcctgtgcagcctntggattcacctttggcagtctttgccatgacgctgggccncaggctccgaggggaagggctgggatgggtctcgagccattaggtagtagtggtggaacgcagtactagctgactccgtagacgggtccggttccncctcncgagacacaaccaccaaacacgcgtctctctctcactaactaacacactagagagaacgacgacgacgtacgtatattacgtagtacggtacggaaggaggtacgtacgacgtagtcgtcgtacgtactacctactaactatacgtggtcggtacgg

SEQ ID NO: 180598 - DNA, 593 bp, Homo sapiens
  misc_feature: GYAE6OF01BO0KD.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggcgttttctaggtggctattttaaaaggtgtccagtgtgaggtggaggtgttggagtcgtgggggaggcttggtacggccgtggggggtccctgagactctcctgtgcagcctctggaataatctttagcaaatacgccatgatctgggtccgccaggctccgaggggaaggggcgtggaggtggggtctcgagccatttccggcaagtggtggtggcacgcactacgcagactcgtgaagggccgttcaccgtctccagagacaattcccaggaacactctatatctgacaatgaacagcctgagacgccgaacgacacggccatattattacgtgtagaccgaaaacgaccccgaaggtacgaacccaactaggtttggaacgttcgtttttacgaacgtttccggtaggggggaaccccaaagggggtacctaaaccggggttccc

SEQ ID NO: 180599 - DNA, 592 bp, Homo sapiens
  misc_feature: GYAE6OF01A3AMT.37.20.B09.1.454.CMB.1.raw
  modified_base (379)..(379): a, c, t, g, unknown or other
  misc_feature (379)..(379): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaggtgtccagtgtgaggtggaggtgttggagtcgtgggggaggcttgggtacggccgtggggggtccctgagactctcctgtgcagcctctggaataatctttagcaaatacgccatgatctggtccgccaggcctccgagggaaggggctggagtgggtctcgagcctactttccggctaagtggtggtggcacgcactacgcagctccgngaacggccgttcaccgtctccagacgacaacttccaaggaacactactatatctagacaatgaacacgcctgagacgaccgaacgaccgaccggaccaatactatttatgtacgacgaaaccgaccccgaaacggtacgaaccgtaacgtagttcgggacttccgttttagacctttcggtaggggaacccaaaggggacctaacgggtaccc

SEQ ID NO: 180600 - DNA, 417 bp, Homo sapiens
  misc_feature: GYAE6OF01BNXB6.37.20.B09.1.454.CMB.1.raw
  modified_base (406)..(406): a, c, t, g, unknown or other
  misc_feature (406)..(406): n is a, c, g, or t
  modified_base (412)..(417): a, c, t, g, unknown or other
  misc_feature (412)..(417): n is a, c, g, or t
tcagtagtgtagatcacgaccggtgctcgatttagtgtagtgtgaaggggctcggagtgggtctcagccatttccggcaatggtggtggcacgcactacgcagactccgtgaagggccggttcaccgtctccagagacaattccaagaatacggtctatctggaaatgaacagcctgagagccgaggacacggccctctattactgtgcgagagatcagacggagtatagcagcagctctgactactgggccacggaaccctggtcaccgtctcctcagcctccaccaaggcccatcggtcttccccctggcaccctcctccaagagcacctctgggggcacagcgccctgggctgcctggtcaaggactacttccatctacactactgagcgggctggcaaggcncatagnnnnnn

SEQ ID NO: 180601 - DNA, 577 bp, Homo sapiens
  misc_feature: GYAE6OF01B2JDL.37.20.B09.1.454.CMB.1.raw
  modified_base (388)..(388): a, c, t, g, unknown or other
  misc_feature (388)..(388): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtgtcgttttctaggtggctattttaaaaggtgtcagtgtgaggtggaggtgttggagtctgggggaggcttggtacggccgtggggggtccctgagactctcctgtgcagcctctggaataatctttagcaaatacgccatgatcgtgggtccgccaggctccgagggaaggggctgggagtgggtctcagccatttccggcaatggtggtggcacgcactacgcagactccgtgaacggccgttnaccgtctccagagacaatccaagaacacgctctatctgacaatgaacagcctagagagccgaagacacggccgtatattactgtgtagaaggcgtaggggagtaggggggtactacggtaggggccgtaaggggaaccccgttgggtacccgtaccggtacttaccccgcgtaccgcccctaaccccgg

SEQ ID NO: 180602 - DNA, 418 bp, Homo sapiens
  misc_feature: GYAE6OF01B2YCS.37.20.B09.1.454.CMB.1.raw
  modified_base (412)..(418): a, c, t, g, unknown or other
  misc_feature (412)..(418): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaagaatacggtctatctggaaatgaacagcctgagagccgaggacacggccctctattactgtgcgagagatcagacggagtatagcagcagctctgactactgggccacggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnnnnnn

SEQ ID NO: 180603 - DNA, 441 bp, Homo sapiens
  misc_feature: GYAE6OF01AZMNZ.37.20.B09.1.454.CMB.1.raw
  modified_base (337)..(337): a, c, t, g, unknown or other
  misc_feature (337)..(337): n is a, c, g, or t
  modified_base (434)..(441): a, c, t, g, unknown or other
  misc_feature (434)..(441): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaagacccaaacggtgaccacattggagctttttgacttctggggccaagggacaacggtcaccgtctcttcagcctccaccaagggccccatcggtccttccccctggccgcccctgctccaggacnccacctccgagacgccacaggccggcccctggggcctggccctggtcaaggactacttccatctacactactgacgcggctggcaaggcgacatagnnnnnnnn

SEQ ID NO: 180604 - DNA, 428 bp, Homo sapiens
  misc_feature: GYAE6OF01CSR8G.37.20.B09.1.454.CMB.1.raw
  modified_base (414)..(414): a, c, t, g, unknown or other
  misc_feature (414)..(414): n is a, c, g, or t
  modified_base (420)..(428): a, c, t, g, unknown or other
  misc_feature (420)..(428): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattatgtgcgaaagaccccaacggtgaccacattggagtcttttgacttcgtggggccaagggacaacggtcaccgtctcttcagcctccaccaagggcccatcggtcctccccctggcgccctgctccaggcgcacctccgagacgcacagcggccctgggctgcctggtcaaggactacttccatcctacactactgagcgggctggcaaggcncatagnnnnnnnnn

SEQ ID NO: 180605 - DNA, 423 bp, Homo sapiens
  misc_feature: GYAE6OF01D238O.37.20.B09.1.454.CMB.1.raw
  modified_base (411)..(411): a, c, t, g, unknown or other
  misc_feature (411)..(411): n is a, c, g, or t
  modified_base (415)..(423): a, c, t, g, unknown or other
  misc_feature (415)..(423): n is a, c, g, or t
tcagtagtgtagatcacgaccggtgctcgatttagtgtagtgtgaaggggctggagtgggtctcagccatttccggcaatggtggtggcacgaactacgcagactccgtgaagggccggttcaccgtctccagagacaattccaggaacactctatatctgcaaatgaacagcctgagagccgacgacacggccatatattattgtgcgaaagaccccaaacggtgaccacattggagcttttgacttctggggccaagggacaacggtcaccgtctcttcagcctccaccaaggcccatcggtcttcccctggcgccctgctccaggacgcacctccgagacgcacagcggccctgggctgcctggtcaaggactacttccatctacactactgagcggctggcaaggcncatnnnnnnnnn

SEQ ID NO: 180606 - DNA, 594 bp, Homo sapiens
  misc_feature: GYAE6OF01B1DEF.37.20.B09.1.454.CMB.1.raw
  modified_base (255)..(255): a, c, t, g, unknown or other
  misc_feature (255)..(255): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (550)..(550): a, c, t, g, unknown or other
  misc_feature (550)..(550): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcggtgtcgtttctaggtggctaatttaaaaggtgtcagtgtgaggtggaggtgttggagtcgtgggggaggcttggtacggccgtgggggtccctgagctctcctgtgcagcctntggaataatctttagacaaatacgccatgatctggtccgccaggctccgaggggaagggctgggagtgggtctcgacgcctagtttcccggnaagtggtggnggcacgcactacgcagactcggagacggccgttcaccgtctccgagacgactaacttccaacggtaacactctatactctgacaaatcgaacaggcctggaacacgccgtaacgaccgacggacctattaattatttagttgtacgaacgtaaaccgaccccgaacgggtcaacccgagtacgttggccgttntttacggctttacgggtcgggacaaggggtaccacgggttaccc

SEQ ID NO: 180607 - DNA, 456 bp, Homo sapiens
  misc_feature: GYAE6OF01CL54K.37.20.B09.1.454.CMB.1.raw
  modified_base (440)..(440): a, c, t, g, unknown or other
  misc_feature (440)..(440): n is a, c, g, or t
  modified_base (445)..(456): a, c, t, g, unknown or other
  misc_feature (445)..(456): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaagaccccaacggtgaccacattggagtcttttgacttcgtggggccaagggacaacggtcaccgtctcttcagcctccaccaaggcccatccggtccttccccctggccgcccctgcctccgaggacgccaccctccgagacgccacacggccggcccgtggggcctcggccctggtaccaaggtacctacttccatcctacactactgacgcgggctcggcaaggcanatagnnnnnnnnnnnn

SEQ ID NO: 180608 - DNA, 595 bp, Homo sapiens
  misc_feature: GYAE6OF01CN23J.37.20.B09.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggtctttttcttagtggctaattttaaaaggtgtccagtgtgaggtggaggtgttggagtcgtgggggagcttggtacggccgtgggggtccctgagactcgtcctgtgcagcctctaggaataatctttagactaaatacgcatgatcngggtccncgagctcgagggaagggctggagtggtctcgacgctacgtttccggnaacgtggtggtcggcncgcactacgcgagaccgtcgtggaacggtccgttacacgtcctccgagacactaactaccgaagtaacctacgtacttatatctagacaaatacgaaactcgacctagacgacgaccgacgacacggacctagtatacgttatggtacaacgaaacgaccccgaagtcaaccgacgtgtaggtacttccgtttagacgttcggacgggaccgaaacgggcgtaaccgtcccg

SEQ ID NO: 180609 - DNA, 583 bp, Homo sapiens
  misc_feature: GYAE6OF01CVXZX.37.20.B09.1.454.CMB.1.raw
tcagtagtgtagatcacgaccggtgctcgatttagtgtagtgtgaagggggagagaggagcccaagccctgggattttcaggtgttttcatttggtgatcaggactgaacagagagaactcaccatggagcttgggctgagctggctttttcttgtggctatttttaaaaggtgtccagtgtgaggtggaggtgttggagtctgggggagcttggtacggcctggggggtccctgagactctcctgtgcagcctctggaatatcttagcaaatacgccatgatctggtccgccaggctccgaggggaaggggctggagtgggtctcagcctagtttccgcaagtggtggtggcgacgcactacgcacgactcggtggaacgggtccggttcgtaccgtctccagagacaacttaccgagaacactctatatctgacaagtagaacacgcctgaagacgaccgaacgacgaccgactatattattattagtacgacgaaaccgacccgaacggtacgaccgactagttcggagttcgttttcgtacgttcggtacgggaccgaacgggaccgtaacggtacccg

SEQ ID NO: 180610 - DNA, 616 bp, Homo sapiens
  misc_feature: GYAE6OF01EC69Y.37.20.B09.1.454.CMB.1.raw
  modified_base (297)..(297): a, c, t, g, unknown or other
  misc_feature (297)..(297): n is a, c, g, or t
  modified_base (404)..(404): a, c, t, g, unknown or other
  misc_feature (404)..(404): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctgtactttttcttgtggctattttaaaaggtgtccagtgtgaggtggaggtgttggagtcgtgggggagcttggtacggccgtggggggtccctgagactctcctgtgcagcctctggaataatctttagacaaaatacgccatgatctgggtccnccaggctccgaggggaaggggctgggagtggggtctcgagcctatttccggcaagtggtggtggcacgcactacgcagactccgtagaacgggtccgttcaccgtcnccagagacattccaggaacactctaatactctgacaaatgaaacagcctagagacgccgaacgacgaccggacctagtaattagttattcggtacgaccgtaaaacgacccccgtaaacgggtacgaaccctacgttagttgggaacttcgtttttacggaccgttttcggacgggggtaaccaaacgggggtccctaaaccggggttaccc

SEQ ID NO: 180611 - DNA, 527 bp, Homo sapiens
  misc_feature: GYAE6OF01CZDZ5.37.20.B09.1.454.CMB.1.raw
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (287)..(288): a, c, t, g, unknown or other
  misc_feature (287)..(288): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
tcagtagtgtagatcacgaccggtgctcgatttagtgtagtgtgaagggggagagaggagcccagccctgggatttttcaggttgttttcatttggtgatcaggactgaacagagagaactcaccatggagcttgggctgagcgtgtcgtttctaggcgactaatttaaaaggtgtcagtgtgaggtggaggtgttggagtcgtggggagcgttggacggcgtgggggtcctgagctctctgtgcancctntgaatacttnttagacaaatacgcatnatcnggccnngncgaggaggngngngtggntcngcnttcgnangtgngcncgcacagcngacncgacgacggcgttcgcgcncacgagacactacgaaggaacactactatactcttaataanaatacgaacgacgacgagacgacgacgacgacgacgactatatatatacgtacgaacgaacgaaccgaccgacgacgtactagtagtcgttcgttgtacgtcgacggacggaacggacgacgtacg

SEQ ID NO: 180612 - DNA, 548 bp, Homo sapiens
  misc_feature: GYAE6OF01B2F4A.37.20.B09.1.454.CMB.1.raw
  modified_base (442)..(442): a, c, t, g, unknown or other
  misc_feature (442)..(442): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaggtgtccagtgtgaggtggaggtgttggagtctgggggaggcttggtacggcctggggggtccctgagactctcctgtgcagcctctggaataatctttagcaaatacgccatgatctgggtccgccaggctccgaggggaaggggctgggagtgggtctcagcctatttccgggacaagtggtggtggcacggcactacgcagactcggtgaagggccgttcaccgtctccagacgacaattccaaggaacactctatatctgacaatgaacngcctgagcgccagacacgcatatattatgtagacgaaacgacccgaacggtcgaccacagttggacttctttagacgttcgcggggaccaaggggtcacgggtacc

SEQ ID NO: 180613 - DNA, 648 bp, Homo sapiens
  misc_feature: GYAE6OF01C5WUY.37.20.B09.1.454.CMB.1.raw
  modified_base (257)..(257): a, c, t, g, unknown or other
  misc_feature (257)..(257): n is a, c, g, or t
  modified_base (320)..(320): a, c, t, g, unknown or other
  misc_feature (320)..(320): n is a, c, g, or t
  modified_base (368)..(368): a, c, t, g, unknown or other
  misc_feature (368)..(368): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggtcttaattttaaaaggtgtccagtgtgaggtggaggtgttggagtcgtgggggaggcgttgggtacggccgtggggggtccctgagactctcctgtgcncgcctcgtaggaaattaattctttaagactaaataccgcaatgatcgtgggtccgcgacggcnccggaggggaacggggctagggagtcgggtctcgacgcctagttccgntaagtggtggtcgcacgcactacgcacgctcgtaggaacggtccgtcaccgtctaccgaggaacgaactaacttccgaaacggtaacacgttactattacgtactacgaacaaatacgaaacaccgactagaacgacgaccgaacgaccgacgactattataacttagttagacgaaccggtaaacgaccccgtaaaggtccaacctaagtattcggtaacgtttacgttttagaccgttaccggggacggacggaaacgggtaaccgtacggtaacccg

SEQ ID NO: 180614 - DNA, 436 bp, Homo sapiens
  misc_feature: GYAE6OF01B5311.37.20.B09.1.454.CMB.1.raw
  modified_base (396)..(396): a, c, t, g, unknown or other
  misc_feature (396)..(396): n is a, c, g, or t
  modified_base (422)..(430): a, c, t, g, unknown or other
  misc_feature (422)..(430): n is a, c, g, or t
  modified_base (432)..(436): a, c, t, g, unknown or other
  misc_feature (432)..(436): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattatgtgcgaaaagaccccaaacggtgaccacattggagcttttgacttctggggccaagggacaacggtcacgtctcttcagcctccaccaagggccccatcggtcttccccctggccgcccctgcctccaggacgcacctccgagacgcacagcggcctggctgcctggtcaaggctactccatcctacactacngacgcgggctggcaaggcgacatagnnnnnnnnnannnnn

SEQ ID NO: 180615 - DNA, 702 bp, Homo sapiens
  misc_feature: GYAE6OF01DT50U.37.20.B09.1.454.CMB.1.raw
  modified_base (144)..(144): a, c, t, g, unknown or other
  misc_feature (144)..(144): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcggngtcgtttctaggtcggctaatttaaaggtgtcagtgtgaggtggaggtgttggagtcgtgggggaggcgttggtacggccgtggggggtccctgagtactctcctgtgcagcctntgaataatnttancaaatacgcaatgatcgtcggtcnccnggctccgaggggaacggggcttaggggnggtggtctcgacgtcctacgttcgagtaggtggtcggtcggcacgacacgtaccgactacgtccgtacggtaacgggtaccggtcccggtaccgacccgtacaccgaacgtaacgtaacgtacgtacccgaaagaccttacttaattagtaccttacgtaaccgaaagtaaacgtaacgtaacgtacgtacgtaaaaaaaaaaacgacgacgaccgaaccgaaccgtaacgtactaacgttaacgttaacgttacgttagtacgtaaccgaaaccgaacccgaaccgtaacgtaccgtaacgtaagttacggttacgttacgttacgttacgttacggtacgggtaccggtaacggtaaccggtacccggtaccg

SEQ ID NO: 180616 - DNA, 803 bp, Homo sapiens
  misc_feature: GYAE6OF01DK8CO.37.20.B09.1.454.CMB.1.raw
tcagtagtgtagatcacgaccggtgctcgatttagtgtagtgtgaaggggagagaggagcccagccctgggattttcaggtgttttcatttggtgatcaggactgaacagagagaactcaccatggagcttgggctgagctggtctttttcttgtggcttaattttaaaaggtgtccagtgtgaggtggaggtgttggagtcgtggggaggcgttggtaccggccggtcgggggtccctggacgtacctctccgtgtgcacgtcctcgtaggtaaattaacttctttaagacctaaataccgaccaagttgacgttcgtcgggtcccgaccgtacggaccgtacggaaggggtacggtcggtagggtacggttcggtctacgacgtacgttacgttaccgacgtaggtcggtaggtcgacgacgaccgacgtacgacgtacgtaccgtacggtacggtaccggtacccgttaccgtaccgtacctacgaacgtaacgtaactaaccgttaaccggaacgtaacctacgttaacttattaccgtaccgtaacgtaaccaaacgtaccgtaaaccgtcgtacccgtaaggaacgaacccggtaaccgtaaccggtaaccggaaccgtaacctttaagtttaacgtttaatttacggttccggtaaaccgaaaacccggtaaaccccgtacccgggtaacgaaccgtaaaccccgtaggtttaacggttcggtaacctttttccgttaacgttacccggtcggggaaaccgtacggtaaaaccccgggcgtaacccgttaaccccg

SEQ ID NO: 180617 - DNA, 714 bp, Homo sapiens
  misc_feature: GYAE6OF01B5TGN.37.20.B09.1.454.CMB.1.raw
  modified_base (301)..(301): a, c, t, g, unknown or other
  misc_feature (301)..(301): n is a, c, g, or t
  modified_base (443)..(443): a, c, t, g, unknown or other
  misc_feature (443)..(443): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggcttaattttaaaaggtgtccagtgtgaggtggaggtgttggagtcgtgggggagtcgttggtacggccgtgggggtccctgagactctcctgtgcagcctctggaataatcttagcaaatacgccatgattcgtcgggtcccncaggcctcgaggggaagggctgggaggtgggtctagaagttacgtagtgctacgttaggtaactagagacagaactacgcacgaccgtcgtaggaacggtccgttacacctatcctacgagacgaactaactaccaagaacncgtactactatctagacaaatacaaactacgacctagaacggacgaaccgaaacgaccgaaccgggtaccttaacttaacgtttacgtagggttacggaagggtaaaacggggtcgggttaacgggggtaggggtaacggggggggtaaccgtttaaccggggacggggggtaaaccccgaaaccggggggtaaaccccccggttacggggttaccccgtaacccccggttttccggtaaccccctaccggtaacccggtaacccccccgg

SEQ ID NO: 180618 - DNA, 679 bp, Homo sapiens
  misc_feature: GYAE6OF01BY0EQ.37.20.B09.1.454.CMB.1.raw
  modified_base (298)..(298): a, c, t, g, unknown or other
  misc_feature (298)..(298): n is a, c, g, or t
tcagtagtgtagatcacgaccggtgctcgatttagtgtagtgtgaagggggaggagaggagcccagccctgggattttcaggtgttttcatttggtgatcaggactgaacagagagaactcaccatggagcttgggctgagctgtcttttcttgtggcttattttaaaaggtgtccagtgtgaggtggaggtgttggagtcgtggggagcgttgggtacggccgtgggggtccctggacgactctcctgtgcagcctctggaataatctttagctaaatcgccatgatcgtgggtccncgaggcctaccgaggggaagggctgggagtgggtctcgacgtcctaagtttccggactaagttggtcggtggcctacggctactacgcagacctccggtaggaacggtcccgttcacccgttctaccgagacgaactaacttccgaaggtaacaccttactaagtaactctaagactaaatacgtaacacgaccgtaggacgaacgacccgaacggtaaccaaccgggtacctaagttaacttattacgttgtacgaacggtaaaccgaccccgtaagggtacctaccgaacgttaggttacggtacgttacgtttttaccggaaccggttttaccgggacggggtaacccgaaacggggtaccgtaacccgggttacccg

SEQ ID NO: 180619 - DNA, 740 bp, Homo sapiens
  misc_feature: GYAE6OF01DKX87.37.20.B09.1.454.CMB.1.raw
  modified_base (346)..(346): a, c, t, g, unknown or other
  misc_feature (346)..(346): n is a, c, g, or t
  modified_base (522)..(522): a, c, t, g, unknown or other
  misc_feature (522)..(522): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtcttttcttgtggcttattttaaaaggtgtccagtgtgaggtggaggtgttggagtcgtgggggagtcgttggtaccggccgtcgggggtccctgacgactctcctgtgcagcctcgtaggaataatcttagacaaataccgccatgactcgtcgggtccgaccgaggccgtaccggaggggaacgggggtccgtaaggggngggtttggggtcctacgacggtccctaggttttacccgggactaaaggttgggtacgggtcggaccgaccgacctaaccgtaccgacaacggaccgttaccggtacggaacggggtcccgttcgacccgtcctaccagaacgactacttaccgacggaactactactatctcgtanaacctaagtcgaaaccgacgtcctaaggacggacccgaccggaacgtaacccgaccggtaacctaattaacttagttttactcggtaacccggaaacggtaaaacccccgtaacccggaacggttaccgacccgtaaacgtacggtttacggtacgtttcgttttacgaccgtttcgggtaacccggacgtaaacggggacccttaacgggtaccccg

SEQ ID NO: 180620 - DNA, 825 bp, Homo sapiens
  misc_feature: GYAE6OF01CC9LL.37.20.B09.1.454.CMB.1.raw
  modified_base (784)..(784): a, c, t, g, unknown or other
  misc_feature (784)..(784): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggtctatttacaaaaggtgtccagtgtgaggtggaggtgttggagtcggtgggggagtcgttgggtaccggtccggtcggggggtccctggacgtactccgttccgtggtcgcgtacgtcccgttcgtaggtaaatttaacgttacgttttaacggaacctaaaacgttaccggacctaagttcggtaacttccggttccggggtaccccggcccgtacgggtacccgttacccgggaaggggggaacggggtccggtaggggtacggttcgggttcctacggtaaccgtcccgttacggttttacccgggacgtaaggttggggtacgggtacggaccgaaccggtaccgtaaccgtaaccgaccgaacggtacccggtccgggtaacgggtaacccggggttccccggtttacccgtacccggttccgtacccgaaggtaacgtaacctaaccgtttacccggaaacgtaaacctccgttaactaattcctacgtaagaactaaacgtacgaaccgtcgacgtagaacgaccgaccggtaacacgacccgtactaagttattagttacgtaggaaccgaacggtaaacccgacccgtaggtacaccctagtaggttcggtacgttnttaccggtactacgggaccggacgtaaacgggccttaccgg

SEQ ID NO: 180621 - DNA, 175 bp, Homo sapiens
  misc_feature: GYAE6OF01CBN78.37.20.B09.1.454.CMB.1.raw
  modified_base (162)..(175): a, c, t, g, unknown or other
  misc_feature (162)..(175): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctggagcgggctggcaaggcgcatagnnnnnnnnnnnnnn

SEQ ID NO: 180622 - DNA, 717 bp, Homo sapiens
  misc_feature: GYAE6OF01CWKMC.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtgtcgttttcttaggtcggtcttaattttaaaaggtgtcagtgtgaggtggaggtgtggagtcgtggggagtcttggtcggccggtcgggggtcctgagactctccgtgtcgcacgcctcgtaggaaattaagttcttagacaaactacgaccatagactcgtcggtccgccgacggccgtaccggaagggggaacgggtcggtagggtagggttcggggttccgtacgtacggtaccgttacggtttacccggacgtaacggttgggtacgggttcggaccgtaccgaccgtaaccgtaccgcgaacgtacccggtaccggtagggaccgggtcccgtaccgtaccgtccgtacgacgacctaacgtacgtaccgaacgtaactaccgttctaaagttcgttacgacgtaaccaaggtacaacggtacgtacgtacgacgacgaccgtacgaacgaccgtactagttaacttagttagcgtacgaaccgtaaacccaccggtagaccaccgtacgtagtacggtcttacggtttacgcgtttacgggacgaaccggtacggaacttcgtacccg

SEQ ID NO: 180623 - DNA, 621 bp, Homo sapiens
  misc_feature: GYAE6OF01DC1V1.37.20.B09.1.454.CMB.1.raw
  modified_base (156)..(156): a, c, t, g, unknown or other
  misc_feature (156)..(156): n is a, c, g, or t
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
  modified_base (446)..(446): a, c, t, g, unknown or other
  misc_feature (446)..(446): n is a, c, g, or t
  modified_base (465)..(465): a, c, t, g, unknown or other
  misc_feature (465)..(465): n is a, c, g, or t
tcagtagtgtagatcacgaccggtgctcgatttagtgtagtgtgaagggggagagaggagcccagccctgggtattttcaggtgttttcatttggtgatcaggactgaacagagagaactcaccatggagcttgggctgagcgtggtcttttctgnggctaatttaaaaggntcagtntgaggtggaggtgtggagtgtgggggagcgttgggtaccggccggtgggggtccctagagactctcctgtgcagcctntggttcagttcttagacaactacgccagtgagctgggccncaggctccgaggggaacggctaggagtgggtctacgaggttatacgtggtaagtaggtactaaccgntatactagacagactccggngacgggtccgttcaccgtcgtaccaaggaactaactaacttccgaaaaggtactacggtctanacgtaagaactagaaacgngtccaggagaccgacggaaggtaccacccggtacccttgtaacttaccgtgagtccgaagtacgatacgaacgggtaacgaatagacgcgtaaaggactacggtctacgtagaacccttgggaaaccgggcccaaacgggtacctcgggtaacccc

SEQ ID NO: 180624 - DNA, 836 bp, Homo sapiens
  misc_feature: GYAE6OF01EQ5NX.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccagtggagtcttgggctggagtcgttggttcttttttcttggttggtactttaagtttttaaaaagggttcgtaccgtaggttgtggagggtgggtaggttggttgggagttcggtgggggaggtcgttgggtaccgggccggttcggggggtcctggacgtactcgttccgtgtgctacgccttacgtaggtaaattaacttcgtttaagactaaaacgtaccgacctaagtgtaacgttccgtacggggttcccgaccgcgggtaccgtacccgggaagggggtaacggggtcgtaggggtacggttacggggttctaccgtaggtacccttacggttttccggactaagggttcgggtagggtcggtaccgaccgtctaacgtaacggccgtaaacggtaccgttccgggtaacgggtaaccgggtccggtttacccgaaccggtttcccgaaccgtaaacggaactaacgtaaccttacccggaaaggtaacctacttacttaatactacgtagtaaccgaaattacgaactcgacgttaggaacgacggcgaacgaccgaccgtaacctagttaactttagttaacgttgaaccggtaacgaaacccggaacccgtaacggtacctaacgtacgtaggtttacgtggtttaccgtttcggtaacgtttcgggaccgggtaaacggtacggtaaccgtaacggtaccccg

SEQ ID NO: 180625 - DNA, 723 bp, Homo sapiens
  misc_feature: GYAE6OF01CHJNJ.37.20.B09.1.454.CMB.1.raw
  modified_base (171)..(171): a, c, t, g, unknown or other
  misc_feature (171)..(171): n is a, c, g, or t
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (341)..(341): a, c, t, g, unknown or other
  misc_feature (341)..(341): n is a, c, g, or t
  modified_base (523)..(523): a, c, t, g, unknown or other
  misc_feature (523)..(523): n is a, c, g, or t
  modified_base (565)..(565): a, c, t, g, unknown or other
  misc_feature (565)..(565): n is a, c, g, or t
tcagtagtgtagatcacgaccggtgctcgatttagtgtagtgtgaagggggagagaggagcccagccctgggtattttcaggtgttttcatttggtgatcaggactgaacagagagaactcaccatggagcgttgggctgagcgtgtcttttctgtgcttatttaaaggtntcagtgtgaggtgngtgtggagtcgnggggagnttggtacggcggtggggtcctgagtactctctgtgcagtcctgtaggtaatacttacgttagactaaactacgccaaggtatacgtcggtcggtaccgaccgacggtccgacggacgggggtacgggtcgttagggnggttcggtcgacgtacgtcccgttacgtttacccggagtaagttggggttacggccgtacgtaccgacgtaacccgtacgacgttaacggcctaacccgggttacgggaaccgggtcccgttacccgtaccgtacgttccgaaacgacgtaacgaaccgttccgaaacgtacctaaccgttntaactgttactaacgaaacttaacgacgaacgtcgtaaccgnggtaacgcgaacccggtaacggacgacccggaatagttaacttattcgttaagtaaccgaacgtaaccggacccgaacgttacgacctacggtagttccgacgtttaccgttgtacggttacgggaacggtaaccggtaacggacccggtacgttacc

SEQ ID NO: 180626 - DNA, 788 bp, Homo sapiens
  misc_feature: GYAE6OF01ADKBX.37.20.B09.1.454.CMB.1.raw
  modified_base (591)..(591): a, c, t, g, unknown or other
  misc_feature (591)..(591): n is a, c, g, or t
  modified_base (754)..(754): a, c, t, g, unknown or other
  misc_feature (754)..(754): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggtctttttcgttggtcggtacttaatttttaaaagggtgtaccaggttggtggtaggtgggtaggttggttgggagtcggtgggggaggtcgttacgggtaccggtccgggttcggggggtccctggacgtaccgtcctccgtgtcgcacgtccttgtaggaacttaattacgttaacgactaaaacgtccgaccattacggtacgtcgttaccggggcctaccggaccggtccgtaccggtacgggggaacggggtcggtagggaggttccggtacctcgaccgtccgttaccgttccggaagtacggttcggggttcggtcggacgtccgaccgtaacgtccgacgtaacgtaccggtccggtacggggtaaccggtcccgtacccgtacgtccgtacgaagacgtaactacgtaccgacggtaacctacgtctaactcgtaacncgtaacaagtaccgaacacgtcgacggaccgaccggaccgaaccgaacgtacggaccttaagtttaccttaggttacgtggtaaaccgacccgaaaacggttcccaggtaaccaccgtaacggttgtaccggtcgttacgtttaaccgtcgttaacccggggngggaaaccgacccggttaagtcccgggttaaccg

SEQ ID NO: 180627 - DNA, 514 bp, Homo sapiens
  misc_feature: GYAE6OF01AGEUK.37.20.B09.1.454.CMB.1.raw
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (485)..(514): a, c, t, g, unknown or other
  misc_feature (485)..(514): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggcatatattattgtgacgaaacgaccccaaggtnaccanattggagtctttttgacctttcgtggggaccaaagggacaaccggtccaccgtctcttcacgcctaccaccgaaggccccatccggtccctttcccccgnggcccgccctgccgtaccgaggacncccnccgtaccgagacgccacgacggcccgtcccgtgggctacggccgtggtaccgaacggtaccttaccttccacttcctacgtaccgttacgtcgacggccgggcgtcggcgaacggcgtacacgtgnnnnnnnnnnnnnnnnnnnnnnnnnnnnnn

SEQ ID NO: 180628 - DNA, 821 bp, Homo sapiens
  misc_feature: GYAE6OF01BQVYZ.37.20.B09.1.454.CMB.1.raw
tcagtagtgtagatcacgaccggtgctcgatttagtgtagtgtgaagggggagagaggagcccagccctgggattttcaggttgttttctatttggtgatcaggactgaacagagagaactcacagtggagcgttgggctgagctggtctttttgtgtggtacttaagttttaaaaggtcgtacctagtggtggtagggtgggtaggttgggtttagggacggttcggtagggggggacggtcggtttacggggtaaccggggtcccgggttcggggggtcccttggaacgtaccttccgtccgtgtcggaccaacggtcccgttcggttaggtaaattaacttacgtttaacgaactaaaacttacccggacctaagtacgtacgttcccggttacggggtcccgtacggtaacggtccgtaccgggaacgggggaagggtccggttaggtacggtcgggtactacgacgtccgtacgttccggactaaggtgggtggtacgcgacgacacgtacgcgaacgtaccgtacggtaggaacggtcccggtacaccgtctaccgagtacgaactaacgtccgaaagaactaccgtacttaatacgtacgtacgaaacgtaagtaacgaacgtacgacgtaggaacggaaccgaccgaacgtacccgaacgtacccgtaaattacttaactttagtacggtacgaaaccggtaaacccgaacccgttaccgaaccgtaaccgtaacgtacggttacggtacgttacgttttacgaccgtttcgggaacgggtaccgtaaacggacccggttaacggtaacccgg

SEQ ID NO: 180629 - DNA, 810 bp, Homo sapiens
  misc_feature: GYAE6OF01B1VVE.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggcttaattttaaaaggtgtccagtgtgaggtggaggtgtggagtcgtgggggagtcttggtacggccgtcgggggtccctgagtactctccgtgtcgcacgtcctcgtaggtaaattaattacttttaagactaaaataccgacctagtagacttcgtcggggtcccgccgacggcctaccggaaggggtaacggggcgtagggtaggttcggggtacctacggtaacggtttagttacgtagggttaggtacggttaaacgtacccggactaactaaccgttaaccgacgtaacgtacccgttcccggtagggtaccccggggtcccgtttaaccgtaaccccgttacctaacccgaaacggtaaaaaccttaacctaaccgtaaaggtaaacgttacccggttacttacttaacggaaagggtaaacgtacgaaacgacgtacccgtaggaacgggtaacgacccgggtaacggacctaaccccgggttcccttacttaagttaacgtcggtagaaccggtaaggacgaacttacggaacggacgggtaaagttacgtaaacggataccggcgtaagtccgttcgaaccgttaacggtaccgtaccgggggaccctaaccccgggtaacccgtcggtaaccccgttacccg

SEQ ID NO: 180630 - DNA, 613 bp, Homo sapiens
  misc_feature: GYAE6OF01DOJ0S.37.20.B09.1.454.CMB.1.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggcttattttaaaaggtgtccagtgtgaggtggaggtgttggagtcgtgggggaggcttgggtacggccgtggggggtccctgagactctcctgtgcagcctctggaataatcttagacaatacgccatnatctggtccncaggctcgaggggagggctggagtggtctcagtctatttccggnaagtgggtggtgcacgctacacgcagactcggtagaacgggtccgtacaccgtcaccgagacactaacgttaccgacggtaacactactactatctacgactaaatacgaacacgaccgtaggacgacgacccggaacgaaccgacggacaattataattattacggtacaaccggaaaaccgaccccgaacggtacgaccgtaacgtagttacggtacgttacgttttgtaccgttcggtacgggacgaaacgggtccgtaaccggtacccg

SEQ ID NO: 180631 - DNA, 581 bp, Homo sapiens
  misc_feature: GYAE6OF01A1800.37.20.B09.1.454.CMB.1.raw
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(543): a, c, t, g, unknown or other
  misc_feature (543)..(543): n is a, c, g, or t
  modified_base (545)..(547): a, c, t, g, unknown or other
  misc_feature (545)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(557): a, c, t, g, unknown or other
  misc_feature (555)..(557): n is a, c, g, or t
  modified_base (559)..(561): a, c, t, g, unknown or other
  misc_feature (559)..(561): n is a, c, g, or t
  modified_base (563)..(563): a, c, t, g, unknown or other
  misc_feature (563)..(563): n is a, c, g, or t
  modified_base (565)..(566): a, c, t, g, unknown or other
  misc_feature (565)..(566): n is a, c, g, or t
  modified_base (568)..(581): a, c, t, g, unknown or other
  misc_feature (568)..(581): n is a, c, g, or t
tcagtagtgtagatcacgaccggtgctcgatttagtgtagtgtgaaggggctggagtgggtttcagccatttccggcaatggtggtggcacgcactacgcagactccgtgaagggccggttcaccgtctccagagacaattccaggaacactctatatctgcaaatgaacagcctgagagtcgaggacacggccttatattactgtgtagaacgggacctctacgtccccttatagcagcggctggtcctggtactttgacgacgtggggccagggaaccctggtccaccgtcctcctcgacgccctaccaccgaacgggccccagtccggtccttcccccgtggcccgccctgcctccgagggacgccacccgtccgacgacgaccacgacggccggcccgtgggcctcggcccgtcgggtaccgaaacgggtaccttaccttaccgtacttacccttaaccaccgttaccgagggaacgggcccgggggtcctacggggaaccgtaaaccggggccgaaccgtaagtacggcncgngnncncnnncncncncnnncnnncngnngnnnnnnnnnnnnnn

SEQ ID NO: 180632 - DNA, 926 bp, Homo sapiens
  misc_feature: GYAE6OF01BCOUF.37.20.B09.1.454.CMB.1.raw
  modified_base (636)..(636): a, c, t, g, unknown or other
  misc_feature (636)..(636): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggcttattttaaaaggtgtcagtgtgaggtggaggtgttggagtcgtgggggagcgttggtacggccgtgggggtccctgagtacctctcctgtcgcacgtcctcgtaggtaaattaacttctttaagactaaaacgtaccgacctataggtacttccggttcggggtcccggaccgaacgggtcccgttaaccggaacggggggaacgggggtcggtaggggtaacgggttcggggttacctaccgacggtacccgttaaccggttttcccgggaaccgttaaagggttcggggtacgggttcgggacccgtaaccggaccgtaaccgtaaccgaccgtaacggtacccgttcccgggtaacgggtaacccggggttccccgggtttacccgtaccccggttacccgtacccggtaaacggtaaccggttaaaccctaaaccggtttacccgggaaaacgggttaacctaacccgtttnttaaaacttccgtttacgaacgtaaacccgtaaagtacgtaaaacccgtccggtaccgtaacggaacggacccggtaacccgggaacggaaccggtaacccgggtaaccttaagtttaaacggttttatttaacggttacgggaaccgtaaacccgggtaaacccgaaccccggttaacgggtaacccgtaaccccaagtttacgggttagggttaccctttcggttttaaacggacccgtttacgggggacgggaacccgggtaaaggtcccgtaaacccggttacccg

SEQ ID NO: 180633 - DNA, 638 bp, Homo sapiens
  misc_feature: GYAE6OF01AURCH.37.20.B09.1.454.CMB.1.raw
  modified_base (268)..(268): a, c, t, g, unknown or other
  misc_feature (268)..(268): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (611)..(611): a, c, t, g, unknown or other
  misc_feature (611)..(611): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
tcagtagtgtagatcacgaccggtgctcgatttagtgtagtgtgaaggggctggagtgggtctcagccatttccgggaatggtggtggcacgcactacgcagactccgtgaagggccggttcaccgtctccagagacaattccaggaacactctatatctgcaaatgaacagcctgagagccgacgacaacggccatactattaactgtgtgaagggacctctagccccttatacgcagcggctggtcctggtacctttgacgtacgnggggtccaagggtaaccctggtccgtaccgtctcctacgaggcccctccaccgaacggggtccccaacgttccggttcccgtttacccccgtcgggaccgtccccttcgacccttcccggaaggaccgtacctacccgtaccggtacgacgccgaaccgacgtccggccccggttcgggcttcggcccgttacgggtacgtaaacggacttaacccttcccggtacttaccgtacctaccgtaacttacgggagggcccgggtaccacggaaccgtaacgggtcccgaacgaagtagccngtacngccgnacgacncganactcagtcncnctcgtctcgcgngcgatcgcncgncnctacgcnctgngc

SEQ ID NO: 180634 - DNA, 853 bp, Homo sapiens
  misc_feature: GYAE6OF01C859I.37.20.B09.1.454.CMB.1.raw
  modified_base (168)..(168): a, c, t, g, unknown or other
  misc_feature (168)..(168): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagtttgggctgagcgtgtcttttctgtgctaatttaaaggngtcagtgtgaggtgcagctgctggagtcgtggggagtcttggtacgcgggtccggggggtccctggacgtaccgtcttccgtaggtacggaacgtccttcgtgggtactttcctaccgtttttaggaactaaaggttggttcggaccctaagttccggtaaacccgtttccgggggtaaccccgtcccggtaacgggcccgtacccgggaaaggggggggtaaaaccgggggtcgttagggggtaacggggttccgggggtttcccttacggtttaaaggttttaacggttttaaaggggtttggggtttaagggtttacggggtaaaggtttacggacgtaaaccggtaggttaacgtttaaccggaccgtaacggttaacccggtttacccggtttaggggaaacccggggttcccggtttaccaacccgtacttaccgtaccgaagtaacgtaaccttaacgttaccccaaagacggtacctaacggttctgggtttaaactttcggactaactaagttacgaaacctgccgtaggaacggcgaacgaggtaaccgcggtactagttacttaatttgttaggaccgtaacgttaacgtttttccttaggacgttttacgtttaacttacgtccccgttagtcgaaccgttacggtccggggaacccagggtaaccccttcgg

SEQ ID NO: 180635 - DNA, 739 bp, Homo sapiens
  misc_feature: GYAE6OF01BG4QU.37.20.B09.1.454.CMB.1.raw
  modified_base (149)..(149): a, c, t, g, unknown or other
  misc_feature (149)..(149): n is a, c, g, or t
  modified_base (167)..(167): a, c, t, g, unknown or other
  misc_feature (167)..(167): n is a, c, g, or t
  modified_base (279)..(279): a, c, t, g, unknown or other
  misc_feature (279)..(279): n is a, c, g, or t
tcagtagtgtagatcacgaccggtgctcgatttagtgtagtgtgaagggggagagaggagcccagccctgggattttcaggtgttttcatttggtgatcaggactgaacagagagaactcacatggagcttgggctgagctgtcttttntgtgctatttaaaaggtntacagtgtgaggtggaggtgttggagtcgtgggggagtcttgggtacggcgtgggggtcctgagactctcctgtgcgagcctacgtggaaataattctttagacaaagtacncctatgatcgtggccgctaggctcggaagggaagggctaggtagtcgggtctgacgtaccgtagtttccggaactaagtcggttcggtagaccgaacggactaacgtaccgacgtaacgtacccggtaccggtaacgggaacgggtttaccccggtactaacccggtcttaacccgaaaggaacgtaaaccgtaacgttaccgaaacggtaacctaaccgttactaacgtaacgtactaacgtaaactaagttaaacggaactaaccggtaccgtacgggaacgtaacggaaccccgaaacggtaacccgtaacggaacccgttaattaaaccttagtttaacgtagtacgaaacggtaaaccgaaccccgaaacggtacgaaccgtaacttagtcggtaacgttccgttacgttacggttacgtacggggaacctaacggtaccggtaaaccgttaacc

SEQ ID NO: 180636 - DNA, 662 bp, Homo sapiens
  misc_feature: GYAE6OF01CE4WC.37.20.B09.1.454.CMB.1.raw
  modified_base (622)..(624): a, c, t, g, unknown or other
  misc_feature (622)..(624): n is a, c, g, or t
  modified_base (630)..(630): a, c, t, g, unknown or other
  misc_feature (630)..(630): n is a, c, g, or t
  modified_base (632)..(633): a, c, t, g, unknown or other
  misc_feature (632)..(633): n is a, c, g, or t
  modified_base (635)..(657): a, c, t, g, unknown or other
  misc_feature (635)..(657): n is a, c, g, or t
  modified_base (659)..(662): a, c, t, g, unknown or other
  misc_feature (659)..(662): n is a, c, g, or t
tcagtagtgtagatcacgaccggtgctcgatttagtgtagtgtgaaggggctggagtgggtctcagcctaattttccggcaatggtggtggcacgcactacgcagactccgtggaagggccggttcaccgtctcccgagacaattccaaggaacactctatatctgacaaatgaacagcctgagagccgacgacacggcatattattagtgtgaccgaaacgaccccgaaggtacaccaactagttggagttcttttgtacgtttcgacgggggaccaaaggggacctaacgggtccaacccgttcttaccttcgacggtcccctaccgtaacccgaacgggtacccctacgttccggttacccctttccccccgtacggcccgtccccgtaccgtcccgaccccggtacgggactacccggtacccccgttacggaacgaccggacccaccgtaccggccggtccccggtagggtcccgtccggtaccgtcgggtaaccgaacgggttaacccttaacccgttacccaagttacccgttaaaacctaccggtttacgtaccgggtacggccggggtaaccgttgggaaaccgaacggggtacacgtaaggtagcgactagnnncacgantnnannnnnnnnnnnnnnnnnnnnnnnannnn

SEQ ID NO: 180637 - DNA, 768 bp, Homo sapiens
  misc_feature: GYAE6OF01A0ZFE.37.20.B09.1.454.CMB.1.raw
  modified_base (401)..(401): a, c, t, g, unknown or other
  misc_feature (401)..(401): n is a, c, g, or t
  modified_base (484)..(484): a, c, t, g, unknown or other
  misc_feature (484)..(484): n is a, c, g, or t
  modified_base (546)..(546): a, c, t, g, unknown or other
  misc_feature (546)..(546): n is a, c, g, or t
  modified_base (680)..(680): a, c, t, g, unknown or other
  misc_feature (680)..(680): n is a, c, g, or t
  modified_base (728)..(728): a, c, t, g, unknown or other
  misc_feature (728)..(728): n is a, c, g, or t
tcagtagtgtagatcacgaccggtgctcgatttagtgtagtgtgaagggggagagaggagcccagcccgtgggtattttcgaggttgttttcatttggtgatcaggactgaacagagagaactcaccagtggacgcgttgggctgagtcgtggttctttttgtggtggtactttaaagtttttaaaaggtcgtccgtaggttggtaggtagggttggagggtttggttgggaggttcgggtggggggtacggttccggtttacggggtccgggtccgggttcgggggggttccctaggaacgtcccgtttccttccgttggtacgaccgacgtcccttgtaaggtaaatttaacttacgttaagactaaactaccgactagtcgacgttccggcgggcccncgaggtccgtacgggaaggggagggccgtgggtacggtcgggtactagggtgtttacggttacgtagggttaaggtacggtanacccgtataacgtcgtacgacctacgtacggtccggagggtacccggtccgtccacccgtanacccgaggaactactaacgtaaccgaagtacgttacggtctagtacgtaagtaacaacgtacaacggtcagggaacgaccgaccgggaacgtccccgagttaccccttagtaacgtgtcggacgtacgaggtanacggtaagaggttacgaaagttcgacgagaccgttgacgtaccgttanacgttcggaacggtccggtaacgaccgtcgtccgtacccg

SEQ ID NO: 180638 - DNA, 765 bp, Homo sapiens
  misc_feature: GYAE6OF01CGZJV.37.20.B09.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (561)..(561): a, c, t, g, unknown or other
  misc_feature (561)..(561): n is a, c, g, or t
  modified_base (692)..(692): a, c, t, g, unknown or other
  misc_feature (692)..(692): n is a, c, g, or t
tcagtagtgtagatcacgaccggtgctcgatttagtgtagtgtgaagggggagagaggagcccagcccctgggtattttcaggttgttttctatttggtgatcaggactagaacagagagaactcaccatggagcgttgggctgagcgtggtctttttcgtgtggtacttaagtttaaaggtntacagtgtggaggtggnggtgttggagtcgtgggggtagcgttgggtacggccggtcggggggtcctgagcctccgtcgtcgtagcgtcgtccttcgttcggtttactatttaccttagaccgaacttaccgcctagtgcgtccgtcgggtccgcgacgtccgaccggaagggagggctgggagtgggtcacggtagttacttagtaggttacggtagtaacgtaccgatataaccgtcgacaacgtacccgtacgggttccggaccgggggttaccctacccgtaccggttacaccccgtaggtaaaccaaagttaacccttaccgaaagtaagttaccgggttaacttaactagtaaacggtaaatacggaaaacnccgtacgtaggaccgaacggacccggtaacggaccgacccggtacccttacgttaacgtagttcggtaacgacgtaaagtacggaactaacggtaacggtaaaccgggtagtaaaccgtaaggacgaccgngtaaccctgttaaccgttacgaccggttaccggacgggtacccccggtaaaacggcccgttaccgggtacccg

SEQ ID NO: 180639 - DNA, 715 bp, Homo sapiens
  misc_feature: GYAE6OF01B34VS.37.20.B09.1.454.CMB.1.raw
  modified_base (269)..(269): a, c, t, g, unknown or other
  misc_feature (269)..(269): n is a, c, g, or t
  modified_base (529)..(529): a, c, t, g, unknown or other
  misc_feature (529)..(529): n is a, c, g, or t
tcagtagtgtagatcacgaccggtgctcgatttagtgtagtgtgaagggggagagaggagcccagccctgggatttttcaggttgtttttcatttggtgatcaggactgaacagagagaactcacatggagtcttgggctgagcgtggtcgttttctagtggacttaattttaaaaggtgtccagtgtgaggtggaggtgtggagtcgtggggagcgttggacggcgtgggggtcctgagctctcgtgtgcagccttgagtaaatattnttagactaaactacgcctagtgtactcgtgggtaccgcgacggtcgtaccggaggggaacgggcgtgggagttcgggtactcgtacgccgttagtttaccgacgttaagtgggtcggttcggacgaccgacttaaccgacgacgacgtaccgtacggttacgggaaacggggttcccgttaccacccgggtttctacccggaagttaacgacctaacggttaccgaaacgggaacctacctaattactaaagtcgttaanaccgtaaaatacggaacacgtacgagaacggcggaccgaacgtacgaaccgctaagttatagtttagtacggtacgaaaccggtataaccccggacgttacgaacccgttacgtaagttacggacgtttacctaggttaacccttcgggacgggtaacccgaaacggtaaccgtaacgttccccgg

SEQ ID NO: 180640 - DNA, 418 bp, Homo sapiens
  misc_feature: GYAE6OF02G4KJ4.37.20.B09.1.454.CMB.1.raw
  modified_base (414)..(418): a, c, t, g, unknown or other
  misc_feature (414)..(418): n is a, c, g, or t
tcagtagtgtagatcacgaccggtgctcgatttagtgtagtgtgaagggctggagtgggtctcagccatttccggcaatggtggtggcacgcactacgcagactccgtgaagggccggttcaccgtctccagagacaattccaggaacactctatatctgcaaatgaacagcctgagagccgacggcacggccatatattattgtgcgaaagaccccaacggtgaccacattggagcttttgacttctggggccaaggggacaacggtcaccgtctcttcagcctccaccaagggcccatcggtctcccctggcgccctgctccaggagcacctccgagagcacagcggccctgggctgcctggtcaaggctacttccatctacactactgagcgggctggcaaggcgcatagnnnnn

SEQ ID NO: 180641 - DNA, 536 bp, Homo sapiens
  misc_feature: GYAE6OF02GD214.37.20.B09.1.454.CMB.1.raw
  modified_base (295)..(295): a, c, t, g, unknown or other
  misc_feature (295)..(295): n is a, c, g, or t
  modified_base (435)..(435): a, c, t, g, unknown or other
  misc_feature (435)..(435): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggcgttttcttagtggctattttaaaaggtgtccagtgtgaggtggaggtgttggagtctgggggaggcttggtacggcctggggggtccctgagactctcctgtgcagcctctggaataatctttagcaactacgccatgagctgggtccnccaggctccaggggaaggggctggagtgggtctcaggtattactggtagtggtaataccgcatactacgcagactccgtgacgggccgttcaccgtctccagagacaattccaagaatacggtctatctggaaatgaacngcctgagagccgaggacacggccctctattactgtgcgagagatcgagacgagtatagcagcagctactgactacgtcggggaccacggaccctggtaccc

SEQ ID NO: 180642 - DNA, 597 bp, Homo sapiens
  misc_feature: GYAE6OF02ISHSF.37.20.B09.1.454.CMB.1.raw
  modified_base (517)..(517): a, c, t, g, unknown or other
  misc_feature (517)..(517): n is a, c, g, or t
  modified_base (537)..(537): a, c, t, g, unknown or other
  misc_feature (537)..(537): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcggtgtgtttctaggtggctaatttaaaggtgtcagtgtgaggtggaggtgttggagtcgtgggggaggcttggtacggccgtgggggtcctgagctctcctgtgcagcctctggaataatctttacactaaatacgccatgatctgggtccgccaggctccgaggggaacggggctggtaggtggggtccttcgaaggcccgtaatttccggacaatgggtggtggacacgcacgtacgcagacgtccgtaggaacgggtccgttcgaccgttctacccgagagtaaaacttcccgaaggaacactcctattactgttacgctaaaatcggaacagccctagagacgccacgacacggaccataatattacttgtnaccgaaaagcccaacgggtnacccagtacttggaatcttttagacctttgcggggtaccaagggtacacggtctaaccgg

SEQ ID NO: 180643 - DNA, 554 bp, Homo sapiens
  misc_feature: GYAE6OF02GZEDF.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaggtgtccagtgtgaggtggaggtgttggagtctgggggaggcttggtacggcctggggggtccctgagactctcctgtgcagcctctggaataatctttagcaaatacgccatgatctgggtccgccaggctccagggaaggggctggagtgggtctcgagccatttccggcaatggtggtggcacgcactacgcagactccgtgaacgggccgtcaccgtctccagacgacaattccaggaacactctatatctgacaaatgaacagcctgacgagccgacgacacgccatatattattgtgacgaaacgaccctaacggtacgaccaacattacgggagtccttttagactttcgtggggacccaaggggaccaacggtacccg

SEQ ID NO: 180644 - DNA, 421 bp, Homo sapiens
  misc_feature: GYAE6OF02GNZTU.37.20.B09.1.454.CMB.1.raw
  modified_base (416)..(421): a, c, t, g, unknown or other
  misc_feature (416)..(421): n is a, c, g, or t
tcagtagtgtagatcacgaccggtgctcgatttagtgtagtgtgaaggggctggagtgggtttcagccatttccggcaattgtggtggcacgcactacgcagactccgtgaagggccggttcaccgtctccagagacaattccaggaacactctatatctgcaaatgaacagcctgagagccgacgacacggccatatattattgtgcgaaagaccccaacggtgaccacattggagcttttgacttctggggccaagggacaacggtcaccgtctcttcagcctccaccaagggcccatcggtcttccccctggccgccctgcctccaggagcacctccgagagcacagcggccctgggctgcctggtcaaggctacttcctctacactactgagcggctggcaaggcgcatagnnnnnn

SEQ ID NO: 180645 - DNA, 437 bp, Homo sapiens
  misc_feature: GYAE6OF02GUKEL.37.20.B09.1.454.CMB.1.raw
  modified_base (428)..(437): a, c, t, g, unknown or other
  misc_feature (428)..(437): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaggaacactctatctgcaaatgaacagcctgagaactgaggacacggctgtgtatcactgtgcgaaccaagggggtttgagatgcagctggagggtgatggttttgatttatggggccaagggacaatggtcaccgtctcttcagcctccaccaagggcccatccggtcttccccctggccaccctcctccaagacgccacctctgggggcacgacgcggccctgggctgcctggtcaaggactacttccatctacactactgagcgggctggcaggcgcatagnnnnnnnnnn

SEQ ID NO: 180646 - DNA, 570 bp, Homo sapiens
  misc_feature: GYAE6OF02GHGO6.37.20.B09.1.454.CMB.1.raw
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (480)..(480): a, c, t, g, unknown or other
  misc_feature (480)..(480): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtgtcgttttctaggtggctaattttaaaaggtgtccagtgtgaggtggaggtgttggagtcgtgggggaggcgttggtacggcctggggggtccctgagactctcctgtgcagcctctggaataatctttagacaaatacgcatgatctgggtccgcaggctccgagggaaggggctggaggtgggtctcgagccatttcccggcaagtggtggtggcacgcactacgcagactccgtgaagggccgtcaccgtctcagagacaacttccagaacnctctatatctgacaaatgaacngcctagagacgaccgacgacacggccaatatattattcgngacgaaacgacccgaagtcggaaccacgaagttggacgtacgttttcgtaacgtttcggtcggggaccaacggggtacgacgggtacccg

SEQ ID NO: 180647 - DNA, 427 bp, Homo sapiens
  misc_feature: GYAE6OF02GT8DC.37.20.B09.1.454.CMB.1.raw
  modified_base (420)..(427): a, c, t, g, unknown or other
  misc_feature (420)..(427): n is a, c, g, or t
tcagtagtgtagatcacgaccggtgctcgatttagtgtagtgtgaaggggctggagtgggtctcagccatttccggcaatggtggtggcacgcattacgcagactccgtgaagggccggttcaccgtctccagagacaattccaggaacactctatatctgcaaatgaacagcctgagagccgacgacacggccatatattattgtgcgaaagaccccaacggtgaccacattggagcttttgacttctggggccaagggacaacggtcaccgtctcttcagcctccaccaagggcccatcggtcttccccctggcgcccctgcctccaggagcacctccgagagcacagcggccctggggctgcctggtcaaggactacttccatctacactactgagcgggctggcaaggcgcatagnnnnnnnn

SEQ ID NO: 180648 - DNA, 497 bp, Homo sapiens
  misc_feature: GYAE6OF02IFK27.37.20.B09.1.454.CMB.1.raw
  modified_base (145)..(145): a, c, t, g, unknown or other
  misc_feature (145)..(145): n is a, c, g, or t
  modified_base (147)..(147): a, c, t, g, unknown or other
  misc_feature (147)..(147): n is a, c, g, or t
  modified_base (169)..(169): a, c, t, g, unknown or other
  misc_feature (169)..(169): n is a, c, g, or t
  modified_base (174)..(175): a, c, t, g, unknown or other
  misc_feature (174)..(175): n is a, c, g, or t
  modified_base (183)..(183): a, c, t, g, unknown or other
  misc_feature (183)..(183): n is a, c, g, or t
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagtagtgtagatcacgaccggtgctcgatttagtgtagtgtgaagggggagagaggagcccagccctgggatttttcaggtgttttcatttggtgatcaggactgaacagagagaactcaccatggagcttgggctgagcggngngttctaggtcgcatttaaaggntcatnnagtgagtntgagtntgggagntgtcgctgggggtcctgagctctcngtgcanctctgataatnttatacaatacnccatgtatctggtcgccagctcaggaagggctggagtggtntcncgcnttcgcaatgtgtggnacgcanacncancacgagacggcgtcacgtcncagagacactacacgactactactatatactganaanacgaacacacacgagacgacgacgacacgacatatattattatagacgaacgaaccgacgacgacgactagtacgtacgtacttacgtcgtacgtacggacgacggacgacgtac

SEQ ID NO: 180649 - DNA, 547 bp, Homo sapiens
  misc_feature: GYAE6OF02FICIZ.37.20.B09.1.454.CMB.1.raw
  modified_base (293)..(293): a, c, t, g, unknown or other
  misc_feature (293)..(293): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaggtgtccagtgtgaggtggaggtgttggagtctgggggaggcttggtacggcctggggggtccctgagactctcctgtgcagcctctggaataatctttagcaaatacgccatgatctgggtccncaggctccagggaaggggctggagtgggtctcagccatttccggcaagtggtggtggcacgcactacgcagactccgtagaacgggccgttcaccgtctccagacgacaattccaaggaaccactctatatctgcaaatgaacagcctgagagccgacgacacggcatatattatgtgacgaaagcccaggtcaccaacattaggacgtcttttagacctttcgtaggggacctaaggggaccaacggtacccg

SEQ ID NO: 180650 - DNA, 568 bp, Homo sapiens
  misc_feature: GYAE6OF02FFJ6I.37.20.B09.1.454.CMB.1.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
  modified_base (451)..(451): a, c, t, g, unknown or other
  misc_feature (451)..(451): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaggtgtccagtgtgaggtggaggtgttggagtctgggggagcttggtacggcctggggggtccctgagactctcctgtgcagcctntggattcaccttcagcagctatgccatcgacctgggtcccnccgagcctaccgagggtaaggactggagtgggtctcgtctattaggtggaagttggtncttaanacaaactcgcacgcctcggtagaacgggccncttccacctntctacccagacgtactacttccaagngcactctgtactcgtgacaatcgaacngcctgagtcgacgagacacggtccctagtacttatcgagtacgtagtgggtggggtaggtcggggaccttacgttcgtggtccgttttagaccgtaggtcggggccgtagggtaccg

SEQ ID NO: 180651 - DNA, 406 bp, Homo sapiens
  misc_feature: GYAE6OF02GGANG.37.20.B09.1.454.CMB.1.raw
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (396)..(396): a, c, t, g, unknown or other
  misc_feature (396)..(396): n is a, c, g, or t
  modified_base (402)..(406): a, c, t, g, unknown or other
  misc_feature (402)..(406): n is a, c, g, or t
tcagtagtgtagatcacgaccggtgctcgatttagtgtagtgtgaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaagaccccaacggtgaccacattggagcttttgacttctggggccaagggacaacggtcaccgtctcttcagcctcaccaggccatcggtctccccngcncctgctcaggncacctcgagagcacagcgccctgggctgctggcaaggactactcatctacactactgacgcgggctggcaaggcncatagnnnnn

SEQ ID NO: 180652 - DNA, 761 bp, Homo sapiens
  misc_feature: GYAE6OF02GFCPF.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggtcgttttctaggtggctaattttaaaaggtgtccagtgtgaggtggaggtgttggagtctgggggagcttgggtacggccgtggggggtccctgagactctccgtgtgcagcctctggaataatcttagcaaatcgcatgatctggtccgccaggcctcgagggaagggctgggagtgggtctcgagcctagtttccggactaagtgggtggtcggcgacggccaacgtaccgacacgtacctcccgggtaggaaacggggtcccggtttacacccggttccgttacccgaaggtaacgaacctaaacgtttacccgaaagggaaacctaccgttacttaaagttacctaccgttacggaacctaaaaagttcgggaaaaccacgggtacccgttaggaaacgtacggaaccccgggaacgaacccgaaccgggaccctaaagtttaactttaacgtttaagtttcggtacggtaaacccgtaaaaaccgaaccccccgtaaacggggttcgaaccccgtaaacgtacggtttaacggacggtttaccgttttttacgacccggtttcgggtaccgggggaaccctaaagggggtaccctaaccgggtttaccccg

SEQ ID NO: 180653 - DNA, 722 bp, Homo sapiens
  misc_feature: GYAE6OF02IJ5P3.37.20.B09.1.454.CMB.1.raw
  modified_base (415)..(415): a, c, t, g, unknown or other
  misc_feature (415)..(415): n is a, c, g, or t
tcagtagtgtagatcacgaccggtgctcgatttagtgtagtgtgaaggggagaggaggagcccagccctgggattttcaggtgttttcatttggtgatcaggactgaacagagagaactcaccatggagcttgggctgagctggctttttcttgtggctattttaaaaggtgtccagtgtgtaggtggaggtgttggagtctgggggagtcgttggtacggtcctggggggttccctggacgctcgttcctggtcgcagcctctggataatcttgcaaatacgcatgtatcgtaggtccgccaggcctaccaggggtaaggggctgggatcgggtctcaggcctagtttccgcgtaatggtacggtgcgacgctacgtacgcacgaccgtcgtagacgggtccgtcgaccgttcnccgtagagtactaacgttccaaggaacgtacctcgttagtaactcgttacggaacctaaaaggttcgaaaacgtagtacccgttagggaaacgcgtacccggggaaaccaaccgtaccggtacgtaaacgtttattaactttagttcggttaccgaaccgggttaaaaccacccccgggttaacgggtcggaaaccccctaacgtaccggtttttagggaacgttttaccggtttttacggtaaaccggttttccgtaccggggggtaccccgttaaaagggtaccccggaaacccggttaacccgg

SEQ ID NO: 180654 - DNA, 741 bp, Homo sapiens
  misc_feature: GYAE6OF02H8KD2.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaaggtgtccagtgtgaggtggaggtgttggagtcgtgggggaggcttggtacggccgtgggggtccctgagactctcctgtgcacgcctctggaataatcttaagcaaaatacgccatgactcgtcggtccgccaggctccgagggaaggggctgggaggtgggtctcgacgcctagtttccggactaagtcgggtggtggccacgcaacctacgacgacgacctccggtaggaacggggtcccgttacacccggtcctaccgagtaacgaactaacttacccgaaagggaaacctactactaattactccttacgaactaaaagtacgaaacgacgtcccgtaagacggaacgaccccggaaccgaacccgaaccgggtaccctaagttaaacttaagttttaacgtttagggttaaccggaaacccggtaaaaaccgaaccccccgtaacgggttaacccggaaaccctaaaccgttagggtttacgggaacgtttaccgttttttaacggacccttttaccggggtaccggggacccggtaaacgggggtaaccctaaccgggttaccccg

SEQ ID NO: 180655 - DNA, 571 bp, Homo sapiens
  misc_feature: GYAE6OF02GNN2F.37.20.B09.1.454.CMB.1.raw
  modified_base (392)..(392): a, c, t, g, unknown or other
  misc_feature (392)..(392): n is a, c, g, or t
  modified_base (443)..(443): a, c, t, g, unknown or other
  misc_feature (443)..(443): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaggtgtccagtgtgaggtggaggtgttggagtctgggggaggcttggtacggcctggggggtccctgagactctcctgtgcagcctctggaataatctttagcaaatacgccatgatctgggtccgccaggctccgagggaagggggctgggagtggggtctcgagcctagtttccggctaagtgggtggtggcacgcactacgcagactcgtagaaggccgttnaccgtctaccagacacattccagaacactcatatctagacaaagtgaaacngcctgagacgaccgacgacgacggcataatattattgtacgacgaaacgaccccgaggtcaaccgactaagttacggagttcttttagactttccggtacgggaccgtaagggaccgtaacggtaccg

SEQ ID NO: 180656 - DNA, 569 bp, Homo sapiens
  misc_feature: GYAE6OF02IQ8XQ.37.20.B09.1.454.CMB.1.raw
  modified_base (386)..(386): a, c, t, g, unknown or other
  misc_feature (386)..(386): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaaggtgtccagtgtgaggtggaggtgttggagtctgggggaggcttgggtacggccgtggggggtccctgagactctcctgtgcagcctctggaataatctttagacaaatacgccaatgatctgggtcccgcaggcctccgaggggaaggggctgggaggtgggtctcagccatttcccggcaagttgggtggtggcacgcactacgcacgactccgngaacgggtccgtcaccgtctcagacacaacttccaagaacactctaatatctgacaaatgaaacagccgtagagacgccgacgacacggccatataattnttgngaacgaacgaccccaaggtcaaccactaagttcggattcttttagacttcggtcggggaccaagggaccaacggtcccg

SEQ ID NO: 180657 - DNA, 625 bp, Homo sapiens
  misc_feature: GYAE6OF02GD76C.37.20.B09.1.454.CMB.1.raw
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggtcttttctggtggctattttaaaaggtgtccagtgtgaggtggaggtgttggagtcgtgggggaggcttggtacggccgtggggggtccctgagactctcctgtgcagcctctggtattaattgtttagctaactctggcatgaactgggtaccgccaggcctccgagcagtgggctgcgagtgggtcncaagtactagtcgctcgtgtaatgancaagactacgcacgactcggtgaacgggccgttcaccatctaccgagagacaataccaagaacacgctactactctacgacaaagtacgaacacgtaccgagaacgacgggaaccgaacggaaccgaccggtacgttaactaacgttaccgttaggttggtaggaacggtgggttagggggtaacggttgggggggaaccttacggggtacgggaccgggtaaccgggtaacccggtcgggtcccgtacccggtccgttaccccg

SEQ ID NO: 180658 - DNA, 496 bp, Homo sapiens
  misc_feature: GYAE6OF02JRM4J.37.20.B09.1.454.CMB.1.raw
  modified_base (286)..(286): a, c, t, g, unknown or other
  misc_feature (286)..(286): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (466)..(496): a, c, t, g, unknown or other
  misc_feature (466)..(496): n is a, c, g, or t
tcagtagtgtagatcacgaccggtgctcgatttagtgtagtgtgaaggggctggaggtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaaacgaccccaaaggtgaaccacattggagcttttgacttcgtggggccaaggacaacggtcaccgtcctcttcncgcctccaccaagggcccatccggtccttccccccgtggccacccctccctacccaacgtacgccaccctcgtcgggggccacgacgccggcccgtcggctcgcctcggacgaacggactacttccactcctactacctactggcgcggcgtggcgtaaggcgacagtcgnagcnagtcnnnnnnnnnnnnnnnnnnnnnnnnnnnnnnn

SEQ ID NO: 180659 - DNA, 623 bp, Homo sapiens
  misc_feature: GYAE6OF02FMOEI.37.20.B09.1.454.CMB.1.raw
  modified_base (480)..(480): a, c, t, g, unknown or other
  misc_feature (480)..(480): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggtcttttcttgtggctattttaaaaggtgtcagtgtgaggtggaggtgttggagtcgtgggggaggcgttggtacggccgtgggggtcctgagactctctgtgcagcctctggaataattcgtttagacaaataccgcctatgagttcgtcgggtaccgccgacggcctaccgaggggaaggggcgtgggaggtgggtctcgacgccgtacgttccgataagtggtggtcgcgacgcactacgccgagtctcggtaggaacgggtcccgtaccgacccgttcctaccgagacgtaactaacgttaccgaacgtaacctacttactatactctaganaaactagaacagccagacgacgcgacgaccgacgactatattattattagtacaacgaaccgtacccgaaggtacaccgaagtacgttaggtcttacgttttgacgttccgggaggtacccggaagggacccgtaggtacccg

SEQ ID NO: 180660 - DNA, 666 bp, Homo sapiens
  misc_feature: GYAE6OF02HMRJL.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggcttattttaaaaggtgtccagtgtgaggtggaggtgttggagtcgtgggggagcttggtacggccgtgggggtccctgagactctcctgtgcagcctctaggaataattctttagacaaatacgcatgatcgtcggtccgcaggcctccgaggggaaggggcgtgggaggtgggtctcgacgtccacgtttccggactaagtgggtcggtggcacggcacgtacgcacgaccgtcggtacgaacgggtccgttaccacccgtcaccagacgactaactaccgaaggaactctactatactctagacctaaagtacgaaacgacgcgtaggacgaccgacccgaacgaaccgtaccggacctaagttaatttagttatttaggacgtaaacccgtaaaacggacccccgtaacggtccgtaacccgtactacggtttacggaacgtttccgttttagacccgttttcgggacgggttaacccgggaaagggtaccctaccgggtacccg

SEQ ID NO: 180661 - DNA, 613 bp, Homo sapiens
  misc_feature: GYAE6OF02I4AG1.37.20.B09.1.454.CMB.1.raw
  modified_base (554)..(554): a, c, t, g, unknown or other
  misc_feature (554)..(554): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaggtgtccagtgtgaggtggaggtgttggagtcgtgggggaggcgttggtacggcctggggggtccctgagactctcctgtgcagcctctggaataatctttagcaactacgccatgagcgtggtccgcaggctccgagggaaggggcgtggagtgggtctcgagctattaagtgggtaatggtagagtaccaacatactacgcacgtaccgtccggtagaacggggtccggttacacccacgtcctaccgacgggaactaacgttcccgaaaagaaccaccactgtcctactagaccaaattcgaaactagccgtagagacgtcggaaggacgaccggtaccttaatacttacgtgtcgtagaacgggtcctgtaccgtcccttanaacggctaggccggtctggttcccttaggttaccgttggacggtcgtcgggtaacccgg

SEQ ID NO: 180662 - DNA, 640 bp, Homo sapiens
  misc_feature: GYAE6OF02HH3J4.37.20.B09.1.454.CMB.1.raw
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtgcgttttctgtggctattttaaaaggtgtccagtgtgaggtggaggtgttggagtcgtgggggaggcttgggtacggcgtggggggtccctgagactctcctgtgcacgcctctggaataatctttagacaaatcgccatgatcgtcggtccgccgaaggcctccgaaggggaacggggctggaggtgggtctcgagccgtatttccggctaagtggtggtgcgacgcactacgcaagacgtccggtagaacgggtccgttcaccgtctaccgagagacattaccgaaggaaacncgtactatagttctacgacaaatgaaacncggtacctagaacgcgacccgaacgaccaccgggcctaaattagttaactttagtttaggacgtaaacgaaaccgtacccccggaaggttcgaacctaacgtagttacgggacgtttcgttttacgacgtttacggaccggggtaaccgtaacgggtaccgtaaccggtaccg

SEQ ID NO: 180663 - DNA, 585 bp, Homo sapiens
  misc_feature: GYAE6OF02GNRGG.37.20.B09.1.454.CMB.1.raw
  modified_base (441)..(441): a, c, t, g, unknown or other
  misc_feature (441)..(441): n is a, c, g, or t
tcagtagtgtagatcacgaccggtgctcgatttagtgtagtgtgaagggggagagaggagcccagccccgggattttcaggtgttttcatttggtgatcaggactgaacagagagaactcaccatggagcttgggctgagctggctttttcttgtggctattttaaaaggtgtccagtgtgaggtggaggtgttggagtctgggggaggcttggtacggcctggggggtccctgagactctcctgtgcagcctctggaataatctttagcaaatacgccatgatctgggtccgccaggctccgagggaaggggctggagtgggtctcagccatttccggcaatggtggtggcacgcactacgcagactccgtgaacgggcccgttcaccgtctccagagacattcaaggacactctatatctgacaaatgaacagcctganacgccgacgacaccggaccatatacttattgtacgacgaaaccgaaccccgaacggtacgaacccactagttacggacgttctttttacgaccgttttcggtacggggtccgaaacggggaccgtaaccgggtcctaaccccgg

SEQ ID NO: 180664 - DNA, 694 bp, Homo sapiens
  misc_feature: GYAE6OF02FVSUS.37.20.B09.1.454.CMB.1.raw
  modified_base (469)..(469): a, c, t, g, unknown or other
  misc_feature (469)..(469): n is a, c, g, or t
tcagtagtgtagatcacgaccggtgctcgatttagtgtagtgtgaagggggagagaggagcccagccctgggatttttcaggtgttttcatttggtgatcaggactgaacagagagaactcaccatggagcttgggctgagctggtctttttcttgtggctattttaaaaggtgtccagtgtgaggtggaggtgttggagtcgtgggggaggtcttggtacggccgtgggggtccctgagactctctgtgcagcctctggaatatcttagacaaatacgcatgatcgtggtccgcaggctcgaggggacgggctggagtgggtctcgacgcctagtttccggctaagttggtggtcgcacgcacgtacgcgagacgtccggtaggaacgggtccgtttccgacccgttccgtaccgaaggaacgtactaacgttacccgaacgggaacctacgttacttaatacgttcncgaaacctaaagtcgaaactcgtaccgtaggaacgaccgaccggaacccgtaccgaaccgggtacctaattaagttacgtttacgttgtaaacggaccggtaaaaccgacccccggtaaggacccgtaaccgaacttaggttacgggtaaccgtttcgtttttaacggtaccgtttccgggttaaccgggggaaccgtaacggggtaacccgaccgggtttcccg

SEQ ID NO: 180665 - DNA, 721 bp, Homo sapiens
  misc_feature: GYAE6OF02FH04K.37.20.B09.1.454.CMB.1.raw
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
  modified_base (402)..(402): a, c, t, g, unknown or other
  misc_feature (402)..(402): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttggctgagctggctttttctgtggctattttaaaggtgtaccagtgtgaggtgcagctgctggagtctgggggagcttggtacaggccggggggtccctgagacctctcctgtgagcctcgtggattcgacctttgactagtgtgccatgacctgggccnccagcctcgagggagggctggatgggtctnagttattaggtgtagtggtagtagcacgagtacgttacgcaagctaccggtaggaaacgggtcccggtttccaaacccgtnttacccgtacccgaaggaacgaacctaaacgtttaccccaaaccgtaacgaccgaaccggtacccgtttacgtttaacgttttaccgaccgttaaacctactttaacggaaacccctaagggtacccccgttaagggaaacgtaacgggcccggtaaagggaacccgtacccgggaccttaacgttaacttaagtttacgtttaggtacgtacccgtaaacgttttcccgtttttaacgacttttacgggtttaattacccgttaccccgttaggtacctacccgtacggtaccggggtaccaacggggtaacccccgg

SEQ ID NO: 180666 - DNA, 624 bp, Homo sapiens
  misc_feature: GYAE6OF02FRAZ5.37.20.B09.1.454.CMB.1.raw
  modified_base (205)..(205): a, c, t, g, unknown or other
  misc_feature (205)..(205): n is a, c, g, or t
  modified_base (510)..(510): a, c, t, g, unknown or other
  misc_feature (510)..(510): n is a, c, g, or t
  modified_base (550)..(550): a, c, t, g, unknown or other
  misc_feature (550)..(550): n is a, c, g, or t
tcagtagtgtagatcacgaccggtgctcgatttagtgtagtgtgaaggggcgtgggagtgggtttcagccatttccggcaatggtggtggcacgcactacgcagactccgtgaagggccggttcaccatctccagagacaattccaagaacaccctgtctctgcaaatgaacaacccgagagccgaggacacggcctatattacngtacgaaaatggcctacggatatcgactcgtattgggactaggtacttcgagtctcgtggggccgtggctaccctgggtacactgtcctcctacagcctacgaccaagggcccagtccggtcttcccccgtagggcccgaccctggacctccgaggactcaaccgttccggagagcgacacgcggccctagggcctagcccgttagggtaccaaaggacgttaaccgttcaattacccgtaactaccgtaacctgaacgcgggacgttggactaacggcgacgtaactaaggctagtacacgtantaccgtgacgaatcgacgtaataacgcctaaagccgttanagtagactaaccggtcgtacgtaggacgtacgtacgtacgtaaccgtcgttaccgacgtccggtacgtagtacg

SEQ ID NO: 180667 - DNA, 729 bp, Homo sapiens
  misc_feature: GYAE6OF02G1KUB.37.20.B09.1.454.CMB.1.raw
  modified_base (290)..(290): a, c, t, g, unknown or other
  misc_feature (290)..(290): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggcgttttcttaggtggtctaattttaaaaggtgtcagtgtagaggtggaggtgttggagtcgtggggagcttggtacggcgtcgggggtcctgacgtactctcctgtgcagcctcgtaggaataatcttagacaaatacgacctanagtactcgtcgggtcccgaccgaagccgttccggaaggggaacgggcgtagggtacggtggttacgcgaacgccttacgtttaccgactaaggcgggttaggtcggcgtacggacctaaccgtaacggacctaggtacccgtacgggtacggaaccgggtcccgggttaccctacccgttcgtacccggaagtaacgtacgtaacgttaccgaacggaaacctacgtactaactagtacgtacgaactaagtaacgaaacgtaccgacgacggaacgaccgacggaccgaaccggacgaccgtattacgttaattgttacgacggtaacgaaacccgaacccgtacgggaccaccgtaacgtaggttacggtacgtttaccgttttacgtaacggtttccggacggtaacccgggaaggtacccggtaaacggtcccgg

SEQ ID NO: 180668 - DNA, 721 bp, Homo sapiens
  misc_feature: GYAE6OF02GWS22.37.20.B09.1.454.CMB.1.raw
  modified_base (278)..(278): a, c, t, g, unknown or other
  misc_feature (278)..(278): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggctttttcttgtggctattttaaaaaggtgtccagtgtgaggtggaggtgttggagtcgtgggggaggcttggtacggccgtggggggtccctgagactctcctgtgcagcctctggaatatctttagcaaatcnccatgatctgggtccgccagggtcctccgaggggaacggggtctagggaggtgggtcctcgagtcctacgttttccggctaagtgggtgggtcggcaccgcaaccgtacgcgacgaccgtccggtaggtaacggggtcccggtttaccacccggttcctacccggaaggaacgaaccttaaccgttacccggaaacggaaacccttaactaccttaacttactccgtacgacctaaaagttacgaaacaaccggtccgtaggaaacgacggtacccggaaccggaccgaccgggtacctaagttaatttaacgttttaacgtggttacgggaaaccgtaaacccgtaaccccgaaccgggtctaacccgaacgttaacgttccggaatttccgtttagaccgtttcggtaccgggaccgtaacggggtacaccgggttacccg

SEQ ID NO: 180669 - DNA, 805 bp, Homo sapiens
  misc_feature: GYAE6OF02GP3XJ.37.20.B09.1.454.CMB.1.raw
  modified_base (281)..(281): a, c, t, g, unknown or other
  misc_feature (281)..(281): n is a, c, g, or t
  modified_base (358)..(358): a, c, t, g, unknown or other
  misc_feature (358)..(358): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtgtcttttctagtcggctatttaaaggtgtcagtgtgaggtggaggtgtggagtcgtggggaggtcgttggtacggccggtcgggggtcccgtgacgtactcgtcctgtcgcgacgtcctctaggaataactacttaanacaaagttaccgaccagtacgaacgtcgttccgggtcccgaccggacggtaccgtacccggaagggggtaacggggngtacggggacgggttaccgggtacttaccgacggtaccgttacccggtttaccggaccgtaaggttcgggtcgggttaggacgtaccgcgtaacgtaccgacgacgtacgtaccggacggtacgggtaccgttaccgtaccgtccgtaccgaagacgtaaactaccgttaacccggaaggtaaacccttacttaaacgtacgtttaactcggtaaccgtaacgaaaacgttaccggaaacgttaccggtaacccgttcgggaaacgtaccgaaacccgggtaccgtaaccgacccgggtaccaattttaaaccgtgtttaacgttacaaccgggtaacccgaaaccgtaccccggtaagtaccgaacccgttattagggtacgttagttacccgtttaacgacggtttcggaaccggggtaccgtaagggtacccctacggttaccc

SEQ ID NO: 180670 - DNA, 685 bp, Homo sapiens
  misc_feature: GYAE6OF02JOX8S.37.20.B09.1.454.CMB.1.raw
  modified_base (188)..(188): a, c, t, g, unknown or other
  misc_feature (188)..(188): n is a, c, g, or t
  modified_base (633)..(633): a, c, t, g, unknown or other
  misc_feature (633)..(633): n is a, c, g, or t
  modified_base (644)..(644): a, c, t, g, unknown or other
  misc_feature (644)..(644): n is a, c, g, or t
  modified_base (648)..(649): a, c, t, g, unknown or other
  misc_feature (648)..(649): n is a, c, g, or t
  modified_base (651)..(653): a, c, t, g, unknown or other
  misc_feature (651)..(653): n is a, c, g, or t
  modified_base (655)..(656): a, c, t, g, unknown or other
  misc_feature (655)..(656): n is a, c, g, or t
  modified_base (658)..(658): a, c, t, g, unknown or other
  misc_feature (658)..(658): n is a, c, g, or t
  modified_base (660)..(661): a, c, t, g, unknown or other
  misc_feature (660)..(661): n is a, c, g, or t
  modified_base (663)..(665): a, c, t, g, unknown or other
  misc_feature (663)..(665): n is a, c, g, or t
  modified_base (667)..(667): a, c, t, g, unknown or other
  misc_feature (667)..(667): n is a, c, g, or t
  modified_base (670)..(676): a, c, t, g, unknown or other
  misc_feature (670)..(676): n is a, c, g, or t
  modified_base (678)..(681): a, c, t, g, unknown or other
  misc_feature (678)..(681): n is a, c, g, or t
  modified_base (683)..(684): a, c, t, g, unknown or other
  misc_feature (683)..(684): n is a, c, g, or t
tcagtagtgtagatcacgaccggtgctcgatttagtgtagtgtgaagggctggagtgggtctcagcatttccggcaatggtggtggcacgcactacgcacgactccgtgaagggccggttcaccgtctccagagacaattccaggaacactctatatctgcaaatgaacagcctgagagccgacgacncggccatatagttatgtgacgaaaagaccccaaggtgaccctaacattacgggagtctttttagacctttcggtcgggggaccaaaagggggacgtaaaccgggtacctaacccggttcccgtacgttcctaacggtcccccttacccgaacccaacggggccccctaggttaccccgggttaccgttccccccccgttgggaccccggtcccccgttcgtccccgttaccccgaaggggtaccgtacccgtaaaccccggttcccgaacggggaccgcccgtaaacgaccggtacccgggtccccgtacgggggccttccggggtccgtcgggttaccgaaaacgggttaccttacctttaccccacgttacccgtaaccgtaccgttaccgtaggaccggccgggtacgtcggggacgtaaacgggcgtaccgagttacgcanctgacgtagcnctcnncnnngnngngnncnnncncgnnnnnnnannnncnnc

SEQ ID NO: 180671 - DNA, 677 bp, Homo sapiens
  misc_feature: GYAE6OF02IVPS9.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagcgtggtctttttcttgtggtactattttaaaaaggtgtccagtgtgaggtggaggtgttggtagtcgtgggggagtcgttggtaccggtccgtcgggggtccctgacgtactcgtccgtgtcgcgacgcctcgtaggtaataattctttaacgacaaaactaccgacctacgtagtacgtcgtcgggtccgaccgaggcctccggaagggacggggcgtagggaggtgggtctcgacgtcctacgtttccggactaaggtggttggtcgcgacgcacgtacgacgacgtacgtcggtaggtacggtcgtcaccgtcacacgaagactaacgtacaacgtactaactcgtatcgtactagaactaaatacgaacacgcgtagacgtacgaccgacgaaccgacgactataatagttagtacgacgaacgaaacgacccgtaaggtacctaacccgagttaacggtacggtaacgttaccgtttaggtaaccgtttcgggaccgggtaaaccgtaacgggtaaccgtacggttaacccg

SEQ ID NO: 180672 - DNA, 904 bp, Homo sapiens
  misc_feature: GYAE6OF02JRBE3.37.20.B09.1.454.CMB.1.raw
  modified_base (210)..(210): a, c, t, g, unknown or other
  misc_feature (210)..(210): n is a, c, g, or t
tcagtagtgtagatcacgaccggtgctcgatttagtgtagtgtgaagggggagagaggagcccagccctgggattttcaggttgttttcatttggtgatcaggactgaacagagagaactcaccatggagcgttgggctgacgctggtctttttctgtggacttaatttaaaggtgtaccagtgtgaggtggaggtgtgagtcgtggggngtcgttggtacggcgtgggggtccctgagactctctgtgcacgtcctcgtgaatacgttcttagactaaactaccgtaccaagttcgaactttccggtgggtaccccgaccggtacggtaccgttaccggaaacgggggaacggggggtacctaaggggttcggggttacgggtaccgtccgtaaccggtcccgtaaacgttttcccgggacgtaaacgggttcggggttacggggttggaaccggtaccgtacgtaaccgtaaccggacgtaaccgtaacccgtttaccgggagggtaaaccgggggttcccgttacccgtaacccggtttcccaccggttaacggaaccctaacggttaaaccttaacccggaacggtaaaccctaaccgttacctaaacgttactacccgttggaaacccttaaaagcccgggttaaaactcccggactaagggaacggtccccgaaacccgggaccgaaccgaaacccggttacctagtttaaacttaagtttaaccgtttacggaaacggtacccggtaaaaacccgacccccggttaagggttacccgtaacctaaacgggtttacttaacgggggttacttttaccccggttttaaggacccttttacgggggtaccgggtaaaaccccggtaccgggggttaaacctaccccgggggtttaacccc

SEQ ID NO: 180673 - DNA, 772 bp, Homo sapiens
  misc_feature: GYAE6OF02IJRED.37.20.B09.1.454.CMB.1.raw
  modified_base (129)..(129): a, c, t, g, unknown or other
  misc_feature (129)..(129): n is a, c, g, or t
tcagtagtgtagatcacgaccggtgctcgatttagtgtagtgtgaagggggagagaggagcccagccctgggattttcaggttgttttcatttggtgatcaggactgaacagagagaactcaccatggngcttgggctgagcgtggtctttttctgtggtacttaagttttaaaaaggtgtacctagtgtggagggtggtaggtgttggaggtcggtgggggaggtcgttggtacggccggtcgggggtccctggagacttccgtccgtgtcgacgtacgtccgtacgtaggtaaattaactttacgttaacgtaactaaaacgtaccgacctaagtagtacgtcgtcgggtcccgccgacggtccgtaccgggaaggggacggggtcgttacggggtagggttcgggtactcgaacgtaccgttaccggttccggacgtaaggttcggggtggtaccgggaccgaccgtcgtaaccgtaccgcgaacgtaccggtacggacgggtaaccgggtccggtaccctacccggtccgacaggaacgtaactacgttccgaaacgtactacgtactacttactacgtagtaactaaagtcgaaacgttcgacgtaggaacgaccgtaccgaaccggaacacgtacctaaagttacttgtttaagcggtacgaaacccgtaaaccgtaacccgagtaccctaaccgtaacgtagtacgggtctttacgtttacgtaccgtggggtaaacccgaccgggtaacgacccgtaccggtcg

SEQ ID NO: 180674 - DNA, 809 bp, Homo sapiens
  misc_feature: GYAE6OF02I9V94.37.20.B09.1.454.CMB.1.raw
  modified_base (209)..(209): a, c, t, g, unknown or other
  misc_feature (209)..(209): n is a, c, g, or t
  modified_base (618)..(618): a, c, t, g, unknown or other
  misc_feature (618)..(618): n is a, c, g, or t
tcagtagtgtagatcacgaccggtgctcgatttagtgtagtgtgaagggggagagaggagcccagccctgggatttcaggtgtttcattggtgatcaggactgaacagagagaactcaccatggagcttgggctggagcgtggtcttttcttgtggcttagttttaaaaggtcgtacctagtgtgaggtggaggtgttgagtctggggnggtcttggtacggccgtggggggtaccctggacgacgtctccgtcgtaggcaacgtcgtcgtacggaattaagtcttacgtactaaacgtaacgtacccaattcggaatcgtacgggtcccggcctaagggcctccgaaggggaacgggtcttaggaagggtcccggttgaaacctaggcctagtttacccggcgaaagttcgggtcggggtgtccgaacggcctaccgttaaccgggatacgggtaccttcccggccggtaaaagggggtccccgtttaccgaaccggtccttacccggagtaaccgtacctaaacgtccctaggggaaaacacccttaaggtaccctagtacggttacgtaacctaaacggaaggtaaacccgtggaacccgtttgaaaccgggtanaccccggggaacttaaacccgggcccggttaaacccacggttttaagtacttttaaaccggttgttacgggaaaccgtaaaccggtaacccccgacggggtttaaaccaaccccgggacttaatttcggggaaacgtccttttaaccgggctttagttaccggggcttaacggaaccggtcggtaacccgg

SEQ ID NO: 180675 - DNA, 856 bp, Homo sapiens
  misc_feature: GYAE6OF02IBNCC.37.20.B09.1.454.CMB.1.raw
  modified_base (746)..(746): a, c, t, g, unknown or other
  misc_feature (746)..(746): n is a, c, g, or t
  modified_base (778)..(778): a, c, t, g, unknown or other
  misc_feature (778)..(778): n is a, c, g, or t
  modified_base (785)..(785): a, c, t, g, unknown or other
  misc_feature (785)..(785): n is a, c, g, or t
  modified_base (802)..(802): a, c, t, g, unknown or other
  misc_feature (802)..(802): n is a, c, g, or t
tcagtagtgtagatcacgaccggtgctcgatttagtgtagtgtgaagggggagagaggagcccagccctgggattttcaggtgttttcatttggtgatcaggactgaacagagagaactcaccatggagcgttgggctgagcgtggttctttttcttggtggtactttaagttttaaaaaggtcgtcctaggtgtaggagggtgggagggttgttaggagtcgggtgggggaggtcgttgggtaccgggtccgggtcggggggttccctggaggtacttccgttccgtggtcggcacggtccttcggtttcggttactaacgtttccgttttaacgacctaaaaccgtccggacctaagttggaacgtccggttcgggccccgaaccggtcggtaccgtacccgggaaggggggacggggtcgttagggacgggttcggtcccgttaggttaacggttaacgttacggtagggttaacggtaacgggtttaaaccaccgtacgaaccgtttaacggtaaccgtacgaaaccggtccggttaccgggttaccgggaacccgggggttccgttacccgtaacccgttccgtaacccgaaagggtaacctaaccgtaaactttaccgaaacggtaaacgttaccgtttaccgatttacggaaaggttaataacgaaacgtcgacgtacgaagggaccgtacggacgacccgtaaccgtcccgtaatttacggtaatcggacgtggaacngttacaaacgtcgggtacggtaattaccgganaccggtnaccggaattcccgttanaaccggtacgttaccgggtacgggaccctaaaccggtaccggttccgtaacccg

SEQ ID NO: 180676 - DNA, 727 bp, Homo sapiens
  misc_feature: GYAE6OF02JVH3B.37.20.B09.1.454.CMB.1.raw
tcagtagtgtagatcacgaccggtgctcgatttagtgtagtgtgaagggggagagaggagcccagccctgggattttcaggtgttttcatttggtgatcaggactgaacagagagaactcaccatggagcttgggctgagctggtctttttcttgtggcttaattttaaaaggtgtccagtgtggaggtggaggtgttggagtcgtggggaggtcgttggtaccggtccggtcgggggtccctgacgacctcgtcctgtgcgacgtcctcgtgaatattcttagactaagtaccgcatgtacttcgtcggtccgccgacggtcctaccggaaggggtacggggcggttagggacggttcgggtctcgtacggtaccgttacgtttacccggacgttaaggtcgggtacgggtcggacctaccggacctaccgtaccgcgtaacgtaccgtaccggtacggtaccgggtccgtaccgtaccgtccgtaccgaggaactaacgtaacctccggaaacgaacttctactaatactcacgaactaaacggtcaaacgtacgtcgtacggaacgcggacccggtaacgaccgtaccaccgttaattaaccgttagtttaccgtggtaaacggaacccgtaaacgttaccccggagttaaccaccgtgttaacgtggtaactttcgttaccgttagttccggacgggtaccgaacggtacctaccggttcccg

SEQ ID NO: 180677 - DNA, 836 bp, Homo sapiens
  misc_feature: GYAE6OF02GEMSA.37.20.B09.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (591)..(591): a, c, t, g, unknown or other
  misc_feature (591)..(591): n is a, c, g, or t
tcagtagtgtagatcacgaccggtgctcgatttagtgtagtgtgaagggggagagaggagcccagccctgggatttcaggtgttttcatttggtgatcaggactgaacagagagaactcaccatggagcttgggctgagctggtctttttcttggtcggcttaattttaaaaggtgtccagtgtgaggtggaggtgtggagtcgtggggngcgttggtacggccgtgggggtcccnggagacctctccgtgtcgacgcgtcctacgtggtaacttcctaaacgtttgggtacggcttagttggactacggtacggttcggggttcccgccgtaaggtcctaccgggaagggggtaacgggtcgtgggggtagggttcggggttacggacccgtaaaactacggttaaacggaggggggtacgggttaacggggttaagggtaaaaccctaaaaaaccggttgttaagggttaccggaacgttcgttaccggtgggacccggggtctaagttacccgaactcgtacctaccgagtaacgaaccaaccgaacctaaaacgtccacgttacgtactacgtcgaaactaacgggngggaaccctccggagttacgacgtaccggacggaccgtcggtagttgtacggttaatttacggttggaacgtacgggaacgtaagttttaaacgttaacggtaacgttaaaccggtttaacgggtttaggtaacggggttaaccttaacggttttaggggaagtttaacggtaccgttttgtaaacggtttaccggttacccgggaaaccggtttccccgggttaccgggggtaaaacccccggg

SEQ ID NO: 180678 - DNA, 711 bp, Homo sapiens
  misc_feature: GYAE6OF02JH18C.37.20.B09.1.454.CMB.1.raw
  modified_base (576)..(576): a, c, t, g, unknown or other
  misc_feature (576)..(576): n is a, c, g, or t
tcagtagtgtagatcacgaccggtgctcgatttagtgtagtgtgaagggcgtggagtgggtctcagccatttccggcaactggtggtggcacgcactacgcagactccgtgaagggccgttcaccgtctccagagacaattccaggaacactctatattctgcaaatgaacagccttgagagccgacgacacggccatatattattgtcgacggaaacgacccgaacgggtgaaccacacgttggacgtcttttacgacttcgtcggggaccaaggggactaacgggtcctaaccggtctccttacagcctaccgaaccgaacgggcctacggttccggttcccttccccccgtggtacccggcccgttcgccgtaccgacggacggtcctaacccgttcggttacgggggacctaaccgtaggcccggacccgtagggcctcggtacccgtacgggtaccgaaaacggtaccgtttaaccgtcctaacgtttaccgtaaccgtaccgtaaccgttcggacgtaccgggtaccgttacgggaaccgtaaggggtccgaacgtaacgttacgcggancgacgtagacgacgtacgacacgagacgacgacgtacgcgtacgacgtacgtacgtacgtcgtacgtagtacgtacggtacgtacgtacgtacgtaccgtacgtacgtaccgtctacgtacgtacgtacggtacg

SEQ ID NO: 180679 - DNA, 835 bp, Homo sapiens
  misc_feature: GYAE6OF02HNQE9.37.20.B09.1.454.CMB.1.raw
tcagtagtgtagatcacgaccggtgctcgatttagtgtagtgtgaagggggagagaggagcccagccctgggattttcgggtgttttcatttggtgatcaggactgaacagagagaactcaccatggagcttgggctgagctggtctttttcttgtggctattttaaaggtgtcagtgtgaggtggaggtgttggagttcgtgggggaggtcgttggtacggtccgtggggggtccctggagtactctcctgtgcagcctcgtaggtaattacttacgttttagactaaacgtaccgtactagtcgtacgttccggtccggggtacccgaccggacggtaccgtaccgggaagggggtacggggtcggtacgggtacggttcggtaccgtacgaccggtaccgttacgtttaccggaacgtaggtcgggttacggtcggaccgacgtacgtaccgtacgacgtaacggtaccggtacggtaacgggtaaccgggttccggttaccgtacccgttacgtaccgtaacggtaactaacgttaaaccgtaccggaaacgtaactacgttactacttacgttacgtacgtaaacgtaaagtacgtaaccggtactaccgtaacggtacggaacccgtaccggtaccggaacgtaccgggtacttaaagttaacttaacgtttacgtttacgggaacggtaaaccggaaaccccggtaacccggtaacggttaccgacccggttaacgttacggttaccggttacgtttaccggtttaacggtaccggttacgggtaaccgggtacccggtaaacgggtccggtaacccgttaccgtacg

SEQ ID NO: 180680 - DNA, 892 bp, Homo sapiens
  misc_feature: GYAE6OF02JV0XA.37.20.B09.1.454.CMB.1.raw
tcagtagtgtagatcacgaccggtgctcgatttagtgtagtgtgaagggggaggagaggagcccagccctgggattttcaggtgttttcatttggtgatcaggactgaacagagagaactcaccatggagctgggctgagctaggtctttttctgtggcttattttaaaggtcgtcgagtgtgaggtggaggtgttggagtcgtgggggagtcgttggtacggtccggtcgggggtccctgacggtactctccgtgtcgcgagtcctcgtaggaatacgttacttacgactaagtaccgacctatggtactacggtacgggttaccccgaccggacggtacccggttaacccgggaagggggaacgggggtcgtacggggtacggttcggggttacctaccggtacggtacccgtacgggttttacccggaagttacggttcggggttggtaccgggaccgtacgggacctaaccggtaccggtacctaacggtaccggttaccgggtaacggtaaccggggtacccggtttcccgaaacccggtttcccctaaacggtacggtaaaccgtaaccgtttaaaccgttaacccgggaaaccgtaaaaccgtccgttttaaccgtaaacgttacggtttacaacggtaaaccgtaaacgttacggaaaccgaacggttacccgttaaggaaaccgggtaccgtaaacccccgggaagaaaccccgggtaccggtaccctaaaaggttacttaacggtttacgtaaccgttacggaacccgtaaaccggacccgttacggaccgtaaccgtgttaaccggtaggtttacccttggtttaaccgaccggttttccgggaaacggccggttaaaccgggttacgtaaccgttccccg

SEQ ID NO: 180681 - DNA, 553 bp, Homo sapiens
  misc_feature: GYAE6OF01EDKVB.12.5.A05.1.454.CMB.1.raw
  modified_base (423)..(423): a, c, t, g, unknown or other
  misc_feature (423)..(423): n is a, c, g, or t
tcagatacgacgtacacgaccggtgctcgatttagatagatagacagggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgataataactatttctcctggtaccagcaacacccaggcaaagcccccaaactcctcatttatggtgtcgggaatcggccctcaggggtttctaatcgcttctctggctccaagtctggcaaaacggcctccctgaccatctctggactccagcctgaggacgaggccgattactactgccattgcaanacgagaagtcacctaggtggtgtcggacgggacgaacctaacgacgaccgtcgtacgtacgaccgaccgacgccgtcccgcccgtcgaccacgttccgttcccgtacccgtccctcctccgtcgttaccg

SEQ ID NO: 180682 - DNA, 575 bp, Homo sapiens
  misc_feature: GYAE6OF01CPP6J.12.5.A05.1.454.CMB.1.raw
tcagatacgacgtacacgaccggtgctcgatttagatagatagacgagggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgataataactattctctggtacagcaacaccaggcaaacgccccaaactcctcatttatggtgtcggaatcggcctcgtaggggtttctaatcgcttctctggctcaagtctgacaaaacggcctcctgacctatctctggactcagcctgaggacgacgccgattactactcgatattgcaacagaacaaggctaccctagttgggtagttcggacgggaggaaccgaaactcgaccgtactaggtcgacgcccgaaaggcctacggccccccttgggtccctaaccgttccgtaccggtttcccccgacccccgttcctccgttaaccggttacccgg

SEQ ID NO: 180683 - DNA, 750 bp, Homo sapiens
  misc_feature: GYAE6OF01AP461.12.5.A05.1.454.CMB.1.raw
  modified_base (301)..(301): a, c, t, g, unknown or other
  misc_feature (301)..(301): n is a, c, g, or t
tcagatacgacgtacacgaccggtgctcgatttagatagatagacagggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggccaaacgccccccaactcctgtatttagnggtacgtcacttacgttccggtcctacgaaggtaactttactaactcgtcttcttcgttcggttaccaagttcgtcggaccaaccgaccggtccctcccgtacgaaccctacgttccgttacggttcggggtacccgtagggtaccgttacgggaacggggtaccggtaacgggtccgtttaaggtaacgttttaaacgtttaccgtacggtaccgttaacggtttacctaaacgtttaacttaaaccgaaccggtaccctttaacccgtttacccctaaccgtttccgtttaccgggttcgggtttcggggttaccgggtccggggttacggaacccgtaacggtccgtacggtaccccgttacgtaacggtccgaaccggtacccgtacggtccctcccggtcccccgttcgtcctacctcccgttccgttccccgtcccttacccg

SEQ ID NO: 180684 - DNA, 512 bp, Homo sapiens
  misc_feature: GYAE6OF01E0NM4.12.5.A05.1.454.CMB.1.raw
  modified_base (408)..(408): a, c, t, g, unknown or other
  misc_feature (408)..(408): n is a, c, g, or t
tcagatacgacgtacacgaccggtgctcgatttagatagatagacagggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatgctgggatgatagttgtctctgtaccacatcaccagcaaacgccccagactcatgatttatgagggacaaaaacggcctacgggatttctaatcgcttctctggctcaagtctgcaacacggctcctgacatctctgggctccagctgaggagagctgattattactgtactgctcatangcaggtagtggtactaccgtttcgctacttacgtcgggcggagggaccaaggcgtacgaccgtctacgtcacgtacccgaaggcctacggtccccctggtaccc

SEQ ID NO: 180685 - DNA, 651 bp, Homo sapiens
  misc_feature: GYAE6OF01BEDQP.12.5.A05.1.454.CMB.1.raw
  modified_base (220)..(220): a, c, t, g, unknown or other
  misc_feature (220)..(220): n is a, c, g, or t
tcagatacgacgtacacgaccggtgctcgatttagatagatagacagggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccngcagtgacgttaatgaataataacttatttctcctggtaccagcaacacccagcaaagcccccaaactcctcatttactggtgtcgggaatccggcctcgagggtttctaatcgcttctctgctcaagtctggacaaacgtcctcctgaccatctctggactccagctggacggacgacggccgtattacctacgtgacctagtttcgaccacgacggaaccgaaagggacgtccccgtaacgtttcggggttcggttaccgggccgggtaacggggaaccctaaaacggttcgtaacccgttccgtacgggttaccacggaccccgaagggtccctcccgggtaccccccgttcgggttcccaacccgtttcccgttaccggtttcccccccaaccccgtttccccgttcccgttaacccggtttacccg

SEQ ID NO: 180686 - DNA, 725 bp, Homo sapiens
  misc_feature: GYAE6OF01AQATC.12.5.A05.1.454.CMB.1.raw
  modified_base (295)..(295): a, c, t, g, unknown or other
  misc_feature (295)..(295): n is a, c, g, or t
tcagatacgacgtacacgaccggtgctcgatttagatagatagacagggggggtctcaggaggcagcgctctcgggacgtctccaccatggcctgggctctgctattcctcaccctcctcactcagggcacagggtcctgggcccactctgccctgactcagcctgcctcgtgtctgggtctcctggacagtcgatcacatctcctgcactgacaaccagcagtgacgttaatgaataataactatttctctggtacacgcaacaccagacaaacgccccaactcctcatttagnggtgtcggtaacgtccggccgtacgtagggttctaatcgtcttctcgtcgcctacgtaacgtcgtacggaaccgtaaaaccgggtccccttacccgtacgaaccctacttccttcgtacggtaccctaccgtacgtcccgtagggaacggacggaacgggtacccgtaacttaaccgtacgtcgtaccttagttaccgacgaaccgtaacggaaccgtaacgggtaccgttacccgttaacgggtttcggggttacgggttccggggaaccgggtaaccgggtaacccgtaaacgttcccggacccgttaccggtacgtacccgaccggtacccgtacggtacccgtcccggtcccccgttcggtacccgtaccgttccccgttccgttcccccgtaccccgttcccttcccggttaccggtttacccgg

SEQ ID NO: 180687 - DNA, 596 bp, Homo sapiens
  misc_feature: GYAE6OF01BXX92.12.5.A05.1.454.CMB.1.raw
  modified_base (235)..(235): a, c, t, g, unknown or other
  misc_feature (235)..(235): n is a, c, g, or t
tcagatacgacgtacacgaccggtgctcgatttagatagatagacaggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaangataataactatttctctggtaccagcaacacccaggacaaacgcccccaaactcctcatttatggtgtacgggaactccggccctcgaggggtttctaagtcgtcttctctggctcaagtctggacaaacggcctccctagacctatctcgtgacttccgacgtcctggacggacgacggcctaagttacactgacctattcgacacgaacgaacgaacggtactcccgtagtttggggtcgttcggggacgggaacggaaccaacgtcggaccgtccgtaggtccacggcccgaaggtcctacgcccccggttcggtccacccgttcgtcccgttccccgcccttcctcgtccgttacg

SEQ ID NO: 180688 - DNA, 616 bp, Homo sapiens
  misc_feature: GYAE6OF01CN1SA.12.5.A05.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
tcagatacgacgtacacgaccggtgctcgatttagatagatagacgagggggggggtctcagggaggcagcgctctcgggacgtctccaccatggcctgggctctgctattcctcaccctcctcactcagggcacagggtcctgggcccactctgccctgactcacgcctcgcctccgtgtctgggtctccgtggacagtcgatcactatctcctgcactcgacaacngcagtgtaacttaangaatataactnttctcgtacgacacaccaacaccgacgaccaaccaccctactcctatattgtggtcgtacggtacgtccgtccgtaggtacggttactacgtcgtctctcgtcgtactacgtagtacgacgaacgaaccgtcctacgactacnctcgcgtacgtacacncgcgacggacgacgacgtactactactcgtacgtactcgtacgacacgaacgacgtacgactaccgtggttacggtcgggtacggacggtaacgtaacgtacgtaccgacgtacggtacgacgacgaccgtaccgtcccgtcccggtcccgtcgtaccgtccttcccgtaccccgtccctacccttccgttccgtccggttac

SEQ ID NO: 180689 - DNA, 696 bp, Homo sapiens
  misc_feature: GYAE6OF01CFPZY.12.5.A05.1.454.CMB.1.raw
  modified_base (136)..(136): a, c, t, g, unknown or other
  misc_feature (136)..(136): n is a, c, g, or t
  modified_base (143)..(143): a, c, t, g, unknown or other
  misc_feature (143)..(143): n is a, c, g, or t
  modified_base (214)..(214): a, c, t, g, unknown or other
  misc_feature (214)..(214): n is a, c, g, or t
  modified_base (363)..(363): a, c, t, g, unknown or other
  misc_feature (363)..(363): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (525)..(525): a, c, t, g, unknown or other
  misc_feature (525)..(525): n is a, c, g, or t
  modified_base (633)..(633): a, c, t, g, unknown or other
  misc_feature (633)..(633): n is a, c, g, or t
  modified_base (646)..(646): a, c, t, g, unknown or other
  misc_feature (646)..(646): n is a, c, g, or t
  modified_base (670)..(670): a, c, t, g, unknown or other
  misc_feature (670)..(670): n is a, c, g, or t
tcagatacgacgtacacgaccggtgctcgatttagatagatagacgaggggggggtctcgaggaggcagcgcgtctcgggacgtctccaccatggcctgggctctgctattcctcaccctcctcactcagggcagngggtccncgggacccactctgaccctgactcagcctcgcctcgtgtcgtgggtctcgtggaccagtcaatccaacctntccgtctgcctacgtcgacaaccgagtcaaggtacgtaacgtttaagagtaaacttaaaacttacgtttactttccgtacgtaggaaccacgaaccaaacgaccgaagaacccgaaaccgaccccctaaactcttacgttaagtttcgnggtacgtacggactcccggtaccgttaggtacggtttacagttccgtctcgtcgtcgtacctaccgtagtcgacggaacccgtaacggtcccctacgtccaacgtctccgtagtaccgcctacncgtacgagacggacgcgtactntaccntcgactcgtanacacgagaacgacgtacgcccttagggtcggtacgggtgggaaccggtaaccggaaccgttacgccggttaacggtccgtaacggccgaaccgtccgaaccggttccncccgttacccggngttaaccgtccgtcggttaccccncccgtcccttacgtccgtacgttcgg

SEQ ID NO: 180690 - DNA, 693 bp, Homo sapiens
  misc_feature: GYAE6OF01DKGG5.12.5.A05.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (334)..(334): a, c, t, g, unknown or other
  misc_feature (334)..(334): n is a, c, g, or t
  modified_base (432)..(432): a, c, t, g, unknown or other
  misc_feature (432)..(432): n is a, c, g, or t
  modified_base (682)..(682): a, c, t, g, unknown or other
  misc_feature (682)..(682): n is a, c, g, or t
tcagatacgacgtacacgaccggtgctcgatttagatagatagacgagggggggggtctcaggaggcagcgctctcgggacgtctccacatggcctgggctctgctacttcctcaccctcctcactcgagggcacggagggtccgtcgggcccactctcgccctgactcacgcctcgcctcgtgtcgtcgggtctcgtggacagtcgactccnccgtctcgtncgacgtcggaactagtaatgttaagttttaggtaaactttcgacgttactctacgtacgtaaccaaactaaccgtaccgaacaaacgtacctaaattaactcttagttacnggaacggacgtaacgtaacggccgacctaggtacgtatttcagtctactcttacgtcgtcgacgtacgacggcgtacggccggtaccggcctacgtanaactagtactcgggacgtacgtcgaggacggttacgggacggacggtaccggaacttaacttcgctagtactaacgtgaaccaagacggaaacgacggtccgttacgtagggtttcgggcggtaacggggacgaaacggtaccaagtccgggtaactgtaccgacgccgtacgacgtcccgtccgacccgttcgtatacccttcccgtacccgttacccctccgttcgtaacccgttacggtattcccgnggtacccgggg

SEQ ID NO: 180691 - DNA, 762 bp, Homo sapiens
  misc_feature: GYAE6OF01A3D4P.12.5.A05.1.454.CMB.1.raw
  modified_base (110)..(110): a, c, t, g, unknown or other
  misc_feature (110)..(110): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (513)..(513): a, c, t, g, unknown or other
  misc_feature (513)..(513): n is a, c, g, or t
  modified_base (575)..(575): a, c, t, g, unknown or other
  misc_feature (575)..(575): n is a, c, g, or t
tcagatacgacgtacacgaccggtgctcgatttagatagatagacaggggggggtctcaggaggcagcgctctcgggacgtctccacatggcctgggctctgctattccncaccctcctcactcagggcacagggtcctgggcccacgtctgcccctgactcagcctgacctccgttgtcgtgggtcctccgtggacagtccgatccaccatctacctgccactcgaccaaccgngactaggtacgtaaccggtttaanagtaattaaactttaaaacgttcgtttttccctaccgttacgggtaacccaaggaccaaacccgaacccgtaacgggaacccaaaaccccggaccccccctaaaacgttcccttacgttaaacgttttcggacgggtttccggtaaccggggtaacgttcccgggcccgttacggtacggggtttactaacgttcggtactttcgtcgtcggtccacgtaagtcgtacgaaccgaaccggccctaccgctaccnctacctcgtcggacctcctaagcccgtaggaccggtacggacgttaccgtaacttacgtacncgtacacttccgaacgaaccgaacggaacgtaacggtaccgttaccgtcgggtttgggtacccggttcgggaacgggtacgaaccgtacgtaccgaccggtacgtcgtacgacccgtaacgacgtcctcccggaccctcgggacctacgtcccgttcgtaccccgtactccgtaacgttccgtacgg

SEQ ID NO: 180692 - DNA, 847 bp, Homo sapiens
  misc_feature: GYAE6OF01AON6L.12.5.A05.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
tcagatacgacgtacacgaccggtgctcgatttagatagatagacgaggggggggtctcaggaggcagcgctctcgggacgtctccaccatggcctgggctctgctattcctcaccctcctcactcagggcacagggtcctgggcccactctgccctgactcagcctgcctccgtgtctgggtcctccgtggacagtcgatcaccatcctcctgcactgcaacngcagtgtacgttaangaataataacttattctcctggtaccagcaacacccgaggaccaaacgcccccaaactccctactattttatggttacggtcggtaactccggacccgttcgtacggggttttactaacgttccggtactttccgtcgtcggtcctacccgtaagttccgtacgggaacccgtaaaaaccggtccccgttaccccgtacggtaaccctaacttcccgttccgttacgggtaccccttacccgaccgtccgttacgggaacgggtaaccggtaacggggtaccccgtaacttttaacccgtaacgttcggaccgttaacgttccggtacctaaccgacggtaaccgtaacgggtaccgtaccccgtaacgggttttaggaacgtttacgggttaccggggtacgggtaaacccgggtaacccgtaaaccgttccggtaaacccggttaccggtaacgggttacccgaaccggtaacccccggtaaaccgggttccccgttaccccgggtacccccccgtttaccgggttacccctacccggtttacccccgtttaccccgttaccccccgtaaccccccgtttcccgttaacccggttttaaccccggg

SEQ ID NO: 180693 - DNA, 615 bp, Homo sapiens
  misc_feature: GYAE6OF02J2FIP.12.5.A05.1.454.CMB.1.raw
tcagatacgacgtacacgaccggtgctcgatttagatagatagacagggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgataatactatttctcctggtaccagcaacacccaggcaaacgcccccaaactcctacatttatggtgtcgggaatcggcctctaggggtttctaatcgcttctctggctcaagtctggacaaacggcctccgtgaccatctctacggacctccgacgcctggacggacggacggcccgtattacctacgttgactagttcgactaacgagaccgaaggtaccgtcccgtaagttgggtcgttccggtacgggacggacctaaacgtcggaccgtaccgtacggtccacgcccgaacggtccgtccgtacccccgtcggtaccctaccgttccgttaccggttcccccgtcccgttacccgttccgttacccgttacccgg

SEQ ID NO: 180694 - DNA, 724 bp, Homo sapiens
  misc_feature: GYAE6OF02I80L7.12.5.A05.1.454.CMB.1.raw
tcagatacgacgtacacgaccggtgctcgatttagatagatagacaggggggggtcgtcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgaataataacttatttctcctggtaccagacaacacccaggcaaacgtcccccaaactcctcatttacgtggtgtcgggaactcggccctaggtacggggtttactaatcgtcttctctggctaccagtcgtggacaaaccggtctccctagacctactcctacgtggacctccgacgtcctaggaacgggacgacgggtaccaagtttacctacgtcgtaccgtattcggacctaaccgtacgaaaccggaacgggtaaaccgttccccgtaacggttttgggggttaccggtttcccggggggacgggtaaacgggggtaacccctaaaccgggttcggtaaacccgtccccgggttaaggtaccgtaccgggaccccgtaacgggtcccgtacccggccccccggttaacggtaccgtaacccgttccgtttacccggtttacccccctaccccgtttcccgttaccgtacccggtttaacccgg

SEQ ID NO: 180695 - DNA, 628 bp, Homo sapiens
  misc_feature: GYAE6OF02IANVW.12.5.A05.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagatacgacgtacacgaccggtgctcgatttagatagatagacaggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccngcagtgaacgttaangaataatactatttctcctggtaccagcaacaccaggcaaagcccccaaactcctcatttatggtgtcgggaatcggcctcaggggtttctaatcgcttctctggctcctaagtctggcaaaacggcctcctagacctatctctggactccacgcctgaggacgacggaccgattactacgtagctattcgacacgaagaacgaaggacgtacccgacgtttcgggttacggttccgggacgggtaacggggaacctaaaccgtaccggaacccgttccgtaaccgggtaccaccggacccgtaacggccgtacccggcccccgttacgggttaccctaccgttccttccggttacccctaccccgtttcccgtttacccgtccgttaccgg

SEQ ID NO: 180696 - DNA, 586 bp, Homo sapiens
  misc_feature: GYAE6OF02IBOWY.12.5.A05.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (379)..(379): a, c, t, g, unknown or other
  misc_feature (379)..(379): n is a, c, g, or t
tcagatacgacgtacacgaccggtgctcgatttagatagatagacagggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccngcagtgacgttaangataatactatttctcctgtaccagacaacaccaggcaaacgcccccaaactcctcatttatggtgtcggaatcggcctcgagggtttctaatcgtcttctctcggtctaccaagttctacggacaaaaccggtccctacccncgtaccacttcctcgtcggtacctcccgacgtccgtggacggaaccggacgggccgtaattacctactacgctagttcgcaacagacgaaggactacccgagtttgggtcggttcggacgggacgggaccaaacgtcgaccgtccgtaggcacgaccgaggctccgcccgtcgtcacgtctcttccctaccctccttcctcgtaccg

SEQ ID NO: 180697 - DNA, 573 bp, Homo sapiens
  misc_feature: GYAE6OF02GQIZC.12.5.A05.1.454.CMB.1.raw
  modified_base (234)..(234): a, c, t, g, unknown or other
  misc_feature (234)..(234): n is a, c, g, or t
  modified_base (516)..(516): a, c, t, g, unknown or other
  misc_feature (516)..(516): n is a, c, g, or t
tcagatacgacgtacacgaccggtgctcgatttagatagatagacaggggggggtctcaggaggcagcgctctcgggacgtctccaccatggcctgggctctgctattcctcaccctcctcactcagggcacagggtcctgggcccactctgccctgactcagcctgcctcgtgtctgggtctcctggacagtcgatcacatctcctgcactgcaaccagcagtgaacgttaangaataatacttatttctcctgtaccagcaacaccaggacaaacgacccccaactcctactatttagtggtgtcgggtaactccggccctcggtagggtttactaactcgtcttctctcggtctccaagtctacggacgaaacgtccctcctcgtaccagtctcgtcggtacctccgacgtcgtggacggacggacggtaccgtacttactacgtgactattcgacacagacaaggctcctacgttgggtcgtcggacggagaccaacgtcgacgtcgtagcncgacgacgtctccgcccgtcgtcctactccttccgtccctccctctccgtacgtccg

SEQ ID NO: 180698 - DNA, 678 bp, Homo sapiens
  misc_feature: GYAE6OF02IJ1XR.12.5.A05.1.454.CMB.1.raw
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
tcagatacgacgtacacgaccggtgctcgatttagatagatagacgaggggggggttcgtcaggaggcagcgctctcgggacgtctcacatggcctgggctctgctattcctcaccctcctcactcagggcacgagggtcctgggcccacgttctgccctgactcagcctgcctcgtgtcgtgggtctccgtggacagtcgatcgacctattctacctggccactgccaaccngcaggtcgacgtttangaattaataacttactttctcctggtaccagacaacaccaggacaacgacccccaaactcctacatttactgggttcggtacgggaacgttccggaccttacggtaaggggtttactaacgtcgtcttactacgtcggctacgacgtctacgggacaaaaccggccttcccgtacgaccatcgtactggactcccagtacctagggacggacggaacggtacgtaatttacctatcgactacgttcgactaacgaacgaacgtaaacggaccgttacccgtacgggtttgggtttacggttcgggacgggaacggtaaccaaaccgtcggtacccggtacgttagggtaccacggtacccgaaggtcctccggaccccgttgtaccaccgttcgttccgttaccccacctcccgttaccgtacgttccg

SEQ ID NO: 180699 - DNA, 556 bp, Homo sapiens
  misc_feature: GYAE6OF02IWN5Z.12.5.A05.1.454.CMB.1.raw
tcagatacgacgtacacgaccggtgctcgatttagatagatagacagggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatcctcctgcactgcaaccagcagtgacgttaatgaataataactatttctcctggtaccagcaacaccaggcaacgacccccaactcctcatttatggtgtcggatcggcctcgagggttactatcgcttctctgctcagtctgacaaacgcctcctcgaccatctctcggactccacgcctgacggacgaggacctagttactactgctattcgacacgagacgaagtactcctacgttgggtcgttcgggcggacggaccaacgtcgaccgttcgtacgtcacgaccgaggctccgtcccctcggtcctaccgtccgttccgtccccgccctccgttccgtacgttaccg

SEQ ID NO: 180700 - DNA, 630 bp, Homo sapiens
  misc_feature: GYAE6OF02HMZ0C.12.5.A05.1.454.CMB.1.raw
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (483)..(483): a, c, t, g, unknown or other
  misc_feature (483)..(483): n is a, c, g, or t
tcagatacgacgtacacgaccggtgctcgatttagatagatagacaggggggggtctcaggaggcagcgctctcgggacgtctccaccatggcctgggctctgctattcctcaccctcctcactcagggcacagggtcctgggcccactctgccctgactcagcctgcctccgtgtctgggtcctcctggacagtcgatcaccatctcctgcactncaaccngacagtgaacgttaangtaataattaacttatttcctccgtaggtaccagacaacaccagacaaaccgacccccaaactcctatactttacgtggttagtacggaactccggacctggtaggtttacaattcgtctctcgtacgttaccaagtctacgacaccgaccgtcctccgtacacctactcgtacggtcggtaccgacgtcgtaggtacggaacggagtaccgtagttaacttacgttacgtacgtactacgttanaacttacgaacacgtactactacctcttcgtcggttacggtcgtacggacggttaccgaaccgtagacgtacgtacctacgtagacgtacgaccgtaagcccgtaccgcccgtcgtacccgtcgttccgtaccctccctcccgtacg

SEQ ID NO: 180701 - DNA, 875 bp, Homo sapiens
  misc_feature: GYAE6OF02G0KP1.12.5.A05.1.454.CMB.1.raw
tcagatacgacgtacacgaccggtgctcgatttagatagatagacagggggggtctcaggaggcagcgctctcggggacgtctccaccatggcctgggctctgctattcctcaccctcctcactcagggcacagggtcctgggccccactctgccctgactcagcctgccctccgtgtcgtgggtcctcctggactagtcgatcaccatcctcctgcactgccaaccagacaggtacggtaacgtttaatgaaacttaaacttaacgtttacttttccgttaccgttacggtaacccacggaaccaaaacctacccccgaacggtaacccaaaacccggtaaccccccctaaaacccttacccttacttaaacttttacggttcggggttacgggttaccggggtaacggttacccgggtcccccggttacgggtttaaccgggggtttttaccttaaaaccgtttccggttcctttacccgttccggttacgggtcccgttaacccgttacggttaccggtacggaaacccgtaaaaaccgggtccccgttacccgtacgtaaccgtaaccttcccgtacgtaccggtaaccctacccggaacgtcccgttaacgggaagggacccggacgtacccgggtacttaccgtacgtcgacctagttcgaacacgtaacgaagtaacggaccgtaccgttacgggttcggggttacggtcgggtaaccggggaaccgggtaacctaaaccggtccgtaccggtacccgttagggtaccacggtaacccggaacggccggtacccggtaccccggtcctaaccgtcccgttaccgttccccgttacccctacccgttcccttacccggtacttacccgg

SEQ ID NO: 180702 - DNA, 701 bp, Homo sapiens
  misc_feature: GYAE6OF02FKWJ9.12.5.A05.1.454.CMB.1.raw
  modified_base (248)..(248): a, c, t, g, unknown or other
  misc_feature (248)..(248): n is a, c, g, or t
tcagatacgacgtacacgaccggtgctcgatttagatagatagacagggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgaataataactnttctctgtacagcaacaccaggacaaacgcccccaaactcctctatttaatggtggtacgggatccggcctcgtcgggtttctaatcgtcttctcgtcgctccagtcgtggacaaaccggtccctccctcgacctacttctcgtacggacctaccgacgcccgtaggacgggacggacggaccgtacttaccgtactacgactacgtttacgactacgaacgaaccgaaacgggtaccgttacccgtaccgttcgggggttacggtttaccggggaccggggtaaacggggtaacccgtaaacgggttaccggtaaccccggttccgttaaccggggtaccgtaaccggtacccggaacgggtccgtcccggtacccccggttccgggtaccgtaccgtttccgttcccgttaaccccgtccccttccccgttaccgttacccggttaaccgg

SEQ ID NO: 180703 - DNA, 777 bp, Homo sapiens
  misc_feature: GYAE6OF02H3EQS.12.5.A05.1.454.CMB.1.raw
  modified_base (264)..(264): a, c, t, g, unknown or other
  misc_feature (264)..(264): n is a, c, g, or t
tcagatacgacgtacacgaccggtgctcgatttagatagatagacaggggggggtctcaggaggcagcgctctcgggacgtctcaccatggcctgggctctgctattcctcaccctcctcactcagggcacacgggtcctgggccccactctgccctgacctcacgcctgccctcgtgtctgggtcctccgtggacagtcgactccaccagttcctcctagcctacgtcggaccaaaccgagctaaggtacgaacggtttaaancgtaaattaaacttaactttacgttttcctaccgttaacggtaaccaagaaccaaaccaacccggacggaacctaaaacccgaccccctaaaacctcccttactaacttttaacgtcgggttacggtacgggtaacgttcccggtaccttacgggtacgggttttactaaacgtccggttcctttccgtcggtccggtacccttaaccggtacgttccggtaacgggaaacccgtaaacccggttcccctacccgtactaacccgtattccgtacgtacgtacctccgacgtacgtaggacggtacgacggtactaataccgtcgtacgctagtacgactaacgaagtaaccgacggtacctaccggtacgttcggggtacgttccggggaacgggtaccggtaaccgtaacgtcccggtaacggttacgtacgtacccgacgtaccggacgccgtacccgtcccgtagttccaccgttccgtccctaccctccctacgttccgtacgttccg

SEQ ID NO: 180704 - DNA, 747 bp, Homo sapiens
  misc_feature: GYAE6OF02GHG4O.12.5.A05.1.454.CMB.1.raw
  modified_base (661)..(661): a, c, t, g, unknown or other
  misc_feature (661)..(661): n is a, c, g, or t
tcagatacgacgtacacgaccggtgctcgattttagatagatagacagggggggggtctcaggaggcagcgctctcgggacgtctccaccatggcctgggctctgctattcctcaccctcctcactcgagggcacgacgggtcctcgggcccactctcgccctgactcagcctcgtcctcgtgtcgtgggtcctccgtggacagtcactcacactctcctgcaccggtcgggaccacgacgtagtgagttcggttacgggtacttacgtttaaccttcgttccttccgttacggtaaccaaacaaccaccgaacggaaccaaaccgacccctaaactacaacttacgttacttagcgggtacggaccgtaaccgaacggtccggtccgttacggtttacgggtttaccttacgtaccgttccgtttctcgttcggtaccgttccggtacgttcggtaccggaccgtaaccggtacccgttccctccgtaacgaactacgtccgttcggtccgtccgtcggacgtcgtacgggaacggacggtacgggtacggttactttacgtttacggtgtttacgacgttaactgttacgaggggtcgttacgtacgtccgtttaagtcgtcgtttacgttccggttcggtcgggaacgggacgtaacncgtacgtacgtccgtaggtccgacgaccggacacgggttccctaccggtcccgttaggtcccttcccgtttccgccccgtaccccg

SEQ ID NO: 180705 - DNA, 829 bp, Homo sapiens
  misc_feature: GYAE6OF02HZQV4.12.5.A05.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
tcagatacgacgtacacgaccggtgctcgatttagatagatagacagggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccngcagtgacgttaangataaataatattctcctgtaccngcaacaccagcaaacgccccaaactcctcatttatcggtgtacgggtaatccggtcctcgtacggggtttactaagttcggtcttcgtacgtcggtctaccgtaacgtcgtacggaacgtaaaaaccgggtcccttaccccgttaaggaacccctaactttccgttaccgtttacggggaacccttacccgaacggtcccgtagggacggggaaccgggtacggggacccgtaaactttaacccgtaacgttacggaccgttaagttaccgtaccaaaccgtaacgaaacggaaacgggtaccgtaaccccgttacggttacgggggttacgtttaccggggtacggggaaccgggaaacccgtaaaaccggttaccggtaacccggttacccgttaaccggggtttaccgaaccgggtaacccccggtaaggggtaccccgttacccgggacccccccggttttaacccgggttacccgttaaacccccgttccgggttttaaccccggttttccccccgggtaccccccgtttcccttttaccccggtaaccggttttaaccccggg

SEQ ID NO: 180706 - DNA, 127 bp, Homo sapiens
  misc_feature: GYAE6OF01D2T07.53.61.F06.1.454.CMB.1.raw
  modified_base (126)..(127): a, c, t, g, unknown or other
  misc_feature (126)..(127): n is a, c, g, or t
tcagcgcgtatacacacgaccggtgctcgatttagctacgctctaagggaaaggggctggccctgacgtgtttctgttcccgccctcctctcgtactgcgctgagcgggctggcaaggcgcatagnn

SEQ ID NO: 180707 - DNA, 126 bp, Homo sapiens
  misc_feature: GYAE6OF02GM7HV.53.61.F06.1.454.CMB.1.raw
  modified_base (126)..(126): a, c, t, g, unknown or other
  misc_feature (126)..(126): n is a, c, g, or t
tcagcgcgtatacacacgaccggtgctcgatttagctacgctctaagggaaaggggctggccctagcgtgttcctgttcccgccctcctctcgtactgcgctgagcgggctggcaaggcgcatagn

SEQ ID NO: 180708 - DNA, 543 bp, Homo sapiens
  misc_feature: GYAE6OF01D6X0W.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttctcgcctggtaccagcagagacctggccaggctcccaggcctcctcatcgtttggtgccgtccaccgagggcccacgtggcactcccagactaggttcagtggcaggtgggtctgggacagtacttcactctcaccatcagcagacttgagcctagaagtatttgactagtatattactgtcagcaatatacgagacgtcacgtgtcgggtcgttcggaccgaacgggaccgaagggtaggtaaacgtacgaaacggtaacgtggtaggacgtacgacaccactcgtgttcc

SEQ ID NO: 180709 - DNA, 506 bp, Homo sapiens
  misc_feature: GYAE6OF01CVB2Z.34.38.D05.1.454.CMB.1.raw
  modified_base (260)..(260): a, c, t, g, unknown or other
  misc_feature (260)..(260): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
tcagtacacgtgatcacgaccggtgctcgatttagtatctgatagttgggaggcttagttcagcctggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctcagagacaacgccaagacacactanatctgcaaatgaacagtctgagagccgaggacacggctgtctattactgtgcaagaggtggctacaatcatggtttgatctctggggccaagggacaatggtcaccgtctcttcagcctcaccaagggcccatcggtcttccccctggcgccctgctctaggacgcacctccgagagcacagcggccctgggctgcctggtcaaggctacttccatcagtgtactgagcgggctggnaaggcgnag

SEQ ID NO: 180710 - DNA, 509 bp, Homo sapiens
  misc_feature: GYAE6OF01BEP6I.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggtgcgtccaccagggccactggcatcccagacaggttcagtgcagtggtctgggacagacttcactctcaccatcagcagacttgagcctgaagtattttgctagttatattactgtcagacaatatacgagacgcacgtgtgggcgttcggccgaagggaccgaaggtaggaaatacaaacgactgtggctgacaccatctgtc

SEQ ID NO: 180711 - DNA, 505 bp, Homo sapiens
  misc_feature: GYAE6OF01DKO37.34.38.D05.1.454.CMB.1.raw
  modified_base (485)..(485): a, c, t, g, unknown or other
  misc_feature (485)..(485): n is a, c, g, or t
  modified_base (501)..(505): a, c, t, g, unknown or other
  misc_feature (501)..(505): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattccaccccctccagagacaacgccaaagaacacactatatctgcaaatgaacagtctgagagccgaggacacggctgtctattactgtgcaagaggtggctacaatcatggttttgatctctgggccaagggacaatggtcaccgtctcttcagcctccaccaaggcccatccggtcttcccctggccgccctgctccaggagcacctccgagacgcacagcggccctgggctgcctggtcaggactacttccatcacgtgtactgacgcggntggcaaggcgcatagnnnnn

SEQ ID NO: 180712 - DNA, 515 bp, Homo sapiens
  misc_feature: GYAE6OF01ANJMN.34.38.D05.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (372)..(372): a, c, t, g, unknown or other
  misc_feature (372)..(372): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaangccacctctcctgcagggtcagtcagcgttctaacnccgattcttcgcctggtaccagcagagacctggccaggcctcccgaggcctcctcattcgtttggtcgccgtccaccgagggccactcggcacgtcccagactaggttcagtggcaggtggtctgggacngtacttcactctcaccatcagcagtacttgacgctagaagtattttgctagttgtacttactgtcaacgtgttcgtctcacacacgtgcgttcgacgacggacagtagaatacgaacgatgtgctgacacactntntctntac

SEQ ID NO: 180713 - DNA, 540 bp, Homo sapiens
  misc_feature: GYAE6OF01DXM7M.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggcctcccaggcctcctcattctttggtcgccgtccaccgagggccacgtggcatcccagacaggttcaggtggcaggtgggtctgggacagtaccttcacttctcaccatcagcagacttgacgcctagaagtattttgctaagttatatttactgtcagacaatatacgagacgctacgtggtcgggtcgttcgggaccgaagggaccgaaagggtaggaaatacgaaacgaacgtgtggctgacacctatctgtcc

SEQ ID NO: 180714 - DNA, 395 bp, Homo sapiens
  misc_feature: GYAE6OF01CTWDM.34.38.D05.1.454.CMB.1.raw
  modified_base (390)..(395): a, c, t, g, unknown or other
  misc_feature (390)..(395): n is a, c, g, or t
tcagtacacgtgatcacgaccggtgctcgatttagtatctgatagttgggtttgggggaagaggaagactgacacaatctacgcggactccgtgaagggccgattcacccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttcccctggcgccctgctccaggagcacctccgagagcacagcggccctgggctgcctggtcaaggactacttccatcacgtgtactgagcgggctggcaaggcgcatagnnnnnn

SEQ ID NO: 180715 - DNA, 517 bp, Homo sapiens
  misc_feature: GYAE6OF01CBRIZ.34.38.D05.1.454.CMB.1.raw
  modified_base (513)..(513): a, c, t, g, unknown or other
  misc_feature (513)..(513): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggcctcccaggcctcctcatctttggtgccgtccaccgagggccactggcatcccagacaggttcagtgcagtggtctgggacagacttcactctcaccatcaccagactggacgcctagaagtatttgcagtgtattactgtacaactagttgtctcacacacgtggacgttcggaccgaaggaccgaaggtgaaatacgaaacgacgtgtggctgacaccatctgtctcntccg

SEQ ID NO: 180716 - DNA, 534 bp, Homo sapiens
  misc_feature: GYAE6OF01B0A23.34.38.D05.1.454.CMB.1.raw
  modified_base (210)..(210): a, c, t, g, unknown or other
  misc_feature (210)..(210): n is a, c, g, or t
tcagtacacgtgatcacgaccggtgctcgatttagtatctgatagttgggtttggggagagaagagctgctcagtttagggacccagagggaaccatggaaacccccagcgcagcttctcttcctcctgctactctggctcccagatgcccccggagaaacttgtgttgacgcagtcgccagacaccctgtctctgtctccaggggaaanagccaccctctcctgcagggtcagtcagcgttctaacaccgacttcttcgcctggtaccagcagagacctggccaggctcccaggctcctcatctttggtgcgtccaccagggccacgtggcatcccagacaggttcagtggcagtggtctgggacaggacttcactctcaccatcagcagacttgacgcctgaagtattttgctagttatatttactgtcagacaatatacgagacgcattgtgggcgttcggaccgaacgggaccgaagggtaggaaacttacgaaacgtaactggtaggctggacaccattcgtcgttacc

SEQ ID NO: 180717 - DNA, 554 bp, Homo sapiens
  misc_feature: GYAE6OF01BKT9J.34.38.D05.1.454.CMB.1.raw
  modified_base (244)..(244): a, c, t, g, unknown or other
  misc_feature (244)..(244): n is a, c, g, or t
  modified_base (453)..(453): a, c, t, g, unknown or other
  misc_feature (453)..(453): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacnccgacttcttcgcctggtaccagcagagacctggccaggctcccgaggcctcctcattccgtttggtcgccgtccaccgagggccacgtggcatcccagacaggttcagtggcaggtggtctgggacagtacttcgactctcaccatcagcagtacttgacgtcctagaagtagttttagcgtagttattattactgtacagtacaatntacgagacgcacgtggtcggcgttcggacgaacgggaccgaagggtacggtaaacgtacgaaacggtacgtagtacggctacgacaacctatcgtgttacc

SEQ ID NO: 180718 - DNA, 644 bp, Homo sapiens
  misc_feature: GYAE6OF01BOTV1.34.38.D05.1.454.CMB.1.raw
tcagtacacgtgatcacgaccggtgctcgatttagtatctgatagttgggtttgggggagagaagagctgctccagttaggacccagagggaaccactggaaaccccagcgcagcttctcttcctcctgctactctggcttcccagatgcccccggagaaattgtgttgacgcagtcgccagacaccctgtctctgtctccagggaaagagccaccctctcctgcagggtcagtcagcgttctaacaccgacttctcgcctggtaccagcagagacctggccacggctcccaggctcctcatctttggtgccgtccaccgacggccacgtcggcacgtcccagaccaggttccaggtggctaggtgggtctagggacaggtacttcactctacaccactcacgcacgacgttgacgtcctagaagtagttttgactaagttacttatttacgtcgtactacggtactaagtagtacggaacgtaccggtaccgtaaccgttcgggttaccggggtaccggttaccggggacccgtaaacggggaaccctaaaggggttacgggaaaacttaccggaaaaccggtaacggttacggtacgggtaccctacggtaccctaaccgttcgttcccgttagttaccccg

SEQ ID NO: 180719 - DNA, 520 bp, Homo sapiens
  misc_feature: GYAE6OF01DHVA1.34.38.D05.1.454.CMB.1.raw
  modified_base (489)..(489): a, c, t, g, unknown or other
  misc_feature (489)..(489): n is a, c, g, or t
  modified_base (514)..(517): a, c, t, g, unknown or other
  misc_feature (514)..(517): n is a, c, g, or t
  modified_base (519)..(520): a, c, t, g, unknown or other
  misc_feature (519)..(520): n is a, c, g, or t
tcagtacacgtgatcacgaccggtgctcgatttagtatctgatagttgggtttgggggtcccggagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctcagagacaacgccaagaacacactatatctgcaaatgaacagtctgagagccgaggacacggctgtctattactgtgcaagaggtggctacaatcatggttttgatctctggggccaagggacaatggcaccgtctcttcagcctccaccaagggcccatccggtccttcccctggccgccctgcctcccaggacgccaccctccgagacgcacgagccggcctgggctgccgtggtacgaacggaccttactccatcacgttgtacngagcgggctgggcaggcgcagtagnnnngnn

SEQ ID NO: 180720 - DNA, 255 bp, Homo sapiens
  misc_feature: GYAE6OF01AYN3K.34.38.D05.1.454.CMB.1.raw
  modified_base (253)..(255): a, c, t, g, unknown or other
  misc_feature (253)..(255): n is a, c, g, or t
tcagtacacgtgatcacgaccggtgctcgatttagtatctgatagttgggtctgggacagacttcactctcaccatcagcagacttgagcctgaagattttgcagtatattactgtcagcaatatcgagacgcactgtgggcgttcggccaagggaccaaggtggaaatcaaacgaactgtggctgcaccatctgtcttcatcttcccgccatctgaatcacgtgtactgagcgggctggcaaggcgcatagnnn

SEQ ID NO: 180721 - DNA, 506 bp, Homo sapiens
  misc_feature: GYAE6OF01DLGU0.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggtgcgtccaccagggccactggcatcccagacagttcagtggcagtggtctgggacagacttcactctcaccatcagcagactgagctgaagtatttgcagtatattactgtcagcaatatcgagacgcactgtgggcgttcggccgaagggaccgaaggtggaaacgtacgaaacggacgtagtggctgacacatcgtgtc

SEQ ID NO: 180722 - DNA, 160 bp, Homo sapiens
  misc_feature: GYAE6OF01C7ADX.34.38.D05.1.454.CMB.1.raw
  modified_base (155)..(160): a, c, t, g, unknown or other
  misc_feature (155)..(160): n is a, c, g, or t
tcagtacacgtgatcacgaccggtgctcgatttagtatctgatagttgggtttgggggaagaggaagactgacggtcctagcacagcggccctgggctgcctggtcaaggactacttccatcacgtgtactgagcgggctggcaaggcgcatagnnnnnn

SEQ ID NO: 180723 - DNA, 543 bp, Homo sapiens
  misc_feature: GYAE6OF01D0T5B.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggcctcccaggcctcctcattcgtttggtcgccgtcccgaccccgggccacgtggccactccccagacaggttcaggtggcaggtgggtctggggacagcttcactctcaccatcagcagacttgagcctagaagtatttgctagtattattactgtcagacaatatcgagacgctacgtggtgggtcgttcggaccgaagggaaccgaagggtaggaaagtaccgaaacgaacgtggtggctacgacaccatctgtcttac

SEQ ID NO: 180724 - DNA, 403 bp, Homo sapiens
  misc_feature: GYAE6OF01EHSIA.34.38.D05.1.454.CMB.1.raw
  modified_base (399)..(403): a, c, t, g, unknown or other
  misc_feature (399)..(403): n is a, c, g, or t
tcagtacacgtgatcacgaccggtgctcgatttagtatctgatagttgggtttcacgtattacgagtgatgggactgacacaatctacgcggactccgcgaagggccgattcaccccctccagagacaacgccaagaacacactatatctgcaaatgaacagtctgagagccgaggacacggctgtctattactgtgcaagaggtggctacaatcattggttttgatctctggggccaagggacaatggtcaccgtctcttcagcctccaccaagggcccatcggtcttccccctggcgccctgctccaggagcacctccgagagcacagcggccctgggctgcctggtcaaggactacttccatcacgtgtactgagcgggctggcaaggcgcatagnnnnn

SEQ ID NO: 180725 - DNA, 575 bp, Homo sapiens
  misc_feature: GYAE6OF01BA4SJ.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagagccaccctctcctgcagggtcagtcagcgttctaacaccgacttcttcgcctggtaccagcagacgacctggccaggcctcccaggcctcctcattcgtttggtcgccgtccaccgagggccacgtggcactcccagacaggttcagtggcaggtgggtctgggacagtacttcactctcaccatcagcagtacttgacgctagaagtatttgactagtattattactgtacagtactaatagtacgagacgtacgtacgttggtcgggtccgttacgggaccgtaacgggaccgtaagggtacggaaacgtacgaaaacggtaacgtacggtacggacgtacgactaacctacgttcgttgttacc

SEQ ID NO: 180726 - DNA, 519 bp, Homo sapiens
  misc_feature: GYAE6OF01DKE07.34.38.D05.1.454.CMB.1.raw
  modified_base (306)..(306): a, c, t, g, unknown or other
  misc_feature (306)..(306): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggngcgtccaccagggccactggcatcccagcaggtcagtggcagtgggtctgggacagacttcactctcaccatcagcagacttgagcctgaagtattttgctagttatattactgtcagacaatatcgagacgtcactgtgggcgttcggacctaagggaccgaagggtaggaaactacgaaacgacgtaggtggacgtgacaccatcgtgtcc

SEQ ID NO: 180727 - DNA, 499 bp, Homo sapiens
  misc_feature: GYAE6OF01BJZJ3.34.38.D05.1.454.CMB.1.raw
  modified_base (409)..(409): a, c, t, g, unknown or other
  misc_feature (409)..(409): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
  modified_base (496)..(499): a, c, t, g, unknown or other
  misc_feature (496)..(499): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctcagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaaggcccatcggtctcccctgccgcctgctccaggcncacctccgagacgcacacgccggccctgggctgcctggcaaggctacttccatcacgtgtacngagcgggntgggcaggcncatagnnnn

SEQ ID NO: 180728 - DNA, 570 bp, Homo sapiens
  misc_feature: GYAE6OF01A2EL7.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgtacttcttcgcctggtaccagcagacgacctggccaggcctcccgaggcctcctcattccgtttgggtcgccgttcccaccgacggggcccacgtggcactccccagacctaggttcaggtggcaggtgggtctgggacagtacttcactctcacatcagcagacttgacgtcctagaagtatttgactagttattattactgtacagactaatactacgagacgtactacgtggtcgggtcgttacggaccgtaacgggaccgaaggtaggaaactacgaaacggtacgtaggtacggacgtacgacaccgatcgtgttacc

SEQ ID NO: 180729 - DNA, 527 bp, Homo sapiens
  misc_feature: GYAE6OF01EK70S.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggtgcgtccaccagggccactggcatcccagacaggttcagtggcagtgggtctgggacagacttcactctcacatcagcagacttgacgtcctagaagtattttagctagttattattactgtacagacaatatacgtagacgtcacgttggtcgggcgttcggccgaagggaccgaagggtacggaaagtacaaacgaactgtaggctcgacaccatctgtc

SEQ ID NO: 180730 - DNA, 552 bp, Homo sapiens
  misc_feature: GYAE6OF01ACVKK.34.38.D05.1.454.CMB.1.raw
  modified_base (308)..(308): a, c, t, g, unknown or other
  misc_feature (308)..(308): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggcctcccaggctcctcatcgtttggngcgtccaccagggcccactggcatccccagaccaggttcaggtggcaggtcgggtctgggacaggtacttcactctcaccatcagcagacttgagtcctagaagtatttgctagtatattactgtacagacaatatacgacgacgtcgacgtggtcgggtcgttacggccgaagggaccgaagggtacggaaacgtacgaaacggacgtaggtacggcgtacgacaaccgacttcgtcgttccg

SEQ ID NO: 180731 - DNA, 254 bp, Homo sapiens
  misc_feature: GYAE6OF01BH8GV.34.38.D05.1.454.CMB.1.raw
  modified_base (253)..(254): a, c, t, g, unknown or other
  misc_feature (253)..(254): n is a, c, g, or t
tcagtacacgtgatcacgaccggtgctcgatttagtatctgatagttgggtctgggacagacttcactctcaccatcagcagacttgagcctgaagattttgcagtatattactgtcagcaatatcgagacgcactgtgggcgttcggccaagggaccaaggtggaaatcaaacgaactgtggctgcaccatctgtcttcatcttcccgccatctgaatcacgtgtactgagcgggctggcaaggcgcatagnn

SEQ ID NO: 180732 - DNA, 558 bp, Homo sapiens
  misc_feature: GYAE6OF01A18C1.34.38.D05.1.454.CMB.1.raw
  modified_base (337)..(337): a, c, t, g, unknown or other
  misc_feature (337)..(337): n is a, c, g, or t
tcagtacacgtgatcacgaccggtgctcgatttagtatctgatagttgggaggcttagttcagcctggggggtccctgagactctcctgtgcagcctctggattcaccttcagtagtcactggatgcactgggtccgtcaagttccagggaagggctggtgtgggtttcacgtattacgagtgatgggactgacacaatctacgcggactccgtgaagggccgattccaccccctcagagacaacgccaagaacacactatatctgcaaatgaacagtctgagagccgaggacacggctgtctattactgtgcaagaggtgctacaatcatggtttnatctcgtggggccaagggacaagtcggtcaccgtctcttcacgtccctaccaccgaacgggcccagtccggtccttcccccgtggcccgccctcgcctccgaggcgccaccgtccgagacgcacgacgccggcccgtgggctcggccgtggtaccaacggtacctaccttccagtccgacgttcgtacgtcgacggccgggtctcggacgaacggcgcgag

SEQ ID NO: 180733 - DNA, 256 bp, Homo sapiens
  misc_feature: GYAE6OF01AJA4M.34.38.D05.1.454.CMB.1.raw
  modified_base (253)..(256): a, c, t, g, unknown or other
  misc_feature (253)..(256): n is a, c, g, or t
tcagtacacgtgatcacgaccggtgctcgatttagtatctgatagttgggtctgggacagacttcactctcaccatcagcagacttgagcctgaagattttgcagtatattactgtcagcaatatcgagacgcactgtgggcgttcggccaagggaccaaggtggaaatcaaacgaactgtggctgcaccatctgtcttcatcttcccgccatctgaatcacgtgtactgagcgggctggcaaggcgcatagnnnn

SEQ ID NO: 180734 - DNA, 155 bp, Homo sapiens
  misc_feature: GYAE6OF01A424A.34.38.D05.1.454.CMB.1.raw
  modified_base (154)..(155): a, c, t, g, unknown or other
  misc_feature (154)..(155): n is a, c, g, or t
tcagtacacgtgatcacgaccggtgctcgatttagtatctgatagttgggtttgggggaagaggaagactgacggtcctagcacagcggccctgggctgcctggtcaaggactattccatcacgtgtactgagcgggctggcaaggcgcatagnn

SEQ ID NO: 180735 - DNA, 524 bp, Homo sapiens
  misc_feature: GYAE6OF01BNG7V.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccacctctcctgcagggtcagtcagcgttctaacaccgacttcttcgcctggtaccagcagagacctggccaggctcccaggcctcctcatctttggtgcgtccaccaggccactggcatcccagacaggttcagtggcaggtgggtctgggacagacttcgactctcaccatcagcagacttgagcctgaagtattttgctagttattattactgtcagcaatatacgagacgcactggtgggcgttcggccgaagggaccgaagggtacggaaagtacgaaacggaactaggtaggctacgacaccatcgtgtc

SEQ ID NO: 180736 - DNA, 512 bp, Homo sapiens
  misc_feature: GYAE6OF01BLG5C.34.38.D05.1.454.CMB.1.raw
  modified_base (206)..(206): a, c, t, g, unknown or other
  misc_feature (206)..(206): n is a, c, g, or t
  modified_base (482)..(482): a, c, t, g, unknown or other
  misc_feature (482)..(482): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgacttcttcgcctggtaccagcagagacctggccaggctcccaggctcctcatctttggtgcgtccaccagggccactggcatcccagacaggttcagtggcagtgggtctgggacagacttcactctcaccatcagcagacttgagcctgaagtattttgctagtatattactgtcagcaatatacgagacgcactgtgggcgttcggccgaagggaccaaagggtaggaaatanaaacgaactagtaggcgtgcaccatctgtc

SEQ ID NO: 180737 - DNA, 532 bp, Homo sapiens
  misc_feature: GYAE6OF01BPQ56.34.38.D05.1.454.CMB.1.raw
  modified_base (206)..(206): a, c, t, g, unknown or other
  misc_feature (206)..(206): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgacttcttcgcctggtaccagcagagacctggccaggctccaggctcctcatctttggncgtccaccaggccactggcatcccagacaggttcagtgcaggtggtctgggacngacttcactctcaccatcagcagacttgagcctagaagtattttgactagttatattactgtcagacaatatacgagacgtcacgttgtcgggtcgtcggccgaacgggtaccgaagggtacggaaactacgaaacggtacgtaggtagacgtacgacaaccatcgtgttacc

SEQ ID NO: 180738 - DNA, 524 bp, Homo sapiens
  misc_feature: GYAE6OF01EHJIU.34.38.D05.1.454.CMB.1.raw
  modified_base (306)..(306): a, c, t, g, unknown or other
  misc_feature (306)..(306): n is a, c, g, or t
  modified_base (407)..(407): a, c, t, g, unknown or other
  misc_feature (407)..(407): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggngccgtccaccgagggccactggcatcccagacaggttcagtggcaggtgggtctgggacagacttcactctcaccatcagcagacttgacgcctagaagtnttttgctagtatattactgtcagcaatatacgagacgcacgtgtgggtcgttcggaccgaacgggaccgaaggtaggaaactacgaaacgaacgtgtaggcgtagaccacatctgtc

SEQ ID NO: 180739 - DNA, 554 bp, Homo sapiens
  misc_feature: GYAE6OF01CBK6D.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaangccaccctctcctgcagggtcagtcagcgttctaacaccgacttcttcgcctggtaccagcagagacctggccaggcctcccaggctcctcatctttggcgcgtccacagggccacgtggcatccccagactaggttcagtggcaggtggtctgggacagacttcactctcaccatcagcagacttgacgcctagaagtatttgactagtatattactgtcagcaatactacgagacgtcacgttggtgggtccgttacggaccgaaagggaccgtaaagggtacggtaaactacgaaaacggtaacgtggtacggaccgttaggacccaacctacttccgtgttacc

SEQ ID NO: 180740 - DNA, 655 bp, Homo sapiens
  misc_feature: GYAE6OF01DL1MQ.34.38.D05.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (284)..(284): a, c, t, g, unknown or other
  misc_feature (284)..(284): n is a, c, g, or t
tcagtacacgtgatcacgaccggtgctcgatttagtatctgatagttgggtttggggagagaagagctgctcagttaggacccagagggaaccatcggaaaccccagcgcagcttctcttcctcctgctactctggctccagatcgccccggagaaattgtgttgacgcagtcgccagaccaccctgtctcgtgtctaccggaaggggaaancgcccacctctccgngcgagggtcagtcagtcgttacaacaccgtacttcttcgctggtaccagcagacgcngccaggcctccgaggtcctcctcactttcgttggtcgccgttaccaccgagggccctagtcggacacgtcccaagacgtaggttccaggtcggcgtaggtcgggtcgtgggaactacgtactttccacttctcaaccctatcgagctagtacgttagactacgtagtaatcgtttagactagttattaagtttactacgttacgagtacctaaattacgacgaacgtaccgtacgtaaccggtggttaccgggtacggttaccggaaccggtaaacgggtaacccggtaaagggttaacggaaacgtaaccggaaaacggtacgtacggtacggtacgtaccggaccaaccgtacttcgtcggtttaaccc

SEQ ID NO: 180741 - DNA, 541 bp, Homo sapiens
  misc_feature: GYAE6OF01C6C9C.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagagccaccctctcctgcagggtcagtcagcgttctaacaccgacttctcgcctggtaccagcagagacctggccaggctcccaggcctcctcatctttggcgcgtccaccgagggccacgtggcactccccaagacaggttcaggtggctaggtgggtctgggacagtacttcactctcacatcagcagtacttgacgtcctagaagtatttgactagtatattactgtcagtctaatatacgagacgtcacgtggtcgggcgttcggaccgaacgggaccgaagggtaggtaaactacgaaacgacgtggtgactcgacacgtatcgtgttacc

SEQ ID NO: 180742 - DNA, 604 bp, Homo sapiens
  misc_feature: GYAE6OF01DMUG1.34.38.D05.1.454.CMB.1.raw
  modified_base (418)..(418): a, c, t, g, unknown or other
  misc_feature (418)..(418): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaaggggaaagacgccaccctctcctgcagggtcagtcagtcgttctaacaccgacttcttcgcctggtacccagcaggacgacctggccaggcctcccagacgtcctcatctatcgcctacactccaccacgggccactgcctatccagccaggttcaggtgctaggtggcgtggacagcgttcactcacacatcagccacgtctgctagtcgtagaatnttcctgacttaacttttatactgacaggactagttacttaaagtacggttcggtaccggttaggtaccggttacccggacggtaaacggggtaacccgaaaggggttaacggtaaactaaccgaaaaccgggttaaccgttagggtacggtaccttacggaccctaacctacgtttcgttacccgg

SEQ ID NO: 180743 - DNA, 592 bp, Homo sapiens
  misc_feature: GYAE6OF01DTNWD.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanacgccaccctctcctgcagggtcagtcagcgttctaacaccgacttcttcgcctggtaccagcagacgacctggccaggcctcccaggcctcctcattcgtttggcgccgtccaccgagggcccacgtcggcactccccaagactaggttcaggtggcaggtgggtctgggacagaccttcactctcaccatcagcagtacttgacgtcctagaagtatttcgactagttactattactgtacagtactaatagtcgaagaccgctacgttgggtacgggtccgttacgggaccgaaacggggaaccgtaaaggggtacggaaaactacgaaaacggtacgttacggtacggacgttcggacccacctacgttccgttggttaccc

SEQ ID NO: 180744 - DNA, 554 bp, Homo sapiens
  misc_feature: GYAE6OF01CRWVT.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagagccaccctctcctgcagggtcagtcagcgttctaacaccgacttctcgcctggtaccagcagagacctggccaggcctcccgaggcctcctcatctttggcgccgtcccaccgagggccacgtcggcactccccagaccaggttcaggtggcaggtcgggtccggacagacttcactctcaccatcagcagtacttgacgccgtagaagtatttgctagtattattactgtcagactaatagtacgagacgctacgtggtcgggcgttcggaccgaacgggaccgaagggtaggaaacgtacgaaacgtaacgtcggtacggcgtacgaccacctatctgtcttac

SEQ ID NO: 180745 - DNA, 760 bp, Homo sapiens
  misc_feature: GYAE6OF01CY1EF.34.38.D05.1.454.CMB.1.raw
  modified_base (152)..(152): a, c, t, g, unknown or other
  misc_feature (152)..(152): n is a, c, g, or t
tcagtacacgtgatcacgaccggtgctcgatttagtatctgataggttggggttggggagagaagagctgctcagttaggacccagagggaaccataggaaaaccccagcgcagcttctctttcctcctgctacctcgtggcctacagtacnccggacccggaagtaacgttggtcgtacggaccgcgacggtccgaccgacggtacccgtacccggtctcgtcgttcgtccgacgggacggaacgacggtccaccctccttcctcggacgggccgtcgtacgtacgagttagttacgtacgcctaccttactttcgtccggtcggttaggtactacgaacgaaccggaaaaccgtacgggtccggtcgtcgggacccgaccggtagtccctacgtaactacttactaacggtacgccgtactaagtaccggaccggtaccggtacctacgggtccgacccgaccgaaggtaccggttacggacgtacgggcgacggttagggtcggcggtggactacgtcgtactcctacgtacactcgtaccacggacgtacggacgtaccgtagttaagtagttttagaccgaggttaaggttaacttacttacgtacgtaactaacggttgttaccgtaccgctaaccggtcgtaacgggttcggttaaccggcgtaaaaccggggtcgaacggtacggtaacgttaaaccgaacgtacgggacgttcggtaccgtctaccgtaccagtccttcgtcctcggtacc

SEQ ID NO: 180746 - DNA, 726 bp, Homo sapiens
  misc_feature: GYAE6OF01BW13C.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaangccaccctctcctgcagggtcagtcagtcgttctaacaccgtacttctcgcctggtaccagcagacgacctggccaggcctcccgaggtcctcctcattcgtttggcgccgtcccgaccgacgggccctacgtcggccacgtccccgagaccgtacggttccaggtcggacgtagggttcgggtccgtaggggacctaacggtaccctttccgaaccttccgtaccaacccgtagtaccgacggtaccgaacgtacgtttacggacgtacccgttaggtaaacgttacgtttttacgacgttaagtttaacttaacgtttacgttacgttaccgtaagtaacctaaagttacgtaaccggaacgtaccgtacgtacggttacgggttacggggtaccggttaccgggaacccgaaacggggtaacccgtaaaggggttaacggtaaaaccgttaaccgaaaaccggtacgttacggtacggtacgtacgacccgtaaccgtacgttccgttcgttacccg

SEQ ID NO: 180747 - DNA, 678 bp, Homo sapiens
  misc_feature: GYAE6OF01DMW7Z.34.38.D05.1.454.CMB.1.raw
  modified_base (343)..(343): a, c, t, g, unknown or other
  misc_feature (343)..(343): n is a, c, g, or t
  modified_base (673)..(674): a, c, t, g, unknown or other
  misc_feature (673)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
tcagtacacgtgatcacgaccggtgctcgatttagtatctgatagttgggtttgggggtccctgagactctcctgtgcagcctctggattcaccttcagtagtcactggatgcacgtgggtccgtcaagttccgagggagggctggtgtggttcacgtattacgagtgagtgggactgacacaatctacgcgactcgtgacggccatccacccctcagacgacaacgcaaagaacacactatatctagacaaatagaacagtcagacgacgccgaggaccacggtctgtactattacgtgtacgacgaaggtggtcgacctaacaatctagtttgggttttanacgttccgtacggtacggggaaccgaaaggggaactaacggtcgggtacctaccggttctaccgtcgaccgtccctacccgaacccggaacggtcccctacgttcccggtccccttcccggcggccctcccgtgccctacgaacggaccgtcccgaccgtacccggaagaccgccgaaccggccgggtccccgggccgtcggggcccttaccggccccggttacgggtaaccgtaaacgttacccttaccgtacccacgttaccggtacgttacccgtacgggagggaccgggtccgggcgtacgggaccgacgggccacgtaaggcganngngn

SEQ ID NO: 180748 - DNA, 538 bp, Homo sapiens
  misc_feature: GYAE6OF01CXNV7.34.38.D05.1.454.CMB.1.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatcgcccccggagaaattgtgttgacgcagtctccaggcaccctgtctttgtctccaggggaaanagccacctctcctgcagggccagtcagagtgttaatagcatctacttagctggtaccagcagaacctggccagcctccagactcncattaatgtgcatacctacgacgggcccctggcactcccagacaggttcagtggctaggtggtctgggacagtacttcactctacaccatccacagactggagtactgaagtatttgctagtgttattactgtacaacgtgttcgtctacactacgacgtggtacgttcggacgaacggacgaggtaagaaatacgaaacgtacgtgtaggtctagtaccactactctagtcttcgtacgtcccg

SEQ ID NO: 180749 - DNA, 556 bp, Homo sapiens
  misc_feature: GYAE6OF01CBJ63.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaangccaccctctcctgcagggtcagtcagcgttctaacaccgacttcttcgcctggtaccagcagagacctggccaggctcccaggctcctcatctttggtcgcgtccaccgagggccactggcatcccagacaggttcagtggcaggtgggtctgggacagacttcactctcaccatcagcagacttgacgcctagaagtatttgactagttatatttactgtcagactaatatacgagacgactacgtggtcgggtcgttcgggaccgaaacgggaccgaaagggtacggtaaacgtacgaaaacggtaacgtacggtaggaccgtacgaccaaccacttccgtgttacc

SEQ ID NO: 180750 - DNA, 664 bp, Homo sapiens
  misc_feature: GYAE6OF01CGKPU.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgacgcagtcgccagaccaccctgtctctgtctccgagggaangccaccctctcctgcgagggtcagtcagtcgttactaaccaccgtactttccgtccgccttggtacccagcaggacgacctggcccaggcctcccgaggtcctccctctagtttccgttttgggtacgccgtacccaccggacgggtcccaacgtcggccaacgtccccgaaggaccgtaggttccaggtcgggactagggttcggggtcgtagggaactaggtaccttccaacgttcctccaaccgtataccacgacgtacgtacgttagacgtacccgtagtaagttacgttttagactaagttaattacgtttactgtacgacgtaactaattagtacgagtaccgtacgtacgttggtcgggtacgtccggaccgtaacgggaaccgtaaggtaacggtaaacgtagaaacgtacgtcgtaggccgtacggacctaacgtcttcgtcgttaccg

SEQ ID NO: 180751 - DNA, 554 bp, Homo sapiens
  misc_feature: GYAE6OF01BCOVW.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctccccaggcctcctcatcgtttggtcgccgtccaccgagggcccactggcatcccagacaggttcagtgcagtgggtctgggacagtacttcactctcaccatcagcagactgacgctagaagtatttgactaatttatactgtcagtctgcgtagactaacgtcggtccttccgttgacgtccgtccgttcggacccggtacgggaccgacggacgtaggaagtaacgttaaacgtaacgtggtacggcgttagcctaaccgtgttccg

SEQ ID NO: 180752 - DNA, 757 bp, Homo sapiens
  misc_feature: GYAE6OF01B47NU.34.38.D05.1.454.CMB.1.raw
  modified_base (207)..(207): a, c, t, g, unknown or other
  misc_feature (207)..(207): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagngccaccctctcctgcagggtcagtcagtcgttactaacaccgtacttcttcgcctggtaccagcagacgacctggccaggcctcccgaggcctccgtcattcgtttgggtcgccgtacccaccgtagggccctactgggaccacgtccccaaggtaccgtagggtttcaaggttcggcctaagggttcggggtcctagggggaacctaacggtacctttccgaaccgttccttacaaccccgtagttaccgaacggtactaacggttaccgtttaggaacggtaccccgttaggtaaaacggtttaacgttttttacggaccgttaaaggtttaacgttaacgtttaaccggttacggttacgaacggtaacctaaagttaacgtaccggaacgtaccgtaccgtaacggttggtacgggtccggttacgggaacccggtaaacggggtacccgtaaagggtaacggtaaacgttaaccgaaaacggttaaacgttgggtaaccggtacgtaccggtaccgtaacctaacgttccgttcggtttaacccg

SEQ ID NO: 180753 - DNA, 620 bp, Homo sapiens
  misc_feature: GYAE6OF01B90GN.34.38.D05.1.454.CMB.1.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
  modified_base (616)..(620): a, c, t, g, unknown or other
  misc_feature (616)..(620): n is a, c, g, or t
tcagtacacgtgatcacgaccggtgctcgatttagtatctgatagttgggtttgggggtccctgagactctcctgtgcagcctctggattcaccttcagtagtcactggatgcacgtgggtccgtcaagttccagggagggctggtgtggttcacgtattacgagtgatggactgacacaatctacgcggactccgngaaggccatcacccctcaganacaacgccaaagaacacactatatctagacaaaatgaacagtctagagagccgaggacacggntgtctatacgtgtgcaagaggtgactaacaatcaagttgggttttagattcgtcggtacgggggaccaaaggggaactaaagttcgggtaccaaccgttctaccgttcacgccctaccgaacccgaacgggtcccagttcccggttcccttcccccgtcggcccgtccctcggtccctcccgaaggacgccgaaccgtccggaagacgcacgacggccggcccgtcgggctacggccgtcggtaacgaaacggtaccttaccgttacccacgtcgtacggtcgttaccgtaggacgggtccgggcgtcgggaccgaacgggcgaccgaatacggnnnnn

SEQ ID NO: 180754 - DNA, 591 bp, Homo sapiens
  misc_feature: GYAE6OF01B53G0.34.38.D05.1.454.CMB.1.raw
  modified_base (420)..(420): a, c, t, g, unknown or other
  misc_feature (420)..(420): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagcgccaccctctcctgcagggtcagtcagcgttctaacaccgacttctcgcctggtaccagcagacgacctggccaggcctcccaggcctcctcattcgtttggtcgccgtcccaccgacgggccacgtggcactcccagacctaggttcagtggctaggtcggtctgggacagtacttcactctcacatcagcagtacttgacgctagaagtntttgactagttatattactgtacagtactaatacgtacgaacgacgtacacgtggtacgggtccgttaccggaccgtaaacgggtaccgtaaagggtacggaaaacgtacgaaaacggtacgtagggttacggacgtacgaccgtaacccgtactttccgtttcgttaccg

SEQ ID NO: 180755 - DNA, 577 bp, Homo sapiens
  misc_feature: GYAE6OF01CXSFF.34.38.D05.1.454.CMB.1.raw
  modified_base (244)..(244): a, c, t, g, unknown or other
  misc_feature (244)..(244): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgagggaaagagccaccctctcctgcagggtcagtcagcgttctaacnccgacttctcgcctggtaccagcagagacctggccaggcctcccaggctcctcatcgtttggcgtccgtcccaccgagggccacgtggacactcccgagacaggttcaggtgctaggtggtctgggacagtacttcactctcaccatcagcagtacttagacgtccttagaacgtattttgactaagttataattactgtacagactaatagtacgaagacgtacgtacgttggtcgggtacgttccggaccgtaaacggggaccgaaagggtaggaaacgtacgaaaccggtaacgtcggtacggtacgtacgactacctatcgttgttacc

SEQ ID NO: 180756 - DNA, 593 bp, Homo sapiens
  misc_feature: GYAE6OF01BUKKJ.34.38.D05.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatatcaccggagaaattgtgttgacacagtctccaggcaccctgtctttgtctccgaggggaancgccacctctcctgcagggccagtcagagtgttaatagcatctacttagcctggaccagcaagaacctggccagcctcccagactcctacattanggtnactatactacgacgggcccctaggccactacccagactaggttcaggtcggctaggtggtctgggacaggtaccttcacttcgtacaccatacaccgagacgttacggacgtcctagaagttacttttggactagttcgttaatttacgtgtactaacgtgttacggtccttacactacgtacggtacggtacggttccggacgtaacggaaccgtaagggtacgaaaacgttacgaaacggtaattggtacgggctacgactaaccgtattactcgttccttcgtacg

SEQ ID NO: 180757 - DNA, 665 bp, Homo sapiens
  misc_feature: GYAE6OF01B1035.34.38.D05.1.454.CMB.1.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
  modified_base (324)..(324): a, c, t, g, unknown or other
  misc_feature (324)..(324): n is a, c, g, or t
  modified_base (337)..(337): a, c, t, g, unknown or other
  misc_feature (337)..(337): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagaaattgtgttgacgcagtcgccagaccaccctgtcctctgtctccgaggggaaanacgccctaccctctcctgcagggtcagtcagtccgttacaacaccgacttcttcgcctggtaccngcagagacctggccaggcctccccgaggtccttacctcatttcgtttggtnaccgtccaaccgnggcccactgggcctaactcccgagtaaccgtggttccaggtgcgagtcgggtcngggaccngaccgtttacacgtctaccaacgtatccagcacgtacttcgacgcgttagaacgttaattttggacctaagtttattacgttacgtagtaccaagtaccctaaagttagacggtaacgaacgtaccgtacgttacgggtacggggtaccgttacggaacccggtaaacggggaaaccccgtaagggtaaacggtaaaaccgtaacggaaaacccgtacggttagtacgggtaccgtacgacccaacgtacgttcgttcgttaacccg

SEQ ID NO: 180758 - DNA, 755 bp, Homo sapiens
  misc_feature: GYAE6OF01EHUIV.34.38.D05.1.454.CMB.1.raw
  modified_base (313)..(313): a, c, t, g, unknown or other
  misc_feature (313)..(313): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgagggaaagagccaccctctcctgcagggtcagtcagcgttctaacaccgacttcttcgcctggtaccagcagacgacctggccaggcctcccgaggcctcctcattcgtttggngtccgtccacccgagggcccacgtcgggacctacgtccccgaagtaccgtacgggttcaaggtcggccgtaaggttcggggtcgtagggaacctaaggtaccttccgaccttccgttaccaacccgtattaccgaacggtaccgtaacggtaacctttcgggaacggttaccccgttaagggtaaacggtttactttttacggacgttaacggtttaatttaaacgttttaccgttaggttacctaacggtactaaacgttacgttaccggaacggtaccgtacttaacggttcgggtcggggttaccggttaccggggaacccgtaaacgggggtaacccggtaaaggggttaacggtaaaacgttaaccgaaaaacgggttaaccgttacgggttacggaccgttacggacctaacccgttacgttccgttcggttaccc

SEQ ID NO: 180759 - DNA, 551 bp, Homo sapiens
  misc_feature: GYAE6OF01BAJDT.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgacttcttcgcctggtaccagcagagacctggccaggcctcccaggctcctcattctttggtgccgtccaccgagggccactggcatcccagacaggttcagtggcagtggtctgggacagacttcactctcaccatcagcagacttgagcctagaagtattttgctagtattattactgtcagactaatatacgagacgctacgtggtcgggtcgttcgggaccgaacgggtaccgaagggtaggtaaacgtacgaaaacggtaacttaggtaggacgttacgaccaaccacttcgttcgttcc

SEQ ID NO: 180760 - DNA, 620 bp, Homo sapiens
  misc_feature: GYAE6OF01C1OIR.34.38.D05.1.454.CMB.1.raw
  modified_base (405)..(405): a, c, t, g, unknown or other
  misc_feature (405)..(405): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatactactggagaaatagtgatgacgcagtctccagccaccctgtctgtcgtccccaaggggaaagagccatcctctcctgcagggccagtcagagtattagcacaacttagcctggtaccagcaagaaacctggccagactcccaggctcctcatctatggtgcatccaccgagggcccacgtcggtactcccgaggctaaggttcaggtcggctagggtcgggtacgtgggactagacgttcactctcacatcagcagtcngcagtctagagtatttgctagtttatactgtacagtcaacttaataacgtaacgtcggacccttaccggacttacccgaacccgtttaccgggaacccgtaaacggggtacccgtaaaccggtaacgttaacggggaaacggttaaaccgtttaaaaaccgggaacgtttcggggtaacggtacctttacgggaacccttaacccgggttaaccg

SEQ ID NO: 180761 - DNA, 667 bp, Homo sapiens
  misc_feature: GYAE6OF01DNA2H.34.38.D05.1.454.CMB.1.raw
  modified_base (661)..(661): a, c, t, g, unknown or other
  misc_feature (661)..(661): n is a, c, g, or t
  modified_base (663)..(664): a, c, t, g, unknown or other
  misc_feature (663)..(664): n is a, c, g, or t
  modified_base (666)..(667): a, c, t, g, unknown or other
  misc_feature (666)..(667): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattccaccccctcagagacaacgccaagaacacactatatctgacaaatgaaacagtctgagagccgaggacacggctgtctattactgtgcaagaggtggctacaatcattggttttgatctcgtggggaccaagggacaagtcggtacaccgttctcttcacgtccctacccaacccgaacgggcccctaacgttcccggttaccctttccccccgtcggcccctaacccccttcccctacccgaaacgacgacccgtacccgtccgggtcgggggacccaaccgaccgggcccggccccggttcggggccttcggcccgttcgggtaccgaaacgggtacccttaaccgttaccctacgttacccgtaccggttggttaacccgtgggaccggcccgggggtccgttcggggaccggtaaacgggccggtaccgaacgttacgcgangnngnn

SEQ ID NO: 180762 - DNA, 854 bp, Homo sapiens
  misc_feature: GYAE6OF01AZLF9.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaaattgtgttgacgcagtcgccagacaccctgtctctgtctccgaggggaaagagccaccctctcctgcagggtcagtcagcgttctaacaccgacttcttcgccttggtaccagcagacgacctggccaggcctcccgaggtcctccgtctattccgtttggtcgccgtccgaccgtacgggcccacgtcggaccactccccgagacgtaggtttcgaggtggcgtagggtcgggtactggggactacgtaccttcgacttctaccgaacctatccgagaccgtaacgacgtttcggacgtacccgttaggtaaacgttacgttttacggacgttaaggtttacgttaacgttttaaccggttacgttaaccgtaaacgtttacgggtttaacggggttaccccttaacgtaacccgttaaccggtaacccgggttacggggttaaccccgggtttacccggggtaacccggtaaaaccggggggtaaacccgttaaacgggggttaaacgggtaaaaaccggttaaacccgggtaaaaaacccgggttaaaccgggtttaccgggggttaaacccggggttaacccggtttaacccggggtaaaacccccgttaaacccccgggttaaacggttttttaccccccggtttaaacgggttttttaaccccccggttttaaccccggtttaaaacccccgg

SEQ ID NO: 180763 - DNA, 693 bp, Homo sapiens
  misc_feature: GYAE6OF01DP61Q.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagacgccaccctctcctgcagggtcagtcagtcgttactaacaccgtacttctcgcctggtaccagcagacgacctggccaggcctcccaggtcctcctcattcgtttggtcgccgtaccaccgacgggccctacgtcggccactccccgagaccgtaggttccgaggtcggacgtagggttcggggtcgtaggggaacacggtacctttccaccttcctaccgtaacctaacgttccgaacgaccgtaacggtaccgtttaggaaccggtcccgttaaggtaaacgttagttttacggacttaaggttaactttaacgtttacgttacgtacgtaacgtacctaaagttacgtacgacgaccgtcgtaacggttggtacgggtccgttccgggaccgtaagggaaccgtaagggtaacggaaacgtaccgaaaacggtacggttcggtacggtacgtacgaccgtacctacgttcgttcgttacccg

SEQ ID NO: 180764 - DNA, 605 bp, Homo sapiens
  misc_feature: GYAE6OF01CMS3U.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaangccaccctctcctgcagggtcagtcagcgttctaacaccgtacttcttcgcctggtaccagcagagacctggccaggcctcccaggctcctcattctttggtcgccgtcccaccgacgggccacgtcggccactccccgagaccgaggttcaggtggacagggtcgggtctgggacagtacttcactctacaccatcagcagtacttgacgtcctagtaagtatttgactagttattagttacgtgtacagtactaagttatacgacgtaccgtacgtacgttggtacgggtccggttacgggacccggtaaagggacccgaagggtaacggaaacgttacgaaaacggtacgttacgggtacggaccgtacgaccacctaacgttccgttcggttacc

SEQ ID NO: 180765 - DNA, 561 bp, Homo sapiens
  misc_feature: GYAE6OF01DXT8A.34.38.D05.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccagggaaangccaccctctcctgcagggtcagtcagcgttctaacaccgacttctcgcctggtaccagcagagacctggccaggctcccaggctcctcatctttggngccgtccaccgagggcccacgtgcactcccagacaggttcagtggcaggtggtctgggacagtacttcactctcactatcagcagtacttgacgcctagaagtatttagctaagttattattacgtgtacagtacaatacgtacgagacgtactacgtcggttagggtccgttacgggacccgtaagggacccgaaagggtaggaaacgtacgaaaacggtacgtagtacgggactacggacactacttcgtgttacc

SEQ ID NO: 180766 - DNA, 768 bp, Homo sapiens
  misc_feature: GYAE6OF01BI3IK.34.38.D05.1.454.CMB.1.raw
tcagtacacgtgatcacgaccggtgctcgatttagtatctgatagttggggtttggggagagaagagctgctcagttaggaccccagacgggaaccatcggaaaccccagcgcagcttctcttcctcctgctactctggctccagatcgccccggataaattgtgttgacgcgacgtcgccagaacaccctgtctctcgtctccgaggggaaagacgccacctcctcctgcgtagggtacaagtcacggtcgtttacctaaccgaccgtactttccgttccgccgtacgggtaacccacgaccgtaacggaccgtacccgtcgggaccaacggtccctaccccgaaggtccctcccgtcgtaacgtttccgtttgggtcgtccgtacccacggtacgggcctacgtcggcctactcccgaagtaccgtacggttcaggtcggactacgggttcgggtcgtacggggtaactacggtacctttaccgaaccttccgtacccgaaccgtaacgtccgacgtactaacgttaccgttcgaacgtaccgtaggtaacgttagtttacgacgtaacgttaagttacgtttacgtacgttacgtaaggtacgtaacgtacgtaacggtaacgaccgtacgtacggttacggtcgggtaccggttaccgggaccggtaaccgggtaaccggtaacggtacggaaaccggttaaccgtaaacggtaccgttacggtccgtaccgtaccgtaccctacgtaccttccgtcgttaccg

SEQ ID NO: 180767 - DNA, 254 bp, Homo sapiens
  misc_feature: GYAE6OF01CM8CQ.34.38.D05.1.454.CMB.1.raw
  modified_base (252)..(254): a, c, t, g, unknown or other
  misc_feature (252)..(254): n is a, c, g, or t
tcagtacacgtgatcacgaccggtgctcgatttagtatctgatagttgggtctgggacagacttcactctcaccatcagcagacttgagcctgaagattttgcagtatattactgtcagcaatatcgagacgcactgtgggcgttcggccaagggaccaaggtggaaatcaaacgaactgtggctgcaccatctgtcttcatcttccgccatctgaatcacgtgtactgagcgggctggcaaggcgcatagnnn

SEQ ID NO: 180768 - DNA, 781 bp, Homo sapiens
  misc_feature: GYAE6OF01D7V9H.34.38.D05.1.454.CMB.1.raw
  modified_base (259)..(259): a, c, t, g, unknown or other
  misc_feature (259)..(259): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagataccaccggagaaattgtgttgacgcagtctccagccctaccctgttctttgtctccgaggggacagacgcccaccctctccgtggccgggccagtcagagttatagagctacttnttagcctaggtatcagcaagaaaccgtggaccgtggccgcccgaggcctcctcatctataatcgaccttagtacggcgacggccacggtcggaccgtacccgaacgacgtacggttcgaacggtcggacggtagggttgggtccggtgggggactaacggtacccgttctaacttccctacgtaccctaagttccgaacgccgaaggtaccgttggggaacgtaccgttaagggtaaactttacgttttacggacgtttaaggtttaggtttaaacgttttacggttaacggttaaccgtagaaccgttacgtaacccgtaacttccgtaacgtttacccgggttaacccgttaacccggttaacgtttacccggttttaaccggggaacccgggtaaccgggggtaaaaccctaaccgggtaccggttaaggggaaacgttaaaccgtaaaccggtaaaaacccggtttaacggtacgggttacgggaacccggttacgtaacccgtaccgtttaacccgg

SEQ ID NO: 180769 - DNA, 658 bp, Homo sapiens
  misc_feature: GYAE6OF01C7EEE.34.38.D05.1.454.CMB.1.raw
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (653)..(654): a, c, t, g, unknown or other
  misc_feature (653)..(654): n is a, c, g, or t
  modified_base (657)..(658): a, c, t, g, unknown or other
  misc_feature (657)..(658): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccgagggaaggggctggtgtgggtttcagtattacgagtgatgggactgacacaatctacgcgactcgtgaggccatccacccctcagagacaacgcaagaacacactatatctagacaaatgaaacagtctagagagaccgaggacacggctgtctattacgtgtagacgaaggnggtggactaacaatctaagtttggttttnagttcgtcggtcggggacaagggactaagtcggtaccaccgtctctcgacgccctaccgaccgaacggccctacgttcccggtacccttcccccgtcggcccgtccccgtcgccctacccgacggacgtaccctaacccgtccgggaacgacgaccctaaccggaccggtccccgggtcccgtcggggtccttccggaccggttaccgggtaaccgaaacgggttacccttacccgtttacccacgttccgtacggttccgtaaccgtagggccgggccgggtacggtacgggacgaaccgggtcgacgtagtaganngtnn

SEQ ID NO: 180770 - DNA, 700 bp, Homo sapiens
  misc_feature: GYAE6OF01B1OFL.34.38.D05.1.454.CMB.1.raw
  modified_base (208)..(208): a, c, t, g, unknown or other
  misc_feature (208)..(208): n is a, c, g, or t
tcagtacacgtgatcacgaccggtgctcgatttagtatctgatagttgggtttggggagagaagagctgctcagttaggacccagagggaaccatggaaacccagcgcagcttctcttcctcctgctactctggctcccagatcgccccggagaaattgtgttgacgcagtcgccagaccaccctgtctctgtcgtccgaggggaaanacgccaccctctcctgcaggtcagtcagcgttctaacaccgtacttcttcgcctggtacccagcagacgacctggccaggcctaccgaggcctcccgtatcgtttcggttcggtccgtaccgtacccgacggccggaacctcggcgactacccgtaccgaacgacgttacggtacgtacggtcggacggttacgggtccggtaggtaccggaacgtaccggttaacttcccgtactacccgtaaccgacgttaacacgtacgacgtacgttacgttacggacgttacgtaagtaacgtttagttacgacgttaacgttattaacgttcggtatacgtagaacgttaattacggaacgtacgtaccgtacgtacggtcgggtacggttaccgaccggtaacggaacggtaacgtagggtaaaacgaccgtaaagggaacgttacggtacggtacgggtacctacggacccttaagtccttcgttcgttacccg

SEQ ID NO: 180771 - DNA, 575 bp, Homo sapiens
  misc_feature: GYAE6OF01B0IBS.34.38.D05.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (368)..(368): a, c, t, g, unknown or other
  misc_feature (368)..(368): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaanagccacctctcctgcagggtcagtcagcgttctaacnccgacttctcgcctggtaccagcagacgacctggccaggctcccgaggcctcctcattcgtttggtcgccgtcccacgacgggcccacgtggcactcccagactaggttcaggtcgcaggtggtcngggacagtctcactctccacatcagcagacttgagctagtaagtatttgactagttatattactgtacagactaatagtacgagtacgtcgtacgttcggtcgggtccgttacggaccgtaacgggaccgtaaagggtacggtaaacgtaacgaaaacggtacgtaggtacggtacgttacgaccctaacgtactccgttgttaccc

SEQ ID NO: 180772 - DNA, 574 bp, Homo sapiens
  misc_feature: GYAE6OF01CAU67.34.38.D05.1.454.CMB.1.raw
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaanagccaccctctcctgcagggtcagtcagcgttctaacaccgacttcttcgcctggtaccagcagagacctggccaggctccccaggcctccncattctttggtcgccgtccaccgagggtccacgtggccatccccagacctaggttcagtggcaggtggtctgggacagtacttcgactctccaccatcacgcagacttgagcctagaagtactttgctagtactattactgtacagactaatactcgacgacgctacttgtgggtccgttccggaccgaaagggacccgtaaagggtacggtaaacgtacgaaaacggtacgtagggtacggaccgtacggaccaacctacgtcgtcggtttacc

SEQ ID NO: 180773 - DNA, 157 bp, Homo sapiens
  misc_feature: GYAE6OF01EQ4VN.34.38.D05.1.454.CMB.1.raw
  modified_base (155)..(157): a, c, t, g, unknown or other
  misc_feature (155)..(157): n is a, c, g, or t
tcagtacacgtgatcacgaccggtgctcgatttagtatctgatagttgggtttgggggaagaggaagactgacggtcctagcacagcggccctgggctgcctggtcaaggactacttccatcacgtgtactgagcgggctggcaaggcgcatagnnn

SEQ ID NO: 180774 - DNA, 631 bp, Homo sapiens
  misc_feature: GYAE6OF01CQG8F.34.38.D05.1.454.CMB.1.raw
  modified_base (209)..(209): a, c, t, g, unknown or other
  misc_feature (209)..(209): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgaggggaaagngccaccctctcctgcagggtcagtcagcgttactaacaccgtacttctcgcctgtaccagcagagacctggccaggcctcccgaggtcctccctctacttcgtttggtcgccgtcccaccgacgggccacgtcggcactccccgagaccgaggttccaggtcggcagggtcgggtctgggacagtaccttcgactctacacactcacgcagtacgttgaacgtcccgtaaggaagttagttttcgacgtaagttaattacgtttactgttacgagactaattaacgtacgaacgaccgtctacgttcgggtagggtccggttacgggacccgaaagggtacccgtaaggggtaacgaaacgtaccgaaaacggtaacgtcggtacggacgttacggactaccctagttccgttcggttaccc

SEQ ID NO: 180775 - DNA, 668 bp, Homo sapiens
  misc_feature: GYAE6OF01AVW7L.34.38.D05.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagaccaccactggaagaaatagtgatgacgcagtctccagccaccctgtctgtgtctccaaggggaanacgcccaccctctcctgcagggccagtcagngtgtgcagcaactgcctggaccagcaagaacctggaccaggccctacccgagtacgttccncaacgttctactcgaccttaaccgactcccccgaacgacgggccctacgtggtccttaacgttcccgacggtccctaggggttcccaggttggaccgtagggttcgggtacgtcggggaaactaggtacgtttccaccttcctaccgtaccgtactaccgacgccgacgtcccgtaggacctaggtcctaaggtaacgttactttacgtcgttaccttaacttttactacgttgtacctagtacgtaagttaccttaaaggtaacggttcggaccgggttaggtaccggttaccggaacgtaacgggaccgtaagggtaacgaaacgtaacgaaactacggttagacgtacctacgcgtaccgtacg

SEQ ID NO: 180776 - DNA, 656 bp, Homo sapiens
  misc_feature: GYAE6OF01AY695.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatgcccccggagaaattgtgttgacgcagtcgccagacaccctgtctctgtctccgaggggaaagacgccaccctctcctgcgagggtcagtcagtcgttctaacaccgtacttcttcgcctggtaccagcagacgacctggccaggcctccccgaggcctcctcattcgtttggtcgccgtcccacgacgggccacgtcggcactcccagaccgtaggttcaggtcggcgagggttcggggtcgtaggggtaccaggtacctttaccgacttcctaccacctacgtcacgccgtagtaccgttaggacgtcccgttaggtaacgttagttttacggaccgtaagttaattactttaccgtgtactacgtacctaagttacgtacggaacgtacgtaccgtacgttggtcggggtaccggttaccgggaccgtaacgggaccgtaagggtacggaaacgtaaccgaaacggtacgtaggtacggtactacgactacccgtacttcgtgttacc

SEQ ID NO: 180777 - DNA, 732 bp, Homo sapiens
  misc_feature: GYAE6OF01DXWSB.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagaccaccctgtctctgtctccgaggggaagacgcccaccctctcctgcgagggtcagtcagtcgttactaaccaccgtactttccttccgcctggtaccagcagacgacctcggccacggcctccccgaggcccttcccgtactagtttccgttttcgggtcgtcccgtacccgacccgacgggccctacgtcggaccacgtacccgaggacctaggttcgaggtcggcgtagggtcgggtacgtcgggaactacggtaccttaccaccttcctaccgaaaccctacgttaccgacgaccgtaacgtaccgttacggaccgttacccgttaaggtaacgtttacgttttacggacttaacggtttaatttaacgtttacgttcgtacgtaagtactaaagttacgtacgtaacgtaccgtacgtacggttcgggtacggggttaccggttaccggaccggtaaacgggacccgtaaagggtaaccggaaacgtaaccgaaacggttacgtcgggttacgaccgtacgacctaccgttacgttcgtcgttacccg

SEQ ID NO: 180778 - DNA, 757 bp, Homo sapiens
  misc_feature: GYAE6OF01C208S.34.38.D05.1.454.CMB.1.raw
  modified_base (309)..(309): a, c, t, g, unknown or other
  misc_feature (309)..(309): n is a, c, g, or t
  modified_base (748)..(748): a, c, t, g, unknown or other
  misc_feature (748)..(748): n is a, c, g, or t
  modified_base (756)..(756): a, c, t, g, unknown or other
  misc_feature (756)..(756): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattccaccccctcagagacaacgccaaagaacacactatatctgacaaatgaacagtctagagagccgaggacacggctgtctattactgtgcaaggnggtggactaacaatcattggttttagatcgtcgtcggggaccaaagggactaagtggtaccaccgtctcttcacgtccctccgaaccgaacgggccctaacgttcccggttcccttccccccgttcgggccccgtccccctcggtaccccgttaccccgaacggggtaacgtacccccgtaacccccgttaccccgggaacggaacccggtacccgaacccggtaacggggccccccgggtccccccggttacggggggtcccgttaccgggtcccccggtttacgggggtaacccgtaaaccggggtaaccctttaaccccgtttaccccgtaacgttacccggtaaccggtttacggtaaaccgttcgggaaccggggtcccggggtccgttacgggggaccgtaaacggggtacccgtaccgtaacgttaacgggntagcgtgng

SEQ ID NO: 180779 - DNA, 939 bp, Homo sapiens
  misc_feature: GYAE6OF01DDDO3.34.38.D05.1.454.CMB.1.raw
  modified_base (261)..(261): a, c, t, g, unknown or other
  misc_feature (261)..(261): n is a, c, g, or t
tcagtacacgtgatcacgaccggtgctcgatttagtatctgatagttggggttggggagagaacgagctgctcaggttagggaccctagagggtaaccatggaaaccccagcgcagcttctcttcctcctgctactctggtctccagacacctacgttggagtaaatagttgtaatgacgcagtctccagccaccctgtctgtcgtcgtccgggaggggtaaagcgccaccctcgtccgtcgcgacgggcctacgtcaggngtcgttggccagctaacttacgccttaggtaaccagtaccgaacggtaaacccgtcggacccgacgggtccctacccgaacggggtcccttacccgtacgtaacgttccggttaagtggaacgttcggtacccgtaccggtaaacgtacggggtaccctaacgtcggtaccctaagtacccgagtccgtaaggtttacaacgggttcggacgtaagggttcgggtaccgtacgggggaccctaacggttacctttaccaaccgtttaccctacccgtaaacccgtaacggttacccgaaacggttaacccgtaaaccgggtaaacccgttaaacggtaaacccgggttaaaccctttaaaaagggtttaacttttttaccgggaaaccttttaaaacggttttttaacgtttaaaccggtcggttaaaccgtaacgggttaccgttaacgggtaacccggtttaacgggtaacccgtaaacggtttcccgggttaaccccttttacccggtttagggaacccgggttaacccgggtaccccggggtttaaccggggaacccgggtaaacgggggtaacccgtaaccgggttaaccggtaaacggggtaaacccgttaaacggtttaaaacccgggtaaaccgtttggggttaaccgtccggttaccgggtaaccccgg

SEQ ID NO: 180780 - DNA, 731 bp, Homo sapiens
  misc_feature: GYAE6OF01BCFAK.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagaccaccctgtctctgtctccgagggaaagacgcccaccctctcctgcgagggtcagtcagtcgttactaacaccgtacttctccgcctggtaccagcagacgaccgtcggaccaggccctcccgaggtcctcctctagtttccgtttgggtcgcccgtacccgaccgacgggccctacgtcgggcctaactccccgaagtaccgtacggttccaggtcggacgtagggtcgggtcgtaggggaacctggtaccttaccgaccgtttccaaccgtaccctaacgtccgtaacgactaacgtaccgttagaccgtaccgtagtaaacgtttagtttacgtaccgtaagtttaacttacgtttaacgtgtactaacgtactaacgtacgtaccgtaacggaccgttccgaaggtttcgggtacggggtcccggttaccgggaaccgggtaaacggggaaaccggtaaaggggtaacggtaaaacgtaccggtaaaacggtaaccggttagggtacggtccgttacggaccaaccgttacgtcgttcgttaacccg

SEQ ID NO: 180781 - DNA, 598 bp, Homo sapiens
  misc_feature: GYAE6OF01A47O8.34.38.D05.1.454.CMB.1.raw
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
tcagtacacgtgatcacgaccggtgctcgatttagtatctgatagttgggtttggggagagaagagctgctcagttaggacccagagggaaccatggaaacccagcgcagcttctcttcctcctgctactctggctcccagatcgccccggagaaattgtgttgacgcagtcgccagacaccctgtctctgtctaccgagggaaancgccaccctctcctgcgaggtcagtcagcgttcaacaccgtcttctcgcctgtccagcagngccnggaccagccacncggctccncgnttcgtttcgcgtccgtaccgaccgcggccncgttcggcactcccgaagcacggttcncgtggcgtgtcgggtcgnggacncgtctcactctcactagtctacgacgtcgtacgtagcgtcgtaaggtacttattacgcgttaattacttacttacgtgtacgtacgtactaacgtacgtacgtacgtacgtacgtacgtacgtacggtcggtacggtaccggtaacggtacggtaacggtaacgtaacgtaacgtaacggtacgtacggtacgtacgtacgtacgtacgtacgtcgttcgtacg

SEQ ID NO: 180782 - DNA, 565 bp, Homo sapiens
  misc_feature: GYAE6OF01DV0UL.34.38.D05.1.454.CMB.1.raw
  modified_base (207)..(207): a, c, t, g, unknown or other
  misc_feature (207)..(207): n is a, c, g, or t
  modified_base (430)..(430): a, c, t, g, unknown or other
  misc_feature (430)..(430): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaangccaccctctcctgcagggtcagtcagcgttctaacaccgacttcttcgcctggtaccagcagacgacctggccaggcctcccgaggcctcctctagttcgtttggtcgccgtcccaccgacgggccacgtggccactcccagactaggttcaggtggcaggtcgggtctgggacagtacttcacttctaccaccatcagcagtacttgactcctagaagttntttgactagttatactttacgtcgtacagtactaatacgtacgagaccgtacgtacgtggtcgggtcgttcggacgaacggaccgtaaggtagaaactacgaaacgtactggtgactcgaccactactctgtacc

SEQ ID NO: 180783 - DNA, 625 bp, Homo sapiens
  misc_feature: GYAE6OF01A2ZDF.34.38.D05.1.454.CMB.1.raw
  modified_base (207)..(207): a, c, t, g, unknown or other
  misc_feature (207)..(207): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaangccaccctctcctgcgagggtcagtcagtccgttactaaccaccgtactttcttcgccttggtacccagcagacgacctggccaggcctcccgaggcctcctcattcgtttggcgtccgtccaccgacgggcccacgtcgggccacgtccccgaagaccgtaggttccaggtcggctagggtcgggtcgtagggacaggtacttcacttctaccaccatcagcacgtacttgacgtcgtagtaagtagtttcgactagttattagttactgtactagactaagtagtacgacgacgtacgtacggttggtacgggtccgttacgggaccgtaacgggtaacctaagggtacgtaaacgtaaccgaaacggtacgtacggtacggtacgtacgacctaacccgtattccgtcgttaccg

SEQ ID NO: 180784 - DNA, 708 bp, Homo sapiens
  misc_feature: GYAE6OF01CQEPD.34.38.D05.1.454.CMB.1.raw
  modified_base (494)..(494): a, c, t, g, unknown or other
  misc_feature (494)..(494): n is a, c, g, or t
tcagtacacgtgatcacgaccggtgctcgatttagtatctgatagttgggtttggggagagaagagctgctcagttacggacccagagggaaccatggaaaccccagcgcagcttctcttcctcctgctactctggcctccagactcgcccccggaagaaattgtcgttgacgtcacgtcgccagacacccgtgtcctctcgtctaccgaggggaaacacgcccacctcctccgtgcgtagggttcacgtccgaacgtaccgttaactaacctaccggtacttccgttcgacctaggtaaccagacgaacgacgtacccgtggaccctaacggtcctaccgacggtccttacccacgtacgtttccgtttggtccgtccgtacccgaacccggtaccgggtccctaacggttcggacctaccgtccgaacgacgtacgttcgaggtcggactagggttcggtacgtacggactacgtacctcacgtactccacnctcgagcgtagtacttcgacgtaccgtagtaacgttacgttgaacgtagttacttacgttactggttacagtacttaacgtacgtacgaacgtaaccgtcgtaacggttcgggtacgggccgttacggaacggtaaccgggtacgaagggtaacgtaaacttacgaaaccgttcggtcgtacggaccacgtacaccgttactccgtacgttacc

SEQ ID NO: 180785 - DNA, 730 bp, Homo sapiens
  misc_feature: GYAE6OF01ANSAW.34.38.D05.1.454.CMB.1.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaaattgtgttgacgcagtcgccagacaccctgtctctgtctccgaggggaaagacgccaccctctcctgcgagggtcagtcagcgttcaacnccgacttctcgctggtaccngcaganaccgtggccaggcctcccaggctccnattcgtttggngccgtcccaccgtagggcccacgtgggccactccccagacctaggttccaaggttggactagggtgggttcgtaggggacacggtaccctttcgaacttccgtacccacctagttaccgacgacgtacggtaactttcgggaacgtccccgttaaggtaacgttagtttttacgacgttaagttaactttaactttaaccgttgtactaacggacttaaaagttacgtacggaacggtaacgtaccgtaacggtttcgggtaccgggtaccggtttaccgggaacccggtaaacgggggtaaacccgtaaaaggggtaaaccgggtaaaacgtaacccggtaaaaaccgggtaaccgttacggggttacgggtaccgttaccggtaaccgtaaccccgtacgttcccggttacgtttacccg

SEQ ID NO: 180786 - DNA, 576 bp, Homo sapiens
  misc_feature: GYAE6OF01BA437.34.38.D05.1.454.CMB.1.raw
  modified_base (398)..(398): a, c, t, g, unknown or other
  misc_feature (398)..(398): n is a, c, g, or t
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
tcagtacacgtgatcacgaccggtgctcgatttagtatctgatagttgggtttgggagagaagagctgctcagttaggacccagagggaaccatggaaaccccacgcgcagcttctcttcctcctgctactctggctcccagacaccactggagaaatagtgatgacgcagtctccagccaccctgtctgtgtctccaggggaaagagcccaccctctcctgcgagggccagtcaggagtggttggacagcctaacgttagccgtggtaccagcaagaacctggccaggcctcccagacgtcctcatctatgctacactccaccgaggccactgactacttccagtccagttcagtggcaggttgggtctaggggacaggtacgttcactctccaacntcagcacggtcctgctagtctagaagtnttcgagtactacttttactcgtntacagctagttacttaaagtacggtcggtccgtaggtaccggttaccggaccgtaaaggggaccgtaagggtacggtaaaactacgaaaaccggtacgtgggttcggactacggtccaaccgttacg

SEQ ID NO: 180787 - DNA, 602 bp, Homo sapiens
  misc_feature: GYAE6OF01D2359.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagagccaccctctcctgcagggtcagtcagcgttctaacaccgtacttctcgcctggtaccagcagacgacctggccaggcctcccaggcctcctcattcgtttggtcgccgtccaccgagggcctacgtcggcactcccgagacgaggttcagtggctagggtgggtcgtgggacaggtacttcgacttcgtacacctatcacgacacgtacgttcgacgtcctagaagtagtttcgactagttattacttacttgtacagactaatatacgacgacgtactacgttggtcgggtcgttccggaccgaagggaccgtaaagggtacggaaacgtaaccgaaaacggtaacgtacggtacggtacgtacggacaaccctacttccgtcggttacccg

SEQ ID NO: 180788 - DNA, 691 bp, Homo sapiens
  misc_feature: GYAE6OF01BH0G6.34.38.D05.1.454.CMB.1.raw
  modified_base (204)..(204): a, c, t, g, unknown or other
  misc_feature (204)..(204): n is a, c, g, or t
tcagtacacgtgatcacgaccggtgctcgatttagtatctgatagttgggtttggggagagaagagctgctcagttaggacccagagggaaccatggaaacccagcgcagcttctcttcctcctgctactctggctccagatgccccggagaaattgtgttgacgcagtcgccagacaccctgtctctgtctccgaggggaaanacgccaccctctcctgcgagggtcagtcagtcgttactaacaccgtacttcctcgcctggtaccagcagacgacctggccaggcctcccaggtcctcctcactttcgtttggtcgtccgtccaccgaggccacgtcggctacgtcccgagacgtacggttcaggtcggactaggtgggtactggggactaggtacttcgaactcgtaccaaccataccgagacgagtacgttagacgtccgttaaggaacgttagttttcggactaaggtttaattaagtttacgttacgtacaaggtaactaagttactacggtaacgtaccggtacctacggttacggggttaccgggtaccggtttaccggggaaccggtaaacggggtaaccgtaaaggggtaaacggtaaaacgttaacccgaaaaacgggttacgtacgggttacgggtaccgtacggtaccgtaacccgtactttccggttcgttacccg

SEQ ID NO: 180789 - DNA, 639 bp, Homo sapiens
  misc_feature: GYAE6OF01CKOZI.34.38.D05.1.454.CMB.1.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaangccaccctctcctgcagggtcagtcagagtgttggcagcacttagcctggtaccagcaagaaacctggaccaggctccagacgtcctnatctatgacctacactcccaaccgaggccacgtgctatccagcctaggttccaggtcggactaggtgggtctagggactagtagttccactctaccacctatcgaagcctaagtccccgtgacctaggtactaggaacgtactttacgtcgaccttaactttttaagtaccttaggtactaggtaccctaaggttaccttaaaggttacgggtcgggtacccggtttagggaaccgtttccgggaccggaaaacgggtaacccgtaaaggggtaccggtaaaactacggaaaaacggtacttcgggtacgtacgtacgaaccctaaccgtaagttccgttaaccg

SEQ ID NO: 180790 - DNA, 606 bp, Homo sapiens
  misc_feature: GYAE6OF01BKIOV.34.38.D05.1.454.CMB.1.raw
  modified_base (204)..(204): a, c, t, g, unknown or other
  misc_feature (204)..(204): n is a, c, g, or t
  modified_base (402)..(402): a, c, t, g, unknown or other
  misc_feature (402)..(402): n is a, c, g, or t
tcagtacacgtgatcacgaccggtgctcgatttagtatctgatagttgggtttggggagagaagagctgctcagttaggacccagagggaaccatggaaacccagcgcagcttctcttcctcctgctactctggctcccagatcgcccccggagaaattgtgttgacgcagtcgccagacaccctgtctctgtctccagggaanagccaccctctcctgcagggtcagtcagcgttactaacaccgacttcttcgcctggtaccagcagacgacctggccaggcctccaggcctcctctattcgtttggcgccgtccaccgagggccctacgtcggctacgtcccaagactaggttccagtcggctaggtgggtctgggacagtacttcgactctacacctntcagcacgtacttgacgtctagtaacgtatttgactagtattattactgtacagactaatagtacgtagacgtactacgttggtcgggtacgttacggaccggtaacgggaccgtaaagggtaacggaaaacgttaacgaaaaccggtaacgttacggtacggtaccgttacggaccctaacctacgttccgttcgtttacccg

SEQ ID NO: 180791 - DNA, 729 bp, Homo sapiens
  misc_feature: GYAE6OF01A3MCD.34.38.D05.1.454.CMB.1.raw
  modified_base (185)..(185): a, c, t, g, unknown or other
  misc_feature (185)..(185): n is a, c, g, or t
  modified_base (211)..(211): a, c, t, g, unknown or other
  misc_feature (211)..(211): n is a, c, g, or t
tcagtacacgtgatcacgaccggtgctcgatttagtatctgatagttgggtttggggaggagaagagctgctcagttaggacccagagggaaccataggaaaccccagcgcagctctcttcctcctgctactctggctcccagatcgcccccggagtaaattgtgttgacggcagtcgccagacnccctgtctctgtctccgaggggaaanacgccaccctctcctagcagggtcagtcaggtctctaacaccgcttctcgacctggtaccagcgagagaccgtggaccaggccgtacccacggtctcccctgtaacttcgtttgggtctccggtcccacggacggccacgtcggaccacgtcccgagtaacgcggtttaccaagttcggacggtacggttaggcgttagggacctacggtaacttccacgtccttacaacgttactacgaccgcgtaacggtacgtacggtacgtacccgttacgtaaacgttacgttttaccgaacgtttaaacggttaactttacggttaaccgttacggtactaacggttaaccgtaattaaccgggttaacaacgggtaaccgtacggtacgttacggttcggggtaaccgtttccgggaaaccgggttaacggaacggttaaacggggtaaggttaaaccgaacggtaaaccgtaacggtcggtacggtacggtccgaactaccgtacgtcgttcgttaaccg

SEQ ID NO: 180792 - DNA, 791 bp, Homo sapiens
  misc_feature: GYAE6OF01BG1O5.34.38.D05.1.454.CMB.1.raw
  modified_base (203)..(203): a, c, t, g, unknown or other
  misc_feature (203)..(203): n is a, c, g, or t
tcagtacacgtgatcacgaccggtgctcgatttagtatctgatagttgggtttggggagagaagagctgctcagttaggacccagaggaaccatggaacccagcgcagcttctcttccgtcctgctactctggctcccagatcgccccgagaattgtgttgacgcagtcgccagacaccctgtctctcgtctccgagggaaancgcctaccgtctccgtgacgagggttacacgtcgaacgtccgttacgtaaaccgaccgtactttccgtaccggtaccttacggttaaccctaggtaccgtaacggtacggtaccgttacggtacccgtaacggaccccgttaccccggaacgggtccttacccgtcctacgttttaccgttttcgggtacgtaccgttacccgaaccggttaacgggccctaaccgtttacggggacctaaccggtacccgtaacgggtaaccgtaggtttaccgaagttcgggacgtaagggttcggtacgtacgggactaggtactacgtactctaccgactacgtcacgtctacgacgttgacgtccgtagtaagtcgttagtacgtagttaacgttatttacgtcgttaacgtagtacctaaagttccgtaaccgaggtaccgtacctaacggttggtaacccgggttacggttaccgggtaacccggtaaagggtacccgtaaaaggggtacggtaaaaccgtaaccgggtaaaacgtacggttacggttagaccggtttacaccgtaaccgttacttccggttcggttaccc

SEQ ID NO: 180793 - DNA, 770 bp, Homo sapiens
  misc_feature: GYAE6OF01CQGE7.34.38.D05.1.454.CMB.1.raw
  modified_base (203)..(203): a, c, t, g, unknown or other
  misc_feature (203)..(203): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatgccccggagaaattgtgttgacgcagtcgccagacaccctgtctctgtctccgagggaanacgccaccctctctgcgagggtcagtcagtcgttactaaccaccgtacttcttcgcctgtaccagcagagacctggccaggcctaccgacggtcctcctactattccgtttggcgtccgtacccaaccggtacgggcccacgtcggacctacctcccgagtacgtaggttcaggtggcgtagggtcgggtacgtacgggactaacggtacctttacgacttcctacaaccacttcgaacggtaccagttacgtttacgaacggtacccgttaggaaacgtttcgttttacggtaaccgtaaggttttaaactttcgtttaaaccgttcggttaacctaaggtaaacctaaaggttactaccgggtaaacgtaaccggtacgttaaccgggtttcggggtaaccgggggttacccggttaccgggaaaccccgggtaaaacgggggtaacccttaaaagggggttaaccggtaaaaaacgtaaccccgtaaaaacgggtaccgttagggggtaaccgccggttaccgtacccgtaaaccttcggtttacccgttggttttaacccccc

SEQ ID NO: 180794 - DNA, 663 bp, Homo sapiens
  misc_feature: GYAE6OF01C5Q74.34.38.D05.1.454.CMB.1.raw
  modified_base (271)..(271): a, c, t, g, unknown or other
  misc_feature (271)..(271): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtcctccgaggggaaagacgcccaccctctcctgcagggtcagtcagtcgttacaacaccgacttctcgcctggtaccngcagagaccgtggccaggcctcccaggcctcctctattcgtttggcgccgtcccacgacgggccacgtcggactacgtccccgaaggacgtaggttcaggttcggactagggtcgggttcctagggaacacggtacttcgactctacacctatcagacacgtacgttgacgtccgtagtaagttatttggaccttaaggttaacttagttacgtagttaccgaagtaacgtaaagtaacgtaccggtaacgaccggtacaccgggttgggttaccggggtccggttacccgggaaccggtaaacggggaacccgttaaaggggtacggaaagtaacgtaaagggaccgtaaacggtggtacgtcgtaacgaccgtaccgtagttcgttaccg

SEQ ID NO: 180795 - DNA, 756 bp, Homo sapiens
  misc_feature: GYAE6OF01B362J.34.38.D05.1.454.CMB.1.raw
  modified_base (209)..(209): a, c, t, g, unknown or other
  misc_feature (209)..(209): n is a, c, g, or t
tcagtacacgtgatcacgaccggtgctcgatttagtatctgatagttgggtttggggagagaagagctgctcagttaggacccagagggaaccatcggaaaccccagcgcagcttctcttcctcctgctactctggctcccagatcgccccggagaaattgtgttgacgcagtcgccagaccaccctgtctctgtctaccgagggaaancgcccaccctctcctgcgacgggtcagtcagtccgttacctaacaccgtacttctcgcctggtaccagcagacgtaccgtcggccacggcctaccgacggtcctccctctactttcgtttggtcgtccgtaccgaccgacgggccacgtcggcacgtcccgagacgtaggttcgaggtggcgtagggtcgggtactacggggaactacgtaccgttaccaccgttcctaccgaaccgtagttaccgacggtaccgtaacggttaacgttacggtaacgtacccgttaaggttaaacgttaacgtttttacggaacgttaaagtttaacgtttaacgtttaaccgtacggttaaccaacggtaacctaaagttacgtaaccggtaacggaacccgtaccgtacggttcggggttccgggtaccggttacccgggaaccggtaaacggggaaaccgtaaaggggtaacggtaaaaccgttaacggtaaaaccggtacggttacggtacggtaccgtacgaccctaccgtacgttccgttcgtttacccg

SEQ ID NO: 180796 - DNA, 607 bp, Homo sapiens
  misc_feature: GYAE6OF01EUB74.34.38.D05.1.454.CMB.1.raw
  modified_base (433)..(433): a, c, t, g, unknown or other
  misc_feature (433)..(433): n is a, c, g, or t
  modified_base (593)..(593): a, c, t, g, unknown or other
  misc_feature (593)..(593): n is a, c, g, or t
tcagtacacgtgatcacgaccggtgctcgatttagtatctgatagttgggtttgggggagagaagagctgctcagttaggacccagagggaaccatggaaaccccagcgcagcttctcttcctcctgctactctggctcccagataccaccggagaaattgtgttgacgcagtctccagcccaccctgttctttgtctccgaggggacagacgcccaccctctcctggcggggccagtcagagtattagtagctacttcttagcctggtatcagcagaaacctggcctggccgcccaggcctcctcatctataatcgcctatacgcacgggccacgtggccgtcccagaccgtaggtcaggtggcgtaggtgggtcgtggggcagtactcactcctcaccatcagcacgcctgcgtagtctagaagtacttcngtacctattttacttacttcgtactacgactaacgttacgtaagttaacggtcgggtccggttagggttaccggttccgggaaccggaaacgggtacccgtaaagggtaacgggtaaactacggaaaccgtacggtaggtcgacgtacgactaacccgtnttcgtcgttacccg

SEQ ID NO: 180797 - DNA, 724 bp, Homo sapiens
  misc_feature: GYAE6OF01ER5FG.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgacgcagtcgccagacaccctgtctctgtctccgaggggaaagagccaccctctcctgcagggtcagtcagcgttactaacaccgtacttcttccgcctggtaccagcagacgaccgtggccaggcctcccgaggcctcctcacttcgtttgggtcgccgtccaccgacgggccacgtcggacactcccgagacgtacggttcaggtggcgagggtcgggtacgtcgggactagtacctttcgacttcgtacacctatcgagacgtagtacgttcggacgtccctaaggtaacgttattttacgacttaagttaacttaactttacgttacgtactacgtaactaagttaacgtacggtaacggtaaccgtaccgttaacggttcggggttaaccggggttacccgggtttaacccggggaacccgggtaaaaccggggtaaacccgggtaaaaggggttaacgggtaaaaaccgttaaaccggtaaaaaccgggtaaaccggttacgggtaccgggtaccgtacggtacccgtaaaccgtaacttcgttcgtttacccg

SEQ ID NO: 180798 - DNA, 821 bp, Homo sapiens
  misc_feature: GYAE6OF01A5LFH.34.38.D05.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgtccacggagaaattgtgttgacgcagtcgccagacaccctgtctctgtctccgaggggaaanacgccaccctctcctgcagggtcagtcagtcgttcaacnccgtacttctcgcctggtaccagcagacgaccgtggccaggcctcccgaggcctcctnacttcgtttggtcnccgtccaccgacgggccctacgtggaccacgtaccccgaggacgtacggtttacagggttcggacgtagggttcggggtactcggggaacctagggtaccctttaccgaaccgttccttacccgaacccttacgttacccgaacggtaccgtaacggttaaccgtttacggggtaaacccggtcccggttaaacgggttaaacggtttaacgttttttcgggaaaccgtttaacggtttaacgttttaacgtttaaccgttcgttaaccgaaaggttaacctaaaacggtttaaccgttaccggtaacggtacccggtaaccgttacgggtttcgggggtaccgggggttcccgggtttaaccgggaaaccccgggtaaacgggggtaaaccccggtaaacggggttaaaccgggtaaaacgtaaccggtaaaaaccggttaccggttaacgggtacgggtacccttacgggaaccctaacccgtaagttcccggtttaaccg

SEQ ID NO: 180799 - DNA, 612 bp, Homo sapiens
  misc_feature: GYAE6OF01CTET2.34.38.D05.1.454.CMB.1.raw
  modified_base (602)..(602): a, c, t, g, unknown or other
  misc_feature (602)..(602): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagacgcccaccctctcctgcagggtcagtcagtcgttactaacaccgtacttcctcgcctggtaccagcagagacctggccaggcctcccgaggcctcctctagttcttggtcgccgtccaccgagggccacgtggaccactccccagacgtggttcgagtggcaggttcgggtcgtgggacagtacttcacgtcctacaccatcacgacgtagacgtttagacgtccctaggtaagttagtttcgagtagttagttatttagttcgtacacgtcacgtacattcgacgttacggtcctaaccgttacttacggtttcggaccggtaacgggaccgtaaggacggtagggacgtaacgtaaccgtaaaacgtacggtacggtcggtacctcgtaccncgtacgttcg

SEQ ID NO: 180800 - DNA, 786 bp, Homo sapiens
  misc_feature: GYAE6OF01DOME4.34.38.D05.1.454.CMB.1.raw
  modified_base (155)..(155): a, c, t, g, unknown or other
  misc_feature (155)..(155): n is a, c, g, or t
  modified_base (200)..(200): a, c, t, g, unknown or other
  misc_feature (200)..(200): n is a, c, g, or t
tcagtacacgtgatcacgaccggtgctcgatttagtatctgatagttgggtttggggagagaagagctgctcagttaggacccagagggaaccatggaaaccccacgcgcagcttctcttcctcctgctactctggctcccagatcgccccgganaattgtgtagacgcagtccgccagaccaccctgtcctctcgttcnccgaagggaaagacgtccaaccctctcgtagaccgaacgggtccaggttacacgtccgttactaaaccgtacccgtcttcctccgccgttacggtaaccctaagtccgaaggtaaccgtaccgtcggacccgaggtcctaaccccggaggtcccttcccgtactaaccgtttcggtttacggtccggtacccgttacccgtaaaccggtccggggaccctaacgttcgggaccctaacgttccccgaaaggttacccggtaggttaccgtacggtcggacgtacggggttcgggtcgtaacgggactaacggttactcgtaaccgtcgtacttaccgattaccgaacgtaccgaacgttacgttagaaccgtacgttaacggaaagtttatttacggaccgttaagttaactaactttacgtcgttaagaacgttactaagttaacgtacgaacgtacgtacctaggttggtacggttaccgtaccgggaacggtaaacgggtaccgtaaagggtaacgtaaacgtaaccgaaacggtcgtaggtacgaccgtacgaacccttagacggttcctgtttaaccccgg

SEQ ID NO: 180801 - DNA, 756 bp, Homo sapiens
  misc_feature: GYAE6OF01A74ZD.34.38.D05.1.454.CMB.1.raw
  modified_base (263)..(263): a, c, t, g, unknown or other
  misc_feature (263)..(263): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaagagccaccctctcctgcagggtcagtcagcgttctaacaccgacttctcgcctggtacncgcgacgagaccgtacggccgacggacgtccctaccggcgtccctcctactcgtttcggttcggtccgtccctacccgaccggccggtacctcggcgacctacccgtaccggaacgtaacggttacgtacgtgggtcgtacggtagggtcggtacgggtacggtaacgtacgtttaccgtacgtaccttaccgtacccgaactactaccggaccgtaacggtaaccgtttcggttacgggaccccgttacggttaaagggtaacttttttcggtaccgaaggtttaattaacttttacgtaggttccaacgtaacaagttaacgtcgtaacggaccgtactacgttacgggttcgggtaccgggttaccggaaccggaaacgggtaaccgtaacgggttaaaggggtaaactaaacccgttaaaaccgggaaacgtttacgggtacgggtacgtaccgtaacccgtaccctaacggttccttcgggtttaccc

SEQ ID NO: 180802 - DNA, 585 bp, Homo sapiens
  misc_feature: GYAE6OF01BG4H9.34.38.D05.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccagggaaangccacctctcctgcagggtcagtcagcgttactaacnccgacttcttcgcctggtaccagcagacgacctggccaggcctcccgaggtcctcctctattccgtttggcgccgttccaccgacgggccacgtcggcagtccccagactggttcaggtcggcaggtcggtacgtgggaacaggtaccttcgacttctacaccatcctagacacgtactagacgccgtagtaagtagtttcgactagttatactttactacgtacacgtactaatacgtacgtacgacgactacgtggtcgggtcgttacggaccgtaagggaccgaaggtagaaacgtacgaaacgacgtacggtgacgtacgacacctactcgtgttaccg

SEQ ID NO: 180803 - DNA, 660 bp, Homo sapiens
  misc_feature: GYAE6OF01AWXAB.34.38.D05.1.454.CMB.1.raw
  modified_base (208)..(208): a, c, t, g, unknown or other
  misc_feature (208)..(208): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatcgcccccggagaaattgtgttgacgcagtcgccagacaccctgtctctgtctccgaggggaancgccaccctctcctgacagggtcagtcagtcgttctaacaccgtacttcttcgcctggaccagcagacgactcgggaccaggcctcccaggtcctcctacgtactttcgtttggcgccgttcccaccgacgggcccacgtgactattccgaagacgtacggttccaggtggaccgtagggtcgggtacgtacggggacacgtacctttcgaacttccacaccgatacgagacgtacgtacgttagactaccgtagtaagttcttttagacttataacgttacgttacgtgtacagtaccaattacgaccgagaccgtactagttcggtacgggtccggtaccggaaccggtaagggtaccgtaaggggtaaccgtaaaacttaccgtaaaacggtaccttacgggtcgtaacgtaccggtacgtaaccctacgttcgttaccggtttacccg

SEQ ID NO: 180804 - DNA, 675 bp, Homo sapiens
  misc_feature: GYAE6OF01EP9TM.34.38.D05.1.454.CMB.1.raw
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (543)..(543): a, c, t, g, unknown or other
  misc_feature (543)..(543): n is a, c, g, or t
tcagtacacgtgatcacgaccggtgctcgatttagtatctgatagttgggtttggggagagaagagctgctcagttaggacccagagggaaccatcggaaaccccagcgcagcttctcttcctcctgctactctggctccagactcgccccggataaattgtgttcgacgcagtcgccagaccncctgtctctgtctcgagggaacncgccacctctctcgcgaggtcagtcacgtcgtacacnccgtacttcgttaccgcgtacggtaccagtaccgaagaccggtaccgtcggacccacggtcctacccgacggtccccttccgtactacgtttccggtttacgggtccggtcccgtacccgaccggacggggtcccacggtcgacctacgtacccgagtaccgtaggttcgaggtcggacgtacgggttcgggacgtacggtacgtacgtacttccaccgtctaccaacgtgtacacgtcgtaacgtacgttcggaccgttactaagtaagttcgtttagacttaagttattaaacgttntacggtacactaacgtaatacggtacgacgtacgtacgtaacggtggtacggtccggtacggaccgtaagggtacggaagtaagaaaccgtacgaagtcgtgtcgtaccgtcaccgtactcttgtcttaccg

SEQ ID NO: 180805 - DNA, 728 bp, Homo sapiens
  misc_feature: GYAE6OF01D05LQ.34.38.D05.1.454.CMB.1.raw
  modified_base (180)..(180): a, c, t, g, unknown or other
  misc_feature (180)..(180): n is a, c, g, or t
  modified_base (204)..(204): a, c, t, g, unknown or other
  misc_feature (204)..(204): n is a, c, g, or t
tcagtacacgtgatcacgaccggtgctcgatttagtatctgatagttgggtttggggagagaagagctgctcagttaggacccagagggaaccataggaacccagcgcagcttctcttcctcctgctactctggctccagactcgccccggagtaattgtgttgacgcagtcgccagacnccctgtctctgtctcgaagggaanacgccacctctccgtgcgagggtcagtcacgtcgttacaaccgtaccgtactttcttcgacctggtaccagtacagacgtaccgtggccgacggccgtccgaaggtccttcctcgtactttcggttggcggtccgtccgaaccgacggcctacgtacggcctaacgtcccgaaggtacgtacggttacgaggttaggccgtaaggggttcgggtacgtcggggtaacctagtaccgttacctaccttaccacgtaacctacgtacacgtactacggtacgttagacgtacttaaggaggtttatttacggacttaagttaattacttacgttacgtactaacgactaaagtccgtaggtaacggaccgtcgtaaccgttcgggtacggggtccgggttaaaccggaaccgggtaaaccgggtaaaccgtaaaggggtaaacggtaaaccgttaacggaaaacgggttacgtacgggttaccgaccgttacggtaccctaaccggtaactttccgtgtttaaccg

SEQ ID NO: 180806 - DNA, 655 bp, Homo sapiens
  misc_feature: GYAE6OF01AYPM5.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgagggaagagccaccctctcctgcaggccagtcagagtgttggcagctaacttagcctggtaccagacacgaaacctggccaggcctaccagacgtcctcatctatgcctacactccacgacggcccatgcctactccacgcctaggttccaaggtgcgtagtcggtacgtgggactaggacgttcacttctacacctagtacgaacgccgtaacgtccgtagtacgtaagttcggtaacgtaacgttacgttcgttacgtaacctttacttttacgttacgttcgtacgtacgtatacggttaccgtttaaagtacggtcggttaccggtcggggttcccgttacgggtaaccgtaacggggtaacccgttaaaggggtaccgtaaaaggtaacccggtaaacggtacggttacggacgggtacccgttagaacccgtacctagttcccgttaacgg

SEQ ID NO: 180807 - DNA, 686 bp, Homo sapiens
  misc_feature: GYAE6OF01C6GF4.34.38.D05.1.454.CMB.1.raw
  modified_base (278)..(278): a, c, t, g, unknown or other
  misc_feature (278)..(278): n is a, c, g, or t
  modified_base (408)..(408): a, c, t, g, unknown or other
  misc_feature (408)..(408): n is a, c, g, or t
  modified_base (616)..(616): a, c, t, g, unknown or other
  misc_feature (616)..(616): n is a, c, g, or t
  modified_base (672)..(672): a, c, t, g, unknown or other
  misc_feature (672)..(672): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctccagatcgccccggagtaattgtgttgacgcagtcgccagactacctgtctctgtcctccggaagggaaagacgcccacctcctcctgcgaggtcagtcacgtcgttactaaccaccgtacttctccgcctaggtaaccngacagacgtaccgtcggaccacggtccctaccgacggtcctacctctactttccgttttgggcgtccgtacccgaaccggacgggaccctcggtcggcctaccgtaccccgaaggaccgtacggttaccngggtacggaccgtagggtcggggttcgtacggggacacggtaccttcgtaccttccgtacctacctactaccaaccgtaggaccgttagggacctacgtaggtaacgttatttacggcttaggtacttacttcgtagtaactacgtggttcgtctaacgactaacgcggttacgtacgttcccggaacgtacgggaactaagggtaanaaccgtaacgaacgtacggtggacggtctcgacccacgtactttcgacgtttaccncttcgttacccccg

SEQ ID NO: 180808 - DNA, 654 bp, Homo sapiens
  misc_feature: GYAE6OF01BYH4J.34.38.D05.1.454.CMB.1.raw
  modified_base (208)..(208): a, c, t, g, unknown or other
  misc_feature (208)..(208): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagngccaccctctcctgcagggtcagtcagcgttactaacaccgtacttcttcgcctggtaccagcagacgacctggccaggcctcccgaggcctcccgtcattcgtttggtcgccgtccaccgagggcccacgtggcactccccgagactaggttcaggtcggacaggttcgggtctggggacctaggtaccctttcgaccttcctaccaaccctatccgacgcaacgtacttggacgtccgtaggtaacgttagttttcgactaagttattactttacgtgtacagtactaaagtgtaccggagaccgtacgtacgttcgggttacgggtccgtttaccgggaccgtaaacgggtaaccgaaacgggttaaggtaaaacgttacgaaaaccggtacgttacgggtacgggtactacggacctaaccgtacgttccgttcgttacccg

SEQ ID NO: 180809 - DNA, 662 bp, Homo sapiens
  misc_feature: GYAE6OF01DMOUZ.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagacgcccaccctctcctgcagggtcagtcagcgttctaacaccgtacttctcgcctggtaccagcagacgaccgtcggccacggcctccccgaggtcctcccgtcacgtttcgttttggcgtccgtcccaccgacgggcccacgtggccactcccaagtacaggttccaggtggcgtaggttcgggcgtagggacagtaccttcacttctaccgacctatacaacgacctaaggtacctttaggaccgtacccgttaaggtaaagttagttttacggactaaggttaacttactttacgtcggtacagtactaagtcgtacgaagaccgtactacgttggtacgggtccgttaccgggaacgtaaacggggactaaaggggtacggtaaaacgtaaccgaaaacgtaacgttaggtcggtacctagggtacccaacttcgttcgtcgtttaccccg

SEQ ID NO: 180810 - DNA, 472 bp, Homo sapiens
  misc_feature: GYAE6OF01BF4UM.34.38.D05.1.454.CMB.1.raw
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (429)..(429): a, c, t, g, unknown or other
  misc_feature (429)..(429): n is a, c, g, or t
  modified_base (433)..(472): a, c, t, g, unknown or other
  misc_feature (433)..(472): n is a, c, g, or t
tcagtacacgtgatcacgaccggtgctcgatttagtatctgatagttgggtttcacgtattacgagtgatgggactgacacaatctacgcggactccgtgaagggcccgattcaccccctccagagacaacgccaagaacacactatatctgcaaatgaacagtctgagagccgaggacacggctgtctattactgtgcaagaggtggctacaatcattggttttnatctcgtggggccaagggacaagtggtcaccgtctcttcagcctcacaaggccatcgtctccccngcncctgctcaggacgcacctccgagagcacgacggccggccctgggcctcgccgtgggtacaaagggaccttaaccgttccaatcaacggttgtaacctggacggccgggctgggaccaaagggccgactaagtagngcannnnnnnnnnnnnnnnnnnnnnnnnnnnnnnnnnnnnnnn

SEQ ID NO: 180811 - DNA, 718 bp, Homo sapiens
  misc_feature: GYAE6OF01BEQBV.34.38.D05.1.454.CMB.1.raw
  modified_base (309)..(309): a, c, t, g, unknown or other
  misc_feature (309)..(309): n is a, c, g, or t
  modified_base (711)..(711): a, c, t, g, unknown or other
  misc_feature (711)..(711): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
tcagtacacgtgatcacgaccggtgctcgatttagtatctgatagttgggtttggggggtccctgagactctcctgtgcagcctctggattcaccttcagtagtcactggatgcacgtgggtccgtcaagttccgagggaaggggctgggtgtgggtttcacgtattacgagtgagtgggactgacacaatctacgcggactccgtggaaggccgattccaccccctcagagacaacgccaagaacacactatatctgacaaatgaactagtctagagacgaccgaggacacggctgtcttattactgngacaaggtggtcgactacaatctagtttgtttgacttccgtcggtcggggaccaagggtactaagtcggtaccctacccggttcttccgttaccgaccgtccccgtacccgaacccgaaccgggtcccctaacggttccccggttccccgtttcccccgtcgggtccccgtccccgtccgcccgtacccggaacggtaccgacccctacccgtacccggaacgacccgaccgaccgaccgggcccggtaccccggtccgggccgtccggtcccgttacgggtacccgtaaaccggttacccgttacccttacccgtaccgtccgttacccgttaccggttaaccgtcgggtaccgggtccgggtaccggtaccggggaccgacgggaccgacgtaagtacgngcngngn

SEQ ID NO: 180812 - DNA, 722 bp, Homo sapiens
  misc_feature: GYAE6OF01CPXDE.34.38.D05.1.454.CMB.1.raw
  modified_base (534)..(534): a, c, t, g, unknown or other
  misc_feature (534)..(534): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggaagaaattgtgttgacgcacgtcgccagaccaccctgtctctcgtctaccgagggaagacgccaccctctcctgacgtagggtcagtcagtccgttactaaccaccgtacttccttcgccgtacggtaccagaccagtacgaccgtcggccgacggtcctaccggcggtccctaccgtcctagtttcgtttggtccgcccgttaccgaccggacggtccaaccgtcggaccacctacccgagtaccgtaggttccaggttcggcgtagggtcggtacggtggactacgtacttacgctccgtacactagtacgacgtacagtacgttacgacgtaccgttaaggtaacttagttacgtaacttagttaacttacgtttaacncgttaacgaactaagtaacttaacggacctaagggtaccctggttaacggttccggtcgggggtttaccgaccgggtaaaccggtaaacgggacccgggttaaaggtaaacgggtaacttaaacgggaaacccggttgttagggaaccggttctaccggtacctaaggtaccttgttacgttaacccg

SEQ ID NO: 180813 - DNA, 610 bp, Homo sapiens
  misc_feature: GYAE6OF01DC1LR.34.38.D05.1.454.CMB.1.raw
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
  modified_base (605)..(605): a, c, t, g, unknown or other
  misc_feature (605)..(605): n is a, c, g, or t
  modified_base (608)..(608): a, c, t, g, unknown or other
  misc_feature (608)..(608): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaagggctggtgttgggtttcacgtattacgagtgatgggactgacacaatctacgcggactccgtgaagggccattcacccccncaganacaacgccaaagaacacactatatctgacaaatgaacagtctagaagagccgaggacacggctagtctattactgtacgacaaggagggtcggactacgtaactctaaggtttgtttttagactcgtacggtcggggtaaccaaacggggtactaagtcgggtaccaaccgttctcgttccacggtccctaccgacgaaccgggcctaacgtccgttcccttccccgtggcccgtcctcgacgaccgaggacnccacctcggagaccncgacgacggccgccggtcgcgtcgcgtacggtacgtacgtaccttactaccgtatccgtagtcgtacgtacgtaggaccgggcgtcgacggacgtacggacgcgaacgtantgncg

SEQ ID NO: 180814 - DNA, 740 bp, Homo sapiens
  misc_feature: GYAE6OF01EHSCT.34.38.D05.1.454.CMB.1.raw
  modified_base (711)..(711): a, c, t, g, unknown or other
  misc_feature (711)..(711): n is a, c, g, or t
  modified_base (732)..(732): a, c, t, g, unknown or other
  misc_feature (732)..(732): n is a, c, g, or t
tcagtacacgtgatcacgaccggtgctcgatttagtatctgatagttggggtttgggggaggaactgctcagttaggacccagacggaaccatggaagccccagcgcagcttctcttcctcctgctactctggctccagacaccactggagaaatagtgatgacgcagtctccacgccctaccctgtctgtcgtactccggaaggggaacgacgccctaccctctctagcgacgggccagtcaggtagtggttggcagactaacgtacgtccgtacggtaccgacgaccgaacgaaccgtcggacccacgccctaccgacctacctccgttactaatttaacggtcggtcgactaactaccgtaccggaccgggtcccgtacggacctaacctacccgaacgggtaaccgtacggttccgagggtcggacggtagggttacgggtacgttacggggaactacgtacccttaccgtacgttaccgaccacccgtaactaccgaacgtaacggtacgtacgggaaccgtaccggttaataacggtttacgttttacggacgttaaggttacgttaagtttaccgttacgtacgtaaacgttgttaccggtctaaccgtaacgaccgtacgggtacgggtacgttaccgggaacggaacgggtaacggtaaggtacggtaaactaacgaaacggtcgtgggacgtgaccgtaanaccgtattaccgtagtcttcncgttcccg

SEQ ID NO: 180815 - DNA, 707 bp, Homo sapiens
  misc_feature: GYAE6OF01BABCF.34.38.D05.1.454.CMB.1.raw
  modified_base (159)..(159): a, c, t, g, unknown or other
  misc_feature (159)..(159): n is a, c, g, or t
  modified_base (221)..(221): a, c, t, g, unknown or other
  misc_feature (221)..(221): n is a, c, g, or t
  modified_base (677)..(677): a, c, t, g, unknown or other
  misc_feature (677)..(677): n is a, c, g, or t
  modified_base (696)..(696): a, c, t, g, unknown or other
  misc_feature (696)..(696): n is a, c, g, or t
tcagtacacgtgatcacgaccggtgctcgatttagtatctgatagttgggtttggggagagaagagctgctcagttaggacccagagggaaccatacggaaaccccagcgcagcttcctcttcctcctgctactctggcctcccagatcggccccgganaaattgtgttgacgcagtccgaccagaccaccctgtctctcgtcctaccggaaggggaaacnccgacccctaccctcctcctcggacgtagggtcctaagtccgacgtccgttaacctaacctaccgtactttccgtccgtcgtacggtaccacgaccgaaggaccgacccgtcggaccgaccggtccctacccggacgtcccttaccctcttacgtttccggtttcggtccgtacccgtcccgaaccggaccggccgtacgtccggactaccgtacccgaagtacgtacggtccgaggtcggtacgtaggtcggtaccggtaggaacctagtacccttcacctcgtacacctacgcagtcgtaacgtacgtcgaacgtacgtaagtaactttgttacgattaggtttaactaggtttaccagtacccgtaatactaaggtacgacgacgtaactcggtggtacgggttagtccgggacgaaccggaagtaccgtaaaggactaacgaacgaacggtntgacgtcctacgcacgttntccgttctacg

SEQ ID NO: 180816 - DNA, 622 bp, Homo sapiens
  misc_feature: GYAE6OF01BRD9U.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagaccaccctgtctctgtcctccgaaggggaaagcgccaccctctcctgcagggtcagtcagtcgttacctaaccaccgtactttcttcgcctaggtaccagcagacgacctggccacggctcccaggcctcctctagttcgtttggtcgcgtcccacgacgggccacgtgcactccagactaggttcagtgctaggtcgggtctgggacaggtacttcgacttcctacacctacgtacacgactacggtacgttcggacgtcccgtaggtaacgttagtttacgacgtaagttacttacgtttacgtcgtacacgtactaatacgtacgacgtacgtactacgtcggtcggtacggttacggacgaacggtacgaacgggtaacgaaacgtacgaaacggtacgtacggtaggtacgtacgactaaccgtcgttcgtgttaccg

SEQ ID NO: 180817 - DNA, 756 bp, Homo sapiens
  misc_feature: GYAE6OF01EN4ZF.34.38.D05.1.454.CMB.1.raw
tcagtacacgtgatcacgaccggtgctcgatttagtatctgatagttgggtttggggagagaagagctgctcagttaggacccagagggaaccatggaaacccagcgcagcttctcttcctcctgctactctggctccagactcgccccggagaattgtgttgacgcagtccgccacgactaccctgtctctgtcgtaccgaagggaacgacgtccaccctcgtccgtgacgtacgggtcagttcaggtacgttactaaccgaccgtacttcttccggcttacggtacacgacacgacgtaccgtcggaccacggtcctaccgacggtcctccgttctacgtttcggtttcggtcggtacccgtaccgaccggtacggtccctagtcgtacctacgacccgtagacgtacggttccgaaggtcggacgtacggtcgggttacgtagggtacctacgtacgttaccaccttcgtaaccaccgtagttacgacgtacgtaacgtacgttcacggtacgtacgtaagttacgtttacggacttaggttaacttacgttacgttacgtacgtaacgtacctaagtacggaccgtacgtaaccgtcgtaaccgttggggtaccggttaccggttaacgggtaccggtaaacggggtaaccgtaaacgggtaaacgggttaaacggtaaaccggaaacggttaacggttacggtaaccgggtacgtacccgtacgtaaccgtttaccgttcgttcggtttac

SEQ ID NO: 180818 - DNA, 651 bp, Homo sapiens
  misc_feature: GYAE6OF01EXLPN.34.38.D05.1.454.CMB.1.raw
  modified_base (151)..(151): a, c, t, g, unknown or other
  misc_feature (151)..(151): n is a, c, g, or t
  modified_base (232)..(232): a, c, t, g, unknown or other
  misc_feature (232)..(232): n is a, c, g, or t
tcagtacacgtgatcacgaccggtgctcgattttagtatctgatagttaggggtttagggggaggagaagagctgtcgtccagttagggacccagagggaaccactggaaaccccagcgctagcttcctcttcctcctgctacgtctcggntcccacgacgtagccccggagtaaattgtgttgacgcagtcgccagactacccttgtcgtactggtctcccaggggaaacngcccacccgtcctccgtgcgagggttcagtcacgtcgttctaactaccgacttacttcgacctggtaccagcagacgaacctggccaggtctaccaggctcctcgaatcgttttcggagccggtcaccgacgggccactggcaagtcccgagacagggtttccaacggtggacaggttgggtccttagggacccaagactttaccaacttctcaacctatacgaacgtcaagtacttgaacgtcctagtaacgtattttagacctagtaataactttactagtacagtacaagtactcggtacggtacgacgtaacgttaggtgggacgtacggtaaccggaaaggtaccgaaacggtagtaaacgtaacaaacggtaacctaggtagcgtacgttaccgaacctttacgtcttcgtcc

SEQ ID NO: 180819 - DNA, 984 bp, Homo sapiens
  misc_feature: GYAE6OF01CFVYT.34.38.D05.1.454.CMB.1.raw
  modified_base (224)..(224): a, c, t, g, unknown or other
  misc_feature (224)..(224): n is a, c, g, or t
tcagtacacgtgatcacgaccggtgctcgatttagtatctgatagttgggtttggggagagaagagctgctcagttaggacccagagggaaccatggaaacccccagcgcagcttctccttcctcctgctactctggctcccagatcgaccccggagaaattgtgttgacgcagtcgccagaccacctgtctctgtctacgagggaaagcgcccacctctccgngcgacgggtcacgtcacgtccgttacctaaccaccgttacttccgtccgccgttacggtacccagccgtaagacgtaccgtcggaccgtacggtccctaccccggacggtcccttcccgtacgttacgttttcggtttcggtaccgtcccgtacccgacccggtacgggaccctaccgttcggaccctaccgttaccccgaaacggtacgttacgggtttaccgaggttacgggtaccggttacggggttcggggttaccggttacgggtaaccctacggtttaaccccgtttaccgaccccttttcccgtaaacccgtacccgtaacgttacccggtaacggtaacccgttaaacgggtttaacccgtttaacgggtcccgtaaaccccggtttaagggtttaacgttttaaccggttttaacggtaacgtttaaaacggttttactttaaacggtttaccggttcgtaaaccggttacggttaaaaccttaacggtttaaaccggtaccggtaaaacccggtacccgggtacccggttttaaacggggtttccgggggtttaccgggggtttacccccgggttaaccggggggaaaacccggttaaaaccggggggttaacccgggtaaaaaggggtttaaacggaaaaacccggttaaacccggttaaaaccgggttaaacggttcggggttaaaccggttcccgtaaaccggttaccctaaacccggttttcgttccgttttaccggttaaccccc

SEQ ID NO: 180820 - DNA, 709 bp, Homo sapiens
  misc_feature: GYAE6OF01D4OJ1.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagaccaccctgtctctgtctccgaggggaaagacgcccaccctctcctgcgagggtcagtcagtcgttacaaccaccgtacttctcgccgtggtaccagcagacgaccgtggccaggcctcccgaggtcctcctctattcgtttggtcgccgtccgaccgacgggccctacgtcggacactcccgaagacgtaggttcgaggtcggctagggtcgggtcgtagggactacgtacttccgactcctacaacctataccgagcctaagtacgttaggacgtacccgttaaggtaagtttagtttcgacgtaaggtttacgttaactttaacgtacgtaacgtaacgttacggtttacggtacctaccgtaaccgtaaccggttaccgggtttaccgggtaacccgggtttaccggaacccgggtaaacggggtaacccgtaaaggggtaaccgtaaaacgtaaccggaaaacggtacggttgggtacggtacctacgaccctaccgttattccgttacgttcttaccgttaccg

SEQ ID NO: 180821 - DNA, 758 bp, Homo sapiens
  misc_feature: GYAE6OF01DJC2R.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagaccaccctgtctctgtctccgagggaaagacgcccaccctctcctgcagggtcagtcagcgttactaaccaccgtacttctcgcctggtaccagacagagacctggccacggcctacccgaggcctcctctacttcgtttggtcgtccgtcccaccggacgggcccacgtcggacctactccccgaagaccgtaggttccgaggtcgggccgtaagggttcgggtcgtagggacctaggtaccttcgacctccgtaccaacccgtaacttccgaacgtaccgtaacggtaaccgtttggaaccgtaccgttagtaaaggttacgtttttacgacgttaagttactttaacgtttaccttaggttaacgaacggtaacctaagttaacgtaccgggaacgtacccggtacgtaccgttacgggttaccggggtcccggtttacccggggaaccggtaaacgggggtaaacccgtaaaggggttaacggtaaaacgttaacgggaaaaaccggtaaacggttacgggtaccggtaccggttacgaaccccgtaaccgtaccgtttccgtcggttttaaccc

SEQ ID NO: 180822 - DNA, 761 bp, Homo sapiens
  misc_feature: GYAE6OF01AHMJP.34.38.D05.1.454.CMB.1.raw
  modified_base (211)..(211): a, c, t, g, unknown or other
  misc_feature (211)..(211): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagactcgcccccggagaaattgtgttgacgcagtccgccagaccaccctgtctctgtctccgaggggaancgcccaccctcctcctgcgtagggtcagtcacgtcgttacctaaccgtaccgtacctttccttccgtccgttcggtaaccagcgaacggaccgacccgtcggacccgacggccctccccgacggtccttccctactacgtttccggttttcggtcgtcccgtacccgacccggacgggtccctacggtcggacctaccgtacccacggtacgtacggttccgagggtcggtacggtagggttcgggtacggtacgggactacgtaccttcctaccttaccacctaacctacgtacgacgacgtacgtaccgttacggaccgtacgtaagtaacgttagtttacgacgttaagttaactttacgttacgtacgtaactacgtaacgttaacttccgtacggtaaccgtaccgtacgtacggttcggggttaccgggttaccggtacccggaccggtaaccgggaaaccgggtaaagggttaacggaaaccgtaaccgtaaaacggtcggtacggtacgacgtaccgacctaacgtacgtttctcggttacc

SEQ ID NO: 180823 - DNA, 637 bp, Homo sapiens
  misc_feature: GYAE6OF01EHVJ5.34.38.D05.1.454.CMB.1.raw
  modified_base (208)..(208): a, c, t, g, unknown or other
  misc_feature (208)..(208): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgaggggaaangcccaccctctcctgcgagggtcagtcagccgttactaacaccgtacttcttccgcctggtaccagcagagacctggccaggcctcccgaggcccttcccgtcattccgtttgggtcgccgtccaccgacggggcccacgtggacactcccagactaggttcagtggcaggtggtcngggacngtacttcactctcacntcagcacgtactagacgctagaagtattttgactagttatactttacgtacgtcaagtactaagtacgttacggacgaccgtactacggttcgggtacgggtccggtttaccgggacccggtaaacgggaccggaacgggtaacggtaaaaccgtaccgtaaaaacccggtacggtacgggtacggtaccgttaccgaccgtaacccgtacgtttccgttggtttacccg

SEQ ID NO: 180824 - DNA, 699 bp, Homo sapiens
  misc_feature: GYAE6OF01DLD8W.34.38.D05.1.454.CMB.1.raw
  modified_base (414)..(414): a, c, t, g, unknown or other
  misc_feature (414)..(414): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagaccaccctgtctctgtcctccgaggggaaaagacgcccaccctctcccgtgccgagggtcagtcagtccgttactaaccacccgtattctcgcctggtaaccagacgaagacgaccgtcggccaggcctcccgaggtcctcctcgattcgttggcgccgtcccaaccgagggccacgtcggaccactccccaagacgtaggttcgagtcggacgtaggtgggttcctagggaaccnggtacctcgacctctacacccgatcaagacacgtacgttgacgtactagtaacgttaattttcgacgtaagttaacttaacgttacttagtactagtacctaaagttaacgtacgaacggtaccgacgtaaccgttgggttacgggtcccggttaccggtaacccggaaaacggggtaaacccgtaaacgggtaacggtaaaaacgtaaaccggaaaaccggtaaacgttaacgggtcggtaaccgttacgaacccgtaaccctacgttccgttcgtttaacccg

SEQ ID NO: 180825 - DNA, 703 bp, Homo sapiens
  misc_feature: GYAE6OF01DY5LD.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagactcgccccggagaaattgtgttgacgcagtcgccagacaccctgtctctgtctccgagggaaacgacgcccaccctctcctgcgacgggtcagtcacgtccgttactaaccaccgtacttcctcgcctggtaccagcagacgaccgtggccaggcctcccgagtcctcctctattccgttggtcgccgtccaccggcggccacgtgacactccgagacgtaggtcaggtcgacgaggttcgggtcgtacggactacgtacttctaaccgttctaccacctactacgacgacctaaggtaccgttaggaacgtcccgtaaggtaacgtttacgtttacgacgttaaacgtttactaattttaccggtacgtacctaagtacctaaagttccgtaacggacggtaacccgtggttaaccggttggggtaccggggtacccgttaccgggaaaccggtaacggggtaaaccgttaaggggtaacggtaaaacgttaccggtaaaacggttcgggttgggtaccgtacttaccggaccctaacgttcttccggttgttaccccg

SEQ ID NO: 180826 - DNA, 752 bp, Homo sapiens
  misc_feature: GYAE6OF01EDS68.34.38.D05.1.454.CMB.1.raw
  modified_base (205)..(205): a, c, t, g, unknown or other
  misc_feature (205)..(205): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagaattgtgttgacgcagtcgccagacaccctgtctctgtctccgagggaaacncgccacctctcctgcaggtcagtcagtcgttacaaccaccgtactttcttcgccttggtaccagcgagacgacctggccaggcctcccgaggcctacctcattcgttggtcgtccgtccaccgtaggcccagttcggctacgtcccaagacgtacggttcaggtcgggactaggtcgggttcctaggggaactggtaccttaccgaccttcgtacaaacccgtatacccgtaacgaccgtaacgtacgtttacggacgtaccgtaggtaaacgttacgttttacggacgttaacggtttaactttaacgtttacgttacggtttactaacgttaccgtaaacgttacgttaaccggtaacggtaaccggtaccgttaaccggttggggttacgggttaccgggttaccgggaacccggtaacggggtaaaccccggtaaaggggttaacggtaaaacgttaaccggaaaaaccggttaaccgttacgggttaccgggtacgttacggacccgttaacccggtacgtttacccggttacgtttacccg

SEQ ID NO: 180827 - DNA, 507 bp, Homo sapiens
  misc_feature: GYAE6OF01EPSIE.34.38.D05.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
tcagtacacgtgatcacgaccggtgctcgatttagtatctgatagttggttttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacnccgacttcttcgcctggtaccagcagagacctggccaggctcccaggctcctcatctttggtgcgtccaccagggccactggcatcccagacaggttcagtggcagtgggctgggacagacttcactctcaccatcagcagacttgagccctgaagtattttagctagtatattactgtcagcaatatcgagacgcactgtgggcgttcgcaagggaccaaaggtggaaatacaaacgactgtagcgtgacaccatcgtgttc

SEQ ID NO: 180828 - DNA, 916 bp, Homo sapiens
  misc_feature: GYAE6OF01E5DD9.34.38.D05.1.454.CMB.1.raw
tcagtacacgtgatcacgaccggtgctcgatttagtatctgataggttggggtttggggagagaagagctgctcagttaggaccagagggaaccatggaaaccccagcgcagcttctcttcctcctgctactcgtggcctccagatcggtccccggtagaaattgtgttagacgtcagtccgcagaccacctgtctcgtgtctcgaagggaacgacgcctacctcgtcgtgcgtaggtctagtcagtcgttacctaaccgtaccgtacttcgttccgtccgtacggtaaccagacgtacggtaacgccgtcgggacccgacggtccctaccgtacggtcctacctacgtacgtttcggtttacggtcggtccgtaccgaaccggtacgggtaccctaacgtcggactaccgtacccgaagtacgtacggttactacgggtcggacgtgggttacgggtacggtacggaactaacggtaccttaccgacttaccgacctaaccgtaactaccgtaaaccgtaaggtacgtacgggaacgttaccggtaagtaaacggtttacgtttcggaacgttaacgttaagtttacgttaaccgtaccgttaacgtaaaccggttttaccggtttagttaacccgtaccgtaaacccggttaacggttaccgggggtttaaaccgggtaacccggggtttaaacccgggtaacccggggaaaaccggggggttaaaaccggttaaaacggggggttaaaaccgtaaaaaccggtaaaacccgggttaaaaaacggtttacggggttacccggggtttaacgggtaaacccggtttacccgaaacccggtttaaacccgttacggtttacccgttaacccgggttttaaacgtttaaccccggttacccggttttaaccccccgg

SEQ ID NO: 180829 - DNA, 651 bp, Homo sapiens
  misc_feature: GYAE6OF01CPQKE.34.38.D05.1.454.CMB.1.raw
  modified_base (247)..(247): a, c, t, g, unknown or other
  misc_feature (247)..(247): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaattgtgttgacgcagtcgccagaccacctgtctctgtctccgaagggaagacgccaccctctcctgcgaggtcagtcagtccgttctaaccnccgtactttctcgtccgtcggtaaccagcaagacgaccgtcggccaggccctaccgcggcctcctcgtactccgtttgtacgcctccgaccgacgggccacgtcggcactccgaagacgtacggttcaggtggacgtagggtcgggtacgtagggacctaggtaccttccgaccttccactaaccgacttacgacgtcaaggtaccttcgacgtccgttaagaagttcgtttagacgttagttagttacttacgtcgttacaagttcggttacgtactaccgtaactacggtgtaccggtacgtaaccggaccggtaacggaaccgtaggtaaacgtaataaccgtaaaacgtacgtaggtcggacgtacgtacaccgttattcgttacgttccgtcttacccg

SEQ ID NO: 180830 - DNA, 787 bp, Homo sapiens
  misc_feature: GYAE6OF01B6QZM.34.38.D05.1.454.CMB.1.raw
tcagtacacgtgatcacgaccggtgctcgatttagtatctgataggttgggtttggggagagaagagctgctcgagttaggacccagagggaaccatggaaaccccagcgcagcttctcttcctcctgctactctggctccagatgccccggagaattgtgttgacgcagtcgccagacacctgtctcgtcgtcgtaccgaaggggaaagacgccacccgtctccgtcgcgtagggtcaggtcacgtccgttacctaaccaccgtactttcttacgccgtacggtaccacgcgtacggacgaccgtcgggaccacggcctacccgacggtcccttcctctacgtttcgttttacgggtcgtacccggtaacccgaaccggaccggggtccctacggtcggaccctaaccgtaccccgaggtaccgtacggttcgaacggttcggacgtacgggttcgggtacggtacgggaacctacggttaaccctttcgaaccgttcctaccgtaaccgtacgtacgacggtaccaaggttaccgttagaacggtacccgttaaggtaacgtttagttttacgacgttaagttactttaacgttaccgtagtacgtaacgtactaacgttacgtacggacgtaccgtcgtacggttcggtacgggtaccggttaccgggacggtaaaccgggtaacgtaacggggttaacgtaaaaccggtaaccgtaaaacggtaccgttacggggtaccgtacgtaccgacccgttaaccgtacgttccgttacggttacccg

SEQ ID NO: 180831 - DNA, 257 bp, Homo sapiens
  misc_feature: GYAE6OF01AXMF0.34.38.D05.1.454.CMB.1.raw
  modified_base (254)..(257): a, c, t, g, unknown or other
  misc_feature (254)..(257): n is a, c, g, or t
tcagtacacgtgatcacgaccggtgctcgatttagtatctgatagttgggtctgggacagacttcactctcaccatcagcagacttgagcctgaagattttgcagtatattactgtcagcaatatcgagacgcactgtgggcgttcggccaagggaccaaggtggaaatcaaacgaactgtggctgcaccatctgtcttcatccttcccgcatctgaatcacgtgtactgaggcggctggcgaaggcgcatagnnnn

SEQ ID NO: 180832 - DNA, 921 bp, Homo sapiens
  misc_feature: GYAE6OF01D5SXC.34.38.D05.1.454.CMB.1.raw
  modified_base (894)..(894): a, c, t, g, unknown or other
  misc_feature (894)..(894): n is a, c, g, or t
tcagtacacgtgatcacgaccggtgctcgatttagtatctgataggttgggtttggggagagaagagctgctcagttaggacccaggaggaaccatacggaaacccagcgcagcttctcttcctctgctactcgtggcctccgagacgtccggaccccggaagtaaagttggtgttacgaccgcacgtccgaccagaccctaccgtgtcctcgtgttaccgaccggaagggaacgccgacccgtacccgtcctaccgtcgacggtggtactacgtccgacggttccgttaacctaaccgtaccgttaccgtttaccgttaccgtaccggttacggaaccgacggacgaacggtaaccgcccggtcggtaccggaccgtccgtacccggacgtcccttaccgtacgttcgtttcggtttacggccgtacccgtaccgaccgggtaccggactaccggtacggaccttaacccgaccggtaacgtaaccgggttacgggttaccgacgggtacggtaacggggtcgggttaccggggttacgggtaacggaaccgtaccgtttaacccgggttacctaccggttaccaacctaaccggtaacgtaccgaaacggttcgggtaaacgttccggtttacgggaaacccgtttacggttaacggtaacgtttttaggttacccgaagtttttaaccggtttaactttaacgtttacctacggtaacgtaaacgtaccttaaacggttagaacccgtaggtaaccgtacccggtttacgggaccggggttacgggtaccgggtaaccggaaacgggtaaaccggggtacgtaaagggtaaccggtaaaacttaacgggtaaccgttaccggttagggtaccgaacccgttcgtaaacccnccgttttccgagttttacccgtaacgg

SEQ ID NO: 180833 - DNA, 828 bp, Homo sapiens
  misc_feature: GYAE6OF01E328E.34.38.D05.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaangccaccctctcctgcagggtcagtcagcgttctaacnccgacttcttccgcctggtaccagcaggacgacctggccacggcctccccaggtcctccctcctacttccgttttggtcgtccgtcccgaaccgtacggggcccaacgttcgggccacctaccccaaggaccgtacgggtttccacggttggccgtagggttcggggtccgttacgggggaacctaacggtacctttccgaccttcccggtacccaacccgtacgtaccgtaacgccgaacggtaaccgtttacggacggtaccccgttaacggtaaacggttacgttttttacggacccgttaaagggtttaactttaacgttttaaccgttcggttaccgtaacgtaaccgtaaaacgttacgttaaccggaacggtaacccgggtaccgttaaaccggttcggggtttaccggggttacccggggtttaccggggtaacccggtaaaaccggggggttaaacccgaaaaggggtttaaccgggtaaaaacgttaacccggtaaaaaaccggtaaccggttacgggttacggggtccgttaaccggacccgtaaacccttacgttaccgttcggtttacccg

SEQ ID NO: 180834 - DNA, 774 bp, Homo sapiens
  misc_feature: GYAE6OF01EDV55.34.38.D05.1.454.CMB.1.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (765)..(765): a, c, t, g, unknown or other
  misc_feature (765)..(765): n is a, c, g, or t
tcagtacacgtgatcacgaccggtgctcgatttagtatctgatagttgggtttggggagagaagagctgctcagttaggggacccagacggaaccatggaagccccagcgcagcttctcttcctctgctactctggcctcccagactaccactggaagtaaatagtgatcgacgcagtcctccacgccaccgtgtctgtctcgtacgaggggaaancgtccaccctctccgngcgacgggccagccagtagtgtacgcagactaacgttggccgtaggaccagacaacggaaccgtcggaccgacggtcccaccccgacggtcccttccgtactaacttccgttagtcgggtacaccgtacctacccgaaccggtaccgggtaccctacggtcggttaccctacccggacgtacccggttagggttaccggacggtcgggtacggttacggggttcggggttaccggtaacggggaacttaaacggttaccgtttaccctaaccgttacccgttaccgaacctacggttaccacgtaccgtaccgtccgtacgacgtttacgtcgttaacgttaacgtttcgtttacgtacttttaagttttactacggtagtaccgtacgtaacggttagttaaacgttaccgtacggttaccgggacccgggttacgggtaccgtaccgggtaaccggaaagggtaccggtaaaggttaacgtaacggtaaacccgtacggttagtacggtccggactaccggactaccggtntttacccgg

SEQ ID NO: 180835 - DNA, 714 bp, Homo sapiens
  misc_feature: GYAE6OF01A54GE.34.38.D05.1.454.CMB.1.raw
  modified_base (207)..(207): a, c, t, g, unknown or other
  misc_feature (207)..(207): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgacgcagtcgccagacaccctgtctctgtctccgaggggaaanacgccaccctctcctgcgagggtcagtcagtcgttacaacaccgtacttcgttcgccgtcggtaccagcaaggacgacctcggccacggtccctacccgaggtcctccctctacgttcgttttgggtcgtccgtaccaccggacgggccctaacgtcggacctacgtccccaaggtaaccgtacgggttacaagggtcggcgtaggggttcggggtacgtacggggaacctacggtaccttacgtaccgttaccctaccgaacctacgttaccgaacggtaccaacggttacgtttacggaaccgttcccgttaaggaacgtttacgttttcgaacgttaagttaatttactttacggttacgtactaagtacctaagttaacgtacgacggtacgcgtacgtgggtcgggtaccggttaccggaccggtaacgggaacgtaacgggtacgtaaacgtaccgaaacggtcgtaggtcgacgtcgacctactacgttcgtacgttacc

SEQ ID NO: 180836 - DNA, 763 bp, Homo sapiens
  misc_feature: GYAE6OF01A0EVG.34.38.D05.1.454.CMB.1.raw
  modified_base (217)..(217): a, c, t, g, unknown or other
  misc_feature (217)..(217): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagactcggcccccggaagaaattgtgttgacgcagtccgccagaccaccctgtctctgtcctaccgaaggggaaacngcccacccgtcctccgtgcgagggtcagtcagtccgttacctaaaccaccgtactttccgttccgccgttaggtacccagcgaagacgacccgtggccgacggtccctaccgacggtcctccttactagtttccgtttgggtcgtccgtacccgtttaccgggacgggccctaacggtcggacctaccgtcccgaacgtaacgtacggttcaggtcggcgtacgggtgggtacgaggggactagtaccttaccgaccttcctaccgaacctacgtcgacgtacgacggtacgttaggaccgtacctaaggtaacgtttagttttaccgaacgttaagttagtttaactttaccgttacgtacgtaacgtactagtacgtaacggtacggaccgtacgtacggttcggggttcgggtacccgggttaaccgggaaccgggtaaacggggtaaccgtaaacgggggttaacggaaaacgttaaccggtaaaacggtacggttcgggtacggttccgtacggtaccctacgttacgttgttccgttacg

SEQ ID NO: 180837 - DNA, 686 bp, Homo sapiens
  misc_feature: GYAE6OF01AOQZD.34.38.D05.1.454.CMB.1.raw
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
  modified_base (544)..(544): a, c, t, g, unknown or other
  misc_feature (544)..(544): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctgctcccagatcgccccggagaattgtgttgacgcagtcgccagaccaccctgtctctgtcnccgaagggaacgcgccaccctctcctgcgaggtcagtcgacgtcgttacgaaccnccgtactttctccgcctacgtaccagcaacggcgaccgtcggcccgagacctccacggtcctcctctactttcgttggcgtccgtccgaccggaccggaccncgtacgccactaccaggactaggttaccgaggtcggacgtacgggttggtacgngggaactacggtaccttacgaccttctaccctaacctagaccgtacgacgtaagtacgttacgggacgtaccttaaggtaacttcgtttacggacttaggtttaacttaagttacggtcgtaactacgactaaagtacncggaacgtaccggtacgtacgttcgggtaccggtacgttaccgggaaacggaccgggtaacggtaacggtaaacggaaccgtaacgaaacggtacggtaccggtcggaacgtaccgtacaaccgtgttaccgtccgttaccg

SEQ ID NO: 180838 - DNA, 801 bp, Homo sapiens
  misc_feature: GYAE6OF01B5QJV.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagaattgtgttgacgcagtcgcagacacctgtctctgtctcgagggaagcgccaccctctcctgcgtacggtcagtcgacgtcgttactaaccaccgtacttctcgccgtacggtaccagacagacgaccgtcggaccgacggtcctacccgacggtccctcctctactttcgtttcgggtccgtccgtacccgaaccggacgggaccctaccggtcggacctaccgtacccgaacgtaccgtacgggttcgacggttacggaccgttagggttcggggtaccggtacggggtaaccgtaacggttaaccgtttaccgtaccgttacccgtacccgtaaacccgtaacgttaccgaaacggtccgtaaacggttccggtttaacggaacccggttaacccgtaaagggtttaaacggtttaacgttttccggaagttaacgtttaacgtttaacgtttacgtacggtaacgaaggttaactaagttaacgtaccgaaggtaccggtaccgtacggttcgggtacggttaccgggttaccggaaccggtaaacgggaacgttaaaggggtaaccgtaaaggaaccggtaaaacggtacgtacgggtacggtacccgtacgacccgtaacctcgtttaggtcccgtttaccg

SEQ ID NO: 180839 - DNA, 766 bp, Homo sapiens
  misc_feature: GYAE6OF01DAXPI.34.38.D05.1.454.CMB.1.raw
  modified_base (156)..(156): a, c, t, g, unknown or other
  misc_feature (156)..(156): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (505)..(505): a, c, t, g, unknown or other
  misc_feature (505)..(505): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctccagatcgcccccggaanaaattgtgttgacgcagtcgccagaccacctgtctctgtctaccgagggaaagcgccaccctctcctgcgtagggtactagtcacgtccgttacctaaacaccgtacttcgttcgtccgtacggtaccagacacggacgtaccgtcggaccgacggtcctcccgacggcctccgtacgtacgtttccgtttggccgtccgaccgtaccggacgggtacctacgtacggtacctacccgacggtaccgtacggtcagggtcggtacgtacgggtgggtcgtaggactacgtactcnctacacgactntacgngactcgtacctgtacgtaacgtcgtaagtaacggtttnttacggactttacgtttattaccgtgttacgactaacgttaagttaactaaacggttaccggttccgggtaccccggggtttaacggggcccgtttaaccgggaaccgggttaacggtaaacccgggtaaagggtttaaccggaaactttaaacccgggaaacgttaaaccgggttaggggttccggaacctttaacgggaccctaacgtttcgggttacctttacccggttttaccaaccggtttccctttaacccccgg

SEQ ID NO: 180840 - DNA, 736 bp, Homo sapiens
  misc_feature: GYAE6OF01AZ52V.34.38.D05.1.454.CMB.1.raw
  modified_base (154)..(154): a, c, t, g, unknown or other
  misc_feature (154)..(154): n is a, c, g, or t
tcagtacacgtgatcacgaccggtgctcgatttagtatctgatagttgggtttggggagagaagagctgctcagttaggacccagagggaaccatggaaaccccagcgcagcttctccttcctcctgctactctggctccagatcgccccgganaaacttgtgttgacgcagtcgccagacacctgtctctgtctcgagggaaagacgccaccctcctcctgacgacgggtcagttcgaacgtcgttaccaaaccgtaccggtacctttcgttccgtaccgttacggtacccgaagaccgaaggtacggtacccgtgggaccctacggtcccgttacccgacgggtccttcccttacgtacgtttcggtttcggtcgtccgtacccgacggaaccggtccaacgtcggacacgtacccgtaagtaccgtacggttccaaggttcggcgtacgggtcgggtacgtggggtaactacggtaccttctacgtacctaccgtaaccctagtccaacggtactaacggtacgttacgacgtaccgtagtaacgttgtttacgactaagttagttaacgttactacgtacgtactacctaagttacgtacggagtaccgtcgtagttcgggtcggtaccgggttcgggaacccggtaagggtaaccggaagggttaaacgaaacgttacgaaacggtacggttacggtacgttacgtacgacctacgacttccgtcgttacc

SEQ ID NO: 180841 - DNA, 754 bp, Homo sapiens
  misc_feature: GYAE6OF01EOMDP.34.38.D05.1.454.CMB.1.raw
  modified_base (158)..(158): a, c, t, g, unknown or other
  misc_feature (158)..(158): n is a, c, g, or t
tcagtacacgtgatcacgaccggtgctcgatttagtatctgatagttgggtttggggagagaagagctgctcagttaggacccagagggaaccatggaaaccccagcgcagcttctcttccgtcctgctactcgtggcctcccagactcgccccgganaaacttgtgttgacgcagtcgcagacctcctgtctctgtctccgagggaagacgcccaccctctaccgtgaccgagggtcagtcacgtacgttacctaacctaccgtacttcgttccgccgttcggtaccagcgaacggtaacgtacccgtggacccgaggtccctacccgaacggtcccttccgtactacgtttccgttttgggacgtcccgttaccaccggtacgggcctacgttcggctactacccgtagaaccgttcggtaccaggtacgccgtaggttcggtcgtagggaccgtataccgttcacgtacctacgacctagtacctacgtacgaacgtacgttagacgtcgtaagttaacgtacgtttacgacgtaagttaacttacgttacgttacgttaccgataccgtaagtacggtaccgttaacggacctaccgtacgtcgggttaccggtaccgggtttaccggaaccggtaaacggggtaaccgtaaagggttaaccggttaaactaaccgggtaaaacgtccgggtaacgtaccgggttaccggtacgtaaccccgtaacgtaaccttccgttacgttaacccg

SEQ ID NO: 180842 - DNA, 737 bp, Homo sapiens
  misc_feature: GYAE6OF01AYXAP.34.38.D05.1.454.CMB.1.raw
  modified_base (169)..(169): a, c, t, g, unknown or other
  misc_feature (169)..(169): n is a, c, g, or t
  modified_base (333)..(333): a, c, t, g, unknown or other
  misc_feature (333)..(333): n is a, c, g, or t
  modified_base (390)..(390): a, c, t, g, unknown or other
  misc_feature (390)..(390): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaatagtgatgacncagtctccagccaccgtgtctgtcgtcgtccgaagggaaagacgtccgacccttctccgtgccgagggccagccagtagtgttagctagctaacgttgccgtgtaccagacaacgaaccgtcggaccacggcctcccgaggcctcctactatccgtagtcggtnacactccgacgacggtcctacgtcgtacctaccggacgtccgtaacgtcgtacgggngtaccggtagggtccggtcggtacggtacgtaacgtacgtttaccaacgttccctccgtaacctagttaccgacgtaccgaacggtcccttacggaacgttaccggtacggttaagacggtttagttttacggtctttaactttaacggtttaccgtagttaacctagtaacgtttaacgttaacgtaacgttaccggtaccggggttccgtacccggggttacggttcccggtaaacccggtaacgggtaccggttaaacgggaacgttaacgttaaccggaaaccggttacggtaggttccgaacgttaccggtactaaacggttcttaccgttacggttacccc

SEQ ID NO: 180843 - DNA, 1103 bp, Homo sapiens
  misc_feature: GYAE6OF01AG9IH.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctccttcctcctgctactctggcctcccagatataccgacggagtaaattgtcgttagacactagtcctccgacggtcctaccccgttgtttccgtttcgttaccgtaccgggaaaggggggtaaaaccgaccgtaccccctaaccccttcccgttaccccgtcgggacccggaaccgggggacccctaagggttaccgaacggttaaggttttaacggttttaaacgtaaccggtacttaaaccgtttaccgttttaaccggttaccggttacccggttaacccgggtaaccgaacggtaaccgaaaaccccgggttaaaacccggtcccggggtaacccctaacccggtccccccccgttaacccgaaaccgggttaccccccttttacccgtaaaaccgttttaaggtttaaccggtacgggttaacgaaacctttaaaccgtacccggtaacccggggtaccccgggtaccccggtacggtaacccctaaccggttaacccggtaacgtaaccggttacggttacggacgggttacggtaccgggttacggggttcgggttaaccggtacggtacggttaacgttaccctaaccgttacccgttacgtaaccccaacttaacccgtaaccgtaacccgtaacggttaccggacggtaacccgggtacttaaacggtttaacgtttaccgtttaggtaccggtttaacgttacgtttaaccttaacggttaccggttaccgttaaggttccgtttaacccgtacgttaacccgtaaccggttaaccggttaccggggtaaccccgggtttaaccgggtaccccgggtaaaacgggaacgggtttaaacccgggtaaacggggtaaaacgtaaaaccggtaaccgggttaaacccggttacgggttaacgggttcccgaccgttacccgtaacccggttaccgttacgtttactttcccccgggtttaattacccccggtttaaccc

SEQ ID NO: 180844 - DNA, 737 bp, Homo sapiens
  misc_feature: GYAE6OF01BFDHD.34.38.D05.1.454.CMB.1.raw
  modified_base (211)..(211): a, c, t, g, unknown or other
  misc_feature (211)..(211): n is a, c, g, or t
  modified_base (588)..(588): a, c, t, g, unknown or other
  misc_feature (588)..(588): n is a, c, g, or t
  modified_base (597)..(597): a, c, t, g, unknown or other
  misc_feature (597)..(597): n is a, c, g, or t
  modified_base (721)..(721): a, c, t, g, unknown or other
  misc_feature (721)..(721): n is a, c, g, or t
tcagtacacgtgatcacgaccggtgctcgatttagtatctgatagttgggtttggggagagaagagctgctcagttaggacccagagggaaccatggaaacccagcgcagcttctcttcctcctgctactctggcctcccagactcgaccccggagtaattgtgttgacgcagtcgccagaccacctgtctctcgtcgtaccgaagggaanccgccctacctcctccgtagcgtacgggtacacgtacgacggtccgtttaccgaaccgtacgttacctttccgtccgtccgttacggaccacggactaacggacggtacccgtcgggaccaccggtccctaacccgtcggtcccttcctacgtacttttccggtttcggtccgtacccgtacccacccgggtacggaccctaccgttcggacctaccgtacccgtagtaaccggtcggttacggaggtaccggtacgtaggggttcggtcgttacggggaactacgttacccgtactccgttccaaccgtaacgtctacgaacgtcgtacgtacgtcgactacggtatacgttagttacagtaacttatcttacgtnagaacgttnaactcgtacgacgtaactccgtaaggttcgtaccgggtccgtaacgggacgtaacgggaccgtaaggtaacgaaactaaccggaaggttcgtacgggtacgacccgttacgaccgttaaaccgnttccggttacttaccg

SEQ ID NO: 180845 - DNA, 721 bp, Homo sapiens
  misc_feature: GYAE6OF01BTFG3.34.38.D05.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (457)..(457): a, c, t, g, unknown or other
  misc_feature (457)..(457): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccgganaattgtgttgacgcagtcgccagacaccctgtctctgtctcgaagggaacncgcctacctctcctgccgagggtcagtcagtccgttactaaccaccgtctttcgtcgcctcggtaccnggaccagacgtaccgtcgaccacggtcctacccgaggcccttccgtactacgtttcgtttggacgtccgttacccgaccgaggccctaacgtcggactaccgtacccaaggtacctaggtacgacgtgggacgagggttacggcggtacggacctaagtacctttcgaccttctacccgaactancgtaacgctaacggtacgttacggactacgttagaacgtttattttacgacttaagttacgttactttaacgtcttacgaacgtaacttaagttaccgaacggtcgaacccgttacgtacggttcggttacggttacccgggttaaccgggtacccggtaaagggtaacccgttaaagggtaacggttaaacgtaaaccggaaccgggttaaacttacggggtcgtaccggtaactaccgtaaccgtacgttcgtttcgtaccg

SEQ ID NO: 180846 - DNA, 807 bp, Homo sapiens
  misc_feature: GYAE6OF01AUJY2.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagactcgcccccggaagtaaattgttgttgacgcacgtcgccagaccacccttgtctctgtcctaccggaaggggaacgacgcccacctctccgtgacgaggtcagtcacgtcgttaccaaccaccgtacttccgttaccgccgttggtaaccagcaacggaccgaccgtcggaccgacggtccctaccgacggtcccttacctcgtacgttttccgttggtccgtacccgtccgtaaccggcgggtaccaggttccggacctacgtaccccgtaggtaccgttacggtcgtaggtcggtaccgtagggttcgggtacgtacgggactacggtaccttcgtaccttcctacgacctacgtacgacgtacgtacgtacttacggacgtacgtagtaacgttagtttacgacgttaagtttacttaacgtttacgttctaacgtacgtaataactaaccggtacggaaccgtaccggtacgttacgggtaccgggttaccgggtccggttaaccggggtaacccgggtaaccgggtaaaccgggtaaggtaaaaccgggtaaaccgtaacccgggttaaaaacggttaccggttaccggggtaaccggttccgtaaacccggttacccgtaaaccgttaccggtttaacccgtttccggtttaacccg

SEQ ID NO: 180847 - DNA, 330 bp, Homo sapiens
  misc_feature: GYAE6OF01ALHB6.34.38.D05.1.454.CMB.1.raw
  modified_base (301)..(330): a, c, t, g, unknown or other
  misc_feature (301)..(330): n is a, c, g, or t
tcagtacacgtgatcacgaccggtgctcgatttagtatctgatagttgggtctgggacagacttcactctcaccatcagcagacttgagcctgaagtattttgcagtattattactgtcagcaatatcgagacgcacgtggtgggcgttcggaccaagggaccaagggtagaaatccaaaacgactgtggctgcaccatctgtcttcacttccttccccgctacttcgtagtaactccgtacggttcgttaaccgtgggacggggtccggggacgtcggaccgaaagggccactaagtggnnnnnnnnnnnnnnnnnnnnnnnnnnnnnn

SEQ ID NO: 180848 - DNA, 799 bp, Homo sapiens
  misc_feature: GYAE6OF01BKO7Z.34.38.D05.1.454.CMB.1.raw
  modified_base (180)..(180): a, c, t, g, unknown or other
  misc_feature (180)..(180): n is a, c, g, or t
  modified_base (227)..(227): a, c, t, g, unknown or other
  misc_feature (227)..(227): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagaattgtgttgacgcagtcgccagaccncctgtcctcgtcgtctaccgaaggggaaacgacgcccacctctccgngcgagggtcagtcacggtccgttacctaaccaccgtactttccgttccgtccgttacggtaccgaacggacctaacggaccggtaccgtacgggacccgaaccggtcccgtaccccggagggtcccttccctacgtacgtttccggtttcggtccggccgttacccgaccggacggggtcccctacggtccgggccctacgtaacccgtacggtaacggtacggttccgaagggtcgggcgtaagggttcggggtcggtaaccgggacgtacggttaaccttaccgtaaccttcccgtaacccgaaccgttacgtacgaaccgtaccggtaaacgttacgtttaacggacgttaaccggtaacggtaacgtttaacgtttacggtacttaaacggtttacttaacgtttacgtagttaaccgtaacgtaactaacgtagtaccgaacggaccggtacgtacgggttggtaccgggttccgtaacgggacggtaacgggaaaggtaacgggtaacgaaacgtaacggaaacggtcgtacggtacgacgtacaccgtacaacgttcgtacgtcc

SEQ ID NO: 180849 - DNA, 489 bp, Homo sapiens
  misc_feature: GYAE6OF01A96JA.34.38.D05.1.454.CMB.1.raw
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (437)..(437): a, c, t, g, unknown or other
  misc_feature (437)..(437): n is a, c, g, or t
  modified_base (440)..(442): a, c, t, g, unknown or other
  misc_feature (440)..(442): n is a, c, g, or t
  modified_base (445)..(446): a, c, t, g, unknown or other
  misc_feature (445)..(446): n is a, c, g, or t
  modified_base (449)..(452): a, c, t, g, unknown or other
  misc_feature (449)..(452): n is a, c, g, or t
  modified_base (454)..(457): a, c, t, g, unknown or other
  misc_feature (454)..(457): n is a, c, g, or t
  modified_base (459)..(474): a, c, t, g, unknown or other
  misc_feature (459)..(474): n is a, c, g, or t
  modified_base (476)..(489): a, c, t, g, unknown or other
  misc_feature (476)..(489): n is a, c, g, or t
tcagtacacgtgatcacgaccggtgctcgatttagtatctgatagttgggtttggggggaagaggaagactgacacaatctacgcggactccgtgaagggccgattcacccctccagagacaacgccaagaacacactatatctgcaaatgaacagtctgagagccgaggacacggctgtctattactgtgcaagaggtggctacaatcagttggttttgatctcgtggggaccaagggacaagtcggtcaccgtctcttcagccctccaccgagggcccatccggtccttccccnggccgcccctgcctcccgaggcnccacccgtccgagacgcacgacgccgggccctgggctagcgtggtaccgaaggtacctaccttccattaccgcgttagtactggacggcggtcgtgggaccgagggcctacaatacgntannngcnngtnnnnannnnannnnnnnnnnnnnnnncnnnnnnnnnnnnnn

SEQ ID NO: 180850 - DNA, 642 bp, Homo sapiens
  misc_feature: GYAE6OF01C61MB.34.38.D05.1.454.CMB.1.raw
  modified_base (455)..(455): a, c, t, g, unknown or other
  misc_feature (455)..(455): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatcgcccccggagaaattgtgttgacgcagtcgccagaccaccctgtctctcgtctccgaaggggaaacacgccaccctctcctgcgaggtcaagtcagtcgttactaacaccgtacttcctcgccgttaggaaccagacaggacgtaccgtcggaccacggtccctacccgacggtccctcctctacgtttcgttttcggcgtccgtacccgaccggtacgggccctaacgtcggactacgtaccccgaagaccgttacgtcgacggtcggacgtagggtcggtacgtagggactacgtaccttcgactcnctaacatcgagtcacgtactgacgtaccgtaagacgttagttgacgtaagttatacttatcgtacaagactaactgtacgacgacgcgtacgtggtaccggtcggttaccggaccggtaaggaaccgtaaaggtacggaaacgtacgaaacgtgtcggtacgcgtacgactactactcgtcgttacc

SEQ ID NO: 180851 - DNA, 706 bp, Homo sapiens
  misc_feature: GYAE6OF01C4R63.34.38.D05.1.454.CMB.1.raw
  modified_base (180)..(180): a, c, t, g, unknown or other
  misc_feature (180)..(180): n is a, c, g, or t
  modified_base (644)..(644): a, c, t, g, unknown or other
  misc_feature (644)..(644): n is a, c, g, or t
  modified_base (666)..(666): a, c, t, g, unknown or other
  misc_feature (666)..(666): n is a, c, g, or t
tcagtacacgtgatcacgaccggtgctcgatttagtatctgatagttgggtttggggagagaagagctgctcagttaggaccagaggaaccatggaaacccagcgcagcttctcttcctcctgctactctggcctccagatcgaccccggagtaattgtgttgacgcagtcgcacgaccncctgtctctcgtctaccggaagggaaacacgacccaccctctccgtagacgacggtcacgtacgacggtacttactaaccaccgttaccttcgtccgtccgtagtacccgagacgtacggaacgtccgtacggaccgacggcctccgagtccctccttactcgtttcgtttcggcgtccgtacccgacggtaccggacctacgtcgacctactccgacgtaacgtcgtaccgtggtacggcgtagggtcggtacggtacgacgtacgtacctacgtacttccgactacacgtaccgaacgtacgtccgtaggaccgtacgtattaacgtttcgttacggcgttaagttacgttacttagtaccgttagtacggttgttaccgtactcgaacgtacgtacgggtcggaccggttacgacggtaacggtacggtaaaggtaacgtaaccgaaacgacgttaacggnggttacgtccgacgttaaaccncgttaacttcgtccgtttaacttcccggttacttcccccg

SEQ ID NO: 180852 - DNA, 726 bp, Homo sapiens
  misc_feature: GYAE6OF01DE1XM.34.38.D05.1.454.CMB.1.raw
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
tcagtacacgtgatcacgaccggtgctcgatttagtatctgatagttgggtttggggagagaagagctgctcagttaggacccagagggaaccatggaaacccagcgcagcttctcttcctcctgctactctggctcccagactcgccccggagaaacttgtgttgacgcagtcgccagcaccctgtctctgtctaccgagggaagcgccaccctctctgcgagggtcagtcngtccgttactaacaccgtaccttcgttcgccgttagtacccngtaccagacgaccgtcggaccacgggtcctccgacggtcctccgttctacgtttccggtttggtccgtccgtacccgacggacgggtcctacggtcgacctaaccgttccaacggtaccgtacggtcgtacggtacggcggttaaggttccgggttcggacgggtaactacggttaccgtacctccgttaccttccgaaccgtactaccgaacggtcaacggtttacgtacgtacgtcgttaacggtagttagtttcgacttaacgtttatactttacgtcgtacacgtaactaacgtacgacgtacggaccgtactcgggttaggtccgggtaccggtaccgggtaaccgtaaccgggtaacggaaggttaaccggaaacgtaaaccggaaacggttcgaaccgggttagtacgtaccgggtacccacttaaaccgtcgtttcgtacccg

SEQ ID NO: 180853 - DNA, 833 bp, Homo sapiens
  misc_feature: GYAE6OF01EJ1JT.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgagggaagacgccaccctctcctgcgagggtcagtcagcttacaacaccgacttctcgcctcggtaccagacagacgcctggccacggcctcccgacggtcctcctctagtttcgtttggtcgtaccgtcccgaccggtacggcccacgtcggacactaccccgtaggacgtacggttacaggttcggacgtagggttcggggtcggtacgggaacgtacgtaccgtttccaccgttcctaccgtaacctacgtaccgtaacggtaaccgtacggttaaccgtttacgggaaccgttacccgttaaggtaaacgtttacggtttttaccgaacgtttaacggtttaactttaaacgttttaccgttacggtaccgtaacggtacttaaaacggtacgtaaccgggtaacgtacccgttacgtaccgggtttacggggttaccggggttacccgggttacccgggtaaaacccgggtaaaaccgggggttaaccccggtaaaagggggtttaaaccgggtaaaaaccgtttaaacccggaaaaaaccggggtacggtttaaccggggtaaccggtacccggttaccggttaaccgtaaccccgtttaaacggttcccgtttacggtttaacccccg

SEQ ID NO: 180854 - DNA, 828 bp, Homo sapiens
  misc_feature: GYAE6OF01AP3E2.34.38.D05.1.454.CMB.1.raw
  modified_base (138)..(138): a, c, t, g, unknown or other
  misc_feature (138)..(138): n is a, c, g, or t
  modified_base (329)..(329): a, c, t, g, unknown or other
  misc_feature (329)..(329): n is a, c, g, or t
  modified_base (772)..(772): a, c, t, g, unknown or other
  misc_feature (772)..(772): n is a, c, g, or t
  modified_base (816)..(816): a, c, t, g, unknown or other
  misc_feature (816)..(816): n is a, c, g, or t
  modified_base (822)..(822): a, c, t, g, unknown or other
  misc_feature (822)..(822): n is a, c, g, or t
  modified_base (828)..(828): a, c, t, g, unknown or other
  misc_feature (828)..(828): n is a, c, g, or t
tcagtacacgtgatcacgaccggtgctcgatttagtatctgatagttgggtttgggggtcccgtgagactctcctgtgcagcctcgtggacttcctaccttcgtagtagtaccacgtggatcgcacgtcgggtccctntaacgttccggaggggtaggggtctggttggttcggtttcacgttagttacgaggtgacgtaggtactcgacaactagtccgtacgcgggtaaccttcggacggtaaggtcccgtacttcccccaacccccgtcgaacggacaaccaaccgtacccaaagtaccaacaacgttctaacgtttcgacgtaanaacgttaacgaaccgtggttacgacggaaacggccggaacccggaccgggtaaacggtaccggtcgttacggttccttaaaggtttcgtacgtagacggaagttacggaccggttactaaacaccttaggtaagtttttagggttttcccgaacgttccgggtccggttacggaaccgggtaagtaactaacgttccgggtcctaccggttccttacgttcccgaccgtacccgttaccccgaccgggtaaaccgttccccgcgttaacccgttttccccccggtaacccgtcggtccccgttccgtccgtaccgtacccggactaccggacccgtaccgaaccggaccgtccgacctccggacccgttcccggccggtaccggcgttacgccggttacgacccgtaacggtcccttaaccgtccgtacgtcccgttcggtanccggtacggacggtcggtaccgcggacggccgtaggaccttagngtccgngtccan

SEQ ID NO: 180855 - DNA, 824 bp, Homo sapiens
  misc_feature: GYAE6OF01A8M6Y.34.38.D05.1.454.CMB.1.raw
tcagtacacgtgatcacgaccggtgctcgatttagtatctgatagttgggtttggggagagaagagctgctcagttaggacccagaggaaccatggaaaccccagcgcagtcttctcttccctctgctactctggcctcccagcgtccgaccccggaagtaattggtcgttcgacgcgtacgtccgaccgacgtacctacccttcgtctccttcgtccgtaccggaagggaaacgcgtaccctaccctccgtcctacgcgtacgggtacacgtacgtacgttaccgttaccgtaaccgtacccgttaccgttccgttccgtaccgtacgtaccgacgtacgaacgtaccgtaccggtcgaccgtaccggcctaccgtacggtccctcctacgtcgtttcggtttcggcccggtaccgtcccgacggtacggcccacgtcgacccgtaccgtacccgtacgtaccggtacgtttccgaaggtccggacgttacggggtcgtaccggtacggtacaccgttcttaaccgtccttaccgactctacgtacacgtacgacgtttaccgagtaccgtactacggttaattacgtttcgacgtttaactacggtttactttacggtacttacgaactacccgtaaagtcccggttaaaccggcggtactacccgggttaggtccggtttacggacccgggttaacggacccgggtaaaacgtccggtaaaaacggtggttaaaaccccggtaaaggtaacgggtaaccgttaccgggttaacggcccgttaactcccggtaaaaccgtcccgtttcgtccccgtttaacg

SEQ ID NO: 180856 - DNA, 838 bp, Homo sapiens
  misc_feature: GYAE6OF01A4CVW.34.38.D05.1.454.CMB.1.raw
  modified_base (833)..(833): a, c, t, g, unknown or other
  misc_feature (833)..(833): n is a, c, g, or t
  modified_base (835)..(835): a, c, t, g, unknown or other
  misc_feature (835)..(835): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccaggggaaggggctggtggtgggtttcacgtattacgagtgatgggactgacacaatctacgcggactccgtggaacggccgtacttccaccccccgtcagagaccaacgccaagaacacactatatctgacaaatgaacagtctagagacgaccgaggacgacggctgtctattactggtgacgtaaggaggttcggaccgttaacaacttcgtaggttttggttttacgtaacttcggttccggttacgggggaacccgtaaaaggggtaacctaaggttaccggttaccctaacccggttccttacctttaccgaaccgtccccgttacccgaaacccggtaaccggggtaccccttacggttcccccgggtttcccccgtttccccccggtccgggtccccggttccccgttccggtacccggttaccccgtaacgggaccgtccccgtaacccggtacccgggtaaccggaccgaacccgaaccggtcccggtacccgggtccccgggtaccggggtcccgtcccggtttacccggttaccgggtaaacccggtaaccggtaacccgtttacccgttacccctaacgtttaccccgtaacggtttaccggtaaccgtcggggtaaccggggtacccggggtaccgggtacgggtacccgggaaaccgggtaccgtacggtaacgttacggatccggngngcg

SEQ ID NO: 180857 - DNA, 751 bp, Homo sapiens
  misc_feature: GYAE6OF01A3HRS.34.38.D05.1.454.CMB.1.raw
  modified_base (259)..(259): a, c, t, g, unknown or other
  misc_feature (259)..(259): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagtaaagttgtgttcgacgcagtcgccagacacccgtgtctctcgtctaccgaagggaaacgacgacccacctctcctgcgaggtcagtcgacgtccgttactaaccnccgtacctttctccgccgttacggtaccacgcgaacgaccgaaccgtcgggaccctaggtccctacccgcggacccttcctctactccgtaagttcgacgtcggccgtaccaacggaccggcccacgtcgactacgtacccgacgtccgtggttacgaggtgggtacgtagggtcgggtcgtacgggtccgtaacgtccgttccgacttccgtaccctaaccgtagtacccgagtaccgtaacgtcccgttaaacgaaccgggtaacctttaaaagggtttacctttacggaactttaacggttaatttaaccgttacgttagtaaccacgtaacgtaacgtactacggaacgtaactaccgtggtacgggtaccggtcggttaaaccggggaccgtaaacgggtaaccggtaaacgggtaggtaaaaccgtaacggtaaaacggttaccgtaggtacggtaaccgtccgtaacacgtttactcgtttaccg

SEQ ID NO: 180858 - DNA, 805 bp, Homo sapiens
  misc_feature: GYAE6OF01EX99G.34.38.D05.1.454.CMB.1.raw
tcagtacacgtgatcacgaccggtgctcgatttagtatctgatagttgggtttggggagagaagagctgctcagttaggacccagagggaaccatggaaacccagcgcagcttctcttcctcctgctactctggctcccagatcgccccggagaattgtgttgacgcagtcgccagaccaccctgtctctgtctccgagggaagacgcccaccctctcctgcgtagggtcacgtcgacgtccgttacctaaccgtacccgtacctttccgttccggccgttacggtacccgaggaccgaacggaccgtaccgtcgggacccgaccgggtccctacccccggacggtcccttccccgttactacgtttccggttttcgggtccggtcccgtaccccgtaacccggacggggtacccgacgttaccgggaccctacccgttacccccgaaggtaaccggttacgggtttacgacggttacgggcggttacggggttcggggtacggtacgggaaccgtacggtaccttaccgtaccttcctaccgacctactaccgacgtaccgtagtaccgtaggaccgtacgtaaggttaagttactttacggacgttaagtttaactttaacgtttacgttacgtacgtaacgtacgtaaacgttcgtaacggtaacgtccgtaacgtcggttcgggtacgggtaccggttaccgggaaccgggtaaacgggtaccgtaaaaggggtacgtaaacgtaaacggtaaccgtagttcgggacgtacgtcggactaaccgtgttccgttgttacccg

SEQ ID NO: 180859 - DNA, 817 bp, Homo sapiens
  misc_feature: GYAE6OF01D5B28.34.38.D05.1.454.CMB.1.raw
  modified_base (260)..(260): a, c, t, g, unknown or other
  misc_feature (260)..(260): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatatcaccggagtaattgtgttgacactagtctccgagcctaccctgttcttttgtcctccgaaggggaaaacgcgccctacccgtctcctgcgacgggccagtcagtagtagttaanagctattctacgtacgtcttcggtaaccagacgaacgaaacccgtggaccacgtccctacccgagtaccccttacccgtataatttaaggtcggtacgactaactaccgtaaccggccggtaccccgtaggacctaccgtacccaaggtaccgtaggtttccgaagggtcgacggtagggttcgggtacggtacgggtacaacggttaccttaccgtaccttccgtaccaaccgtacttaaccccgaacggtacgttaaaccggtcggtaacggtcccgtttaaagggtaaccgttttaggttttacccggacgtaacgggtttttaacgttaacgttttaccgtaccggttaaacctaacgggtttacgggtttcggtaacccctttacgaaacgtacccggttaacgggttaaccggttacccgggttaacccgggaaccggtaaaggggtaacccgtaaagggttaaacccgtaaacgtaacccggtaaaccgtagggttccggtacggccgttacgacccgtaataccttccgtttagtcccttacgtacccg

SEQ ID NO: 180860 - DNA, 510 bp, Homo sapiens
  misc_feature: GYAE6OF02F264C.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatcttggtgcgtccaccagggccactggcatcccagacaggttcagtggcagtgggtctgggacagacttcactctcaccatcagcagacttgagcctgaagattttgctagtatattactgtcagcaatatacgagacgcacgtgtgggtcgttcggccgaagggaccgaaggtaggaaatacaaacggaactgtaggctgcaccatctgtc

SEQ ID NO: 180861 - DNA, 489 bp, Homo sapiens
  misc_feature: GYAE6OF02HFMAV.34.38.D05.1.454.CMB.1.raw
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (486)..(486): a, c, t, g, unknown or other
  misc_feature (486)..(486): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccagagtcctcatctatgctacatccacaggccactgctatccagcaggtcagtgcagtggtcngggacagattcactctcaccatcagcagcctgcagtctagaagtnttctgctactttattactgtcagctagtctaatagtgcgtggacgtcgacagggacaggtgaatacgaaacgactgtaggctgactacatntcg

SEQ ID NO: 180862 - DNA, 515 bp, Homo sapiens
  misc_feature: GYAE6OF02H633O.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggcctcctcacttctttggtcgcgtccaccgagggccactggcactcccagacaggttcagtggcagtggtctgggacagcttcactctcactatcagcagacttgagctgaagtatttgactagttattattactgtcagacaatatacgagacgcacttgtggtcgttcgacgaaggacgaaggtaggaatacgaaacgaacgtagtggctgcactatctgttc

SEQ ID NO: 180863 - DNA, 155 bp, Homo sapiens
  misc_feature: GYAE6OF02IE389.34.38.D05.1.454.CMB.1.raw
  modified_base (155)..(155): a, c, t, g, unknown or other
  misc_feature (155)..(155): n is a, c, g, or t
tcagtacacgtgatcacgaccggtgctcgatttagtatctgatagttgggtttgggggaagaggaagactgacggtcctagcacagcggccctgggctgcctggtcaaggactacttccatcacgtgtactgagcgggctggcaaggcgcatagn

SEQ ID NO: 180864 - DNA, 528 bp, Homo sapiens
  misc_feature: GYAE6OF02I2KPI.34.38.D05.1.454.CMB.1.raw
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacnccgacttcttcgcctggtaccagcagagacctggccaggctcccaggctcctcatctttggngcgtccaccagggccactggcatcccagacaggttcagtggcagtgggtctgggacagacttcactctcaccatcaccagactggagcctgaagtatttgcagttgttattactgttacaactagttggtctcacacgacgtggtacgttcggaccgaacgggaaccgaaggtaggaatacgaaacggaactagtaggcgtgacacatctgtcttcattccg

SEQ ID NO: 180865 - DNA, 791 bp, Homo sapiens
  misc_feature: GYAE6OF02JRSTG.34.38.D05.1.454.CMB.1.raw
  modified_base (204)..(204): a, c, t, g, unknown or other
  misc_feature (204)..(204): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaaattgtgttgacgcagtcgccagacaccctgtctctgtctccagggaaanagccaccctctcgtgcgacggtcagtcagtcgttacaaccaccgtacttcgtccgtccgtacggtaccacgacgagacgtaccgtcggaccgtacggccctaccgacggtcctcctactacttcggtttggtcgtccgtacccaccggtaccgggccctacggtcggactaccgtcccgaacggtaccgtacggttaccgaggtcggacgtaggggttcgggtcggtacgggactaacggttacttaccgtaccttccgtacctaaccgtactaccgacgtaccgtaacgttacgttacggaaccgtccgtaaaggtaaacggtttacgtttacggaacgttaagtttaacgtttaaccgtttacgttacgttaaccgaacggttaacttaaacgttaacggtaacggaacggtaccgtacgttaacgggttcggggttacggggttacccggttaaccgggaaccgggtaaaccgggaccgggttaaagggttaacggtaaaacgttaaccggtaaaacggtaaccggtttacgggtacggtaccgttacggacccttaacgtaccgttacgtttaccgttaaccg

SEQ ID NO: 180866 - DNA, 495 bp, Homo sapiens
  misc_feature: GYAE6OF02HQ19L.34.38.D05.1.454.CMB.1.raw
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (462)..(462): a, c, t, g, unknown or other
  misc_feature (462)..(462): n is a, c, g, or t
  modified_base (490)..(491): a, c, t, g, unknown or other
  misc_feature (490)..(491): n is a, c, g, or t
  modified_base (493)..(495): a, c, t, g, unknown or other
  misc_feature (493)..(495): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattccaccccctccagagacaacgccaagaacacactatatctgacaaatgaacagtctgagagccgaggacacggctgtctattactgtgcaagaggtggctacaatcattggttttgatctcgtgggccaagggacaatggtcaccgtctcttcagcctccacgaggcccagtcgtctcccnggcnccngctcagcgcacctcgagacgcacagcgcctgggctgcctgcaaggactactccatcacgtntactgaggcggctggcaaggcgcatagnngnnn

SEQ ID NO: 180867 - DNA, 544 bp, Homo sapiens
  misc_feature: GYAE6OF02JF7SH.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagataccactggagaaatagtgatgacgcagtctccagccaccctgtctctgtctccaggggaaangccaccctctcctgcagggtcagtcagcgttcaacaccgacttcttcgcctggtaccagcagagacctggccaggctcccaggcctcctcatcgtttggtgccgtccaccgagggccacgtggcatcccagacaggttcagtggcagtggtctgggacagacttcactctcacatcagcagacttgacgcctagaagtatttcgactagttatacttactgtacagactatatacgagacgcacgtgtgggtcgttcggaccgaagggaccgtaagggtacggaaacgtaccgaaacgtaacgtaggtacggtaccgttaggacctaccgtattaccg

SEQ ID NO: 180868 - DNA, 559 bp, Homo sapiens
  misc_feature: GYAE6OF02GDB12.34.38.D05.1.454.CMB.1.raw
  modified_base (554)..(554): a, c, t, g, unknown or other
  misc_feature (554)..(554): n is a, c, g, or t
  modified_base (557)..(559): a, c, t, g, unknown or other
  misc_feature (557)..(559): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaagggctggtgtgggttcacgtattacgagtgatgggactgacacaatctacgcggactccgtgaagggccgattcaccccctcagagacaacgccaagaacacactatatctgacaaaatgaacagtctgagagccgaggacacggctgtctattactgtgcaagaggtggctacaatcatggttttgatctctgggccaagggacaatggtcaccgtctcttcagcctccaccaagggcccatcggtcttcccctggccgccctgcctccaggacgcacctccgagacgcacacgccggccctgggcctcgcccgttggtccgaacggtaccttaccgttcccacttccgaacgttcgttacctggacggtccggggaccttcggggaccgtaacgggccgaccgaacgttacggncgnnn

SEQ ID NO: 180869 - DNA, 518 bp, Homo sapiens
  misc_feature: GYAE6OF02HXFX7.34.38.D05.1.454.CMB.1.raw
  modified_base (481)..(481): a, c, t, g, unknown or other
  misc_feature (481)..(481): n is a, c, g, or t
  modified_base (506)..(506): a, c, t, g, unknown or other
  misc_feature (506)..(506): n is a, c, g, or t
  modified_base (514)..(518): a, c, t, g, unknown or other
  misc_feature (514)..(518): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctcagagacaacgccaagaacacactatatctgcaaatgaacagtctgagagccgaggacacggctgtctattactgtgcaagaggtggctacaatcatgttttgatctctggggccaagggacaatggtcaccgtctcttcagcctccaccaagggcccatccggtccttccccgtggccgcccctgcctccaggacgccacccgtcgagacgcacacgcggccctgggctcgcctggcaaggactacttccatccacgtntactgacgcgggctgggacaaggcncgagtagnnnnn

SEQ ID NO: 180870 - DNA, 504 bp, Homo sapiens
  misc_feature: GYAE6OF02FH3Z9.34.38.D05.1.454.CMB.1.raw
  modified_base (500)..(504): a, c, t, g, unknown or other
  misc_feature (500)..(504): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctcagagacaacgccaagaacacactatatctgcaaatgaacagtctgagagccgaggacacggctgtctattactgtgcaagaggtggctacaatcatggttttgatctctggggccaaggggacaatggtcaccgtctcttcagcctccaccaagggcccatcggtcttcccctggcgccctgctccaggacgcacctccgagagcacagcggccctgggctgcctggtcaaggactacttccatcacgtgtactgagcgggctggcaaggcgcatagnnnnn

SEQ ID NO: 180871 - DNA, 529 bp, Homo sapiens
  misc_feature: GYAE6OF02GWQL3.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatcttggtgcgtccaccagggccacgtggcatcccagacaggttcagtggcaggtgggtctgggacaggacttcactctcaccatcagcagtacttgagcctagaagtatttgactagtattattactgtcagtcaatatacgacgacgcacgtgtgggcgttacggaccgaacgggaccgaaggtaggaaactacgaaacgaacgtagtaggctcgaccacatactgtacc

SEQ ID NO: 180872 - DNA, 508 bp, Homo sapiens
  misc_feature: GYAE6OF02FPV73.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgacttcttcgcctggtaccagcagagacctggccaggctcccaggctcctcatctttggtgcgtccaccagggccactggcatcccagacaggttcagtggcagtggtctgggacagacttcactctcaccatcagcagacttgagcctgaagtatttgctagtatattactgtcagcaatatcgagacgcactgtgggcgttcggccgaagggaccaaggtaggaaatacgaaacgaactagtaggctgccacactctgtc

SEQ ID NO: 180873 - DNA, 568 bp, Homo sapiens
  misc_feature: GYAE6OF02HE0ED.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccgaggctcctcattctttggtcgccgtccaccgagggcccacgtggcactcccagacaggttcaggtggctaggtgggtctgggacaggtacttcgactctacacctatcagcagtacttgagctagaagtatttcgactagttattattactgtcagacaatatacgacgacgactacgtggtcgggtcgttcggaccgaacgggaccgtaagggtacggaaacgtacgaaacggtaacgtacggtacggacgtacgaccgaccgtacgttcgtcgttac

SEQ ID NO: 180874 - DNA, 498 bp, Homo sapiens
  misc_feature: GYAE6OF02HTGF7.34.38.D05.1.454.CMB.1.raw
  modified_base (496)..(496): a, c, t, g, unknown or other
  misc_feature (496)..(496): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggtgcgtccaccagggccactggcatcccagacaggttcagtggcagtgggtctgggacagacttcactctcaccatcagcagacttgagcctgaagtattttgctagttgttattattgtcagcagcatcatcgtcaccgtacactttgccagggaccaagcgtggagatacgaacgtactgtggctgcacntc

SEQ ID NO: 180875 - DNA, 554 bp, Homo sapiens
  misc_feature: GYAE6OF02IMBUJ.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgacttcttcgcctggtaccagcagagacctggccaggctcccaggctcctcatctttggtgcgtccaccagggccactggccactcccagacctaggttcaggtcggacaggtcgggtctgggacagtacttcactctcaccatcagcagtacttgacgcctagaagtatttgactagttatattactgtacagactaattactacgagaccgactacgtcggtcgggtcgttccggaccgaacgggaccgaagggtaggaaataccgaaacgtaacgtaggtaggactgaccacctactcgtgttcc

SEQ ID NO: 180876 - DNA, 522 bp, Homo sapiens
  misc_feature: GYAE6OF02I25IK.34.38.D05.1.454.CMB.1.raw
  modified_base (308)..(308): a, c, t, g, unknown or other
  misc_feature (308)..(308): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatcgtttggtncgtccaccgagggccactggcactcccagacaggttcagtggcaggtggctgggacagacttcactctcaccatcagcagacttgacgctgaagtatttagactagtatatttactgtcagactaatagtacgagacgctacgtgtggtcgttcggaccgtagggacgaaggtaggaagtacgaacgtacgtgtgcgtcgaccactactctgtc

SEQ ID NO: 180877 - DNA, 552 bp, Homo sapiens
  misc_feature: GYAE6OF02JPFQ2.34.38.D05.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
tcagtacacgtgatcacgaccggtgctcgatttagtatctgatagttgggtttggggagagaagagctgctcagttaggacccagagggaaccatggaaacccagcgcagcttctcttcctcctgctactctggctcccagatgccccggagaaattgtgttgacgcagtcgccagacaccctgtctctgtctccaggggaaangccacctctcctgcagggtcagtcagcgttctaacnccgacttcttcgcctggtaccagcagagacctggccaggctcccaggctcctcatctttggtcncgtccaccagggccatcggcatcccagacaggttcagtggcagtgggctgggacagacttcgacttcgcaccattcacgcacgactttcgacgcctgaagtattttgcagttattattactgtctagcaaatatacgagacgcactggttcggcggttccggtaccgaacgggtaccgtaagggtacggaaacgtacgtaaacgaacgttacggtaggacgtacgtccgaacgtacttacgtcgttac

SEQ ID NO: 180878 - DNA, 559 bp, Homo sapiens
  misc_feature: GYAE6OF02HVT74.34.38.D05.1.454.CMB.1.raw
  modified_base (385)..(385): a, c, t, g, unknown or other
  misc_feature (385)..(385): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggcctcccaggcctcctcattctttggtgccgtccaccgagggccacgtggcatcccagacaggttcagtggcaggtggtctgggacagaattcactctcaccntcagcacgcctgcagtctagagtattttgctagttttatacttgtacagctagttactaataaggtcggtaccggttggtacgttcgggaccgaaagggtaccaagggtacggaaactacgtaaaacggtacttggtaggtcgtagaccactacgtacgttcgttacttctacg

SEQ ID NO: 180879 - DNA, 547 bp, Homo sapiens
  misc_feature: GYAE6OF02JVHG8.34.38.D05.1.454.CMB.1.raw
  modified_base (205)..(205): a, c, t, g, unknown or other
  misc_feature (205)..(205): n is a, c, g, or t
  modified_base (308)..(308): a, c, t, g, unknown or other
  misc_feature (308)..(308): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaanagccaccctctcctgcagggtcagtcagcgttctaacaccgacttcttcgcctggtaccagcagacgacctggccaggctcccaggcctcctcatcgtttggngccgtccaccagggccactggcatcccagactaggttcagtggcaggtggtctgggacaggtacttcgactctacaccatcagcagacttgacgctagaagtatttcgactaagttatattactgtacagtactaatagtacgtagacgacgtacgtgtaggtaccgtcggaccgtaacggacgtaaggtacggaactacgtaacgaacgtagtagcgtacgacactactcgtacgtac

SEQ ID NO: 180880 - DNA, 870 bp, Homo sapiens
  misc_feature: GYAE6OF02F3GXD.34.38.D05.1.454.CMB.1.raw
tcagtacacgtgatcacgaccggtgctcgatttagtatctgatagttggggtttgggggaagagaagagcttggcctcaggttaacggacccagaagggaacccatggaaaccccagcgtcagtcttctcttcctcctgcgtactcctaggctcccagatgaccccggagtaaattgtgttagacgcagtccgcccagacaccctgtctctggtctccgagggaacacgccaccctctcctgccagggtcaggtcagcgttctaacaccgacttctcgccgtcgtaccagacagagacctggtcccaggccttcccgaggtcctacctcaattcgtttaggcgtccgttcccaaccggacgggccctaacggtcgggacccaagttcccccgaaggtaccacgggtttccgaacgggttcggggtccgtaaggggttcggggtaccgtttacggggaaccctaaacggttaacccttttcccgaaacccgtttacccttacccgaaaccccgtaacgttaccggaaaccggtacccgtaacgggtaacccgttttacgggtaaacggtaccccgtttaacgggtaaacggttaacgtttttttaacgggacctttaaacggtttaacgtttaaacgttttaaccgtacggttaacctaacggtaacccttaaaagtttaaccgttaccggtaacggtacccggtaccgtaaccggtttacgggtaccggggttaccggttaacccgggaaccgtaaacgggggtaacccgtaaagggtaaccgggtaaaacgttaccggaaaaccggtaacgttacggttacggtaccgtacggtaccgtaacccgtaacgtttacccgtagtttacccg

SEQ ID NO: 180881 - DNA, 612 bp, Homo sapiens
  misc_feature: GYAE6OF02GOXIT.34.38.D05.1.454.CMB.1.raw
tcagtacacgtgatcacgaccggtgctcgatttagtatctgatagttgggtttggggagaggaagagctgctcagttaggacccagaggggaaccatggaaaccccagcgcagcttctcttcctcctgctactctggctcccagatgccccggagaaattgtgttgacgcagtcgccagacaccctgtctctgtctccaggggaaagagccaccctctcctgcagggtcagtcagcgttctaacaccgacttcttcgcctggtaccagcaagacgacctggccacggctcccgaggtcctcctcacttcgtttggtcgccgtccaccgagggccacgtggcattcccgagacgtacggttccaggtcggacaggtcggtctgggacagtacttcactcacaccatccgagcacgtacgttgacgtacctagtaacgttattttcggactaggttaattacttacgttagtactagtactaagttacgtacggtaacgaaccgtacgtacgttgggtcgggtcggttcggaccgaacgggtaccgaaggtacggaaacgtaccgaaacgtaacgtacggtacggtcgtcgtacctaccgtcttccgtgttacc

SEQ ID NO: 180882 - DNA, 575 bp, Homo sapiens
  misc_feature: GYAE6OF02GT2NO.34.38.D05.1.454.CMB.1.raw
  modified_base (382)..(382): a, c, t, g, unknown or other
  misc_feature (382)..(382): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtctccagccaccctgtctgtgtctccaggggaaagagccaccctctcctgcagggccagtcagagtgttggcagcaacttagcctggtaccagcagagacctggccaggctcccaggctcctcatctttggtgcgtccaccgagggccacgtggcactcccagacaggttcagtggcaggtgggtctgggacagaccttcgactctcaccntcagcagacttgacgctagaagtatttgctaagtattattactgtacagtactaatacgtacgaagacgtacgtacgttggtcgggtccgttaccgggaccgtaacgggtaccgtaagggtaacggtaaacgtaaccggaaaacggtaacgttaggtacggtaccgtacgaccgtaaccgtacgttcgttacg

SEQ ID NO: 180883 - DNA, 535 bp, Homo sapiens
  misc_feature: GYAE6OF02IYH6H.34.38.D05.1.454.CMB.1.raw
  modified_base (206)..(206): a, c, t, g, unknown or other
  misc_feature (206)..(206): n is a, c, g, or t
  modified_base (379)..(379): a, c, t, g, unknown or other
  misc_feature (379)..(379): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgacttcttcgcctggtaccagcagagacctggccaggctcccaggcctcctcatctttggtgccgtccaccgagggccacgtggcactcccagacaggttcagtggcagtggtctgggacagtacttcactcncaccatcagcagacttgagtcctgtaacgtatttgactagttattattactgtacagactaatatacgagacgctacgtgtcggtcgttcgacgacgggaccgaaggtacggaaactacgaaacgtactaggtagtactgacacgacttctgttac

SEQ ID NO: 180884 - DNA, 793 bp, Homo sapiens
  misc_feature: GYAE6OF02JUSEY.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccacctctcctgcagggtcagtcagcgttctaacaccgacttctcgcctggtaccagcagagacctggccaggcctcccgaggcctcctcatctttggtgccgtccaccgagggccacgtggcactcccgagactaggttccaggtcgggacctaggtcgggtcgtgggactaggtacctttcaccgttctaccgaacctattccgacggtacgtaacgtactttacgggaccgtacccgttagggtaaaagtttacgtttttacggaccgttaaggtttaactttaacgttttaacgtttccggttaacgtaaccggtaaccttaaacgtttaacggttaaccgggtaacgggtaacccggtaccgttaaccgggttttcgggggttaaccgggggttcccggggtttaaccggggtaaccccggggtaaaacgggggtaccccgggttaaaaggggttaaaccggggtaaaaaccggttaaccgggtaaaaacccggtaaaccgggtttaacgggttaaccgggtaaccggttacggtaacccggtaaacccgttaccggttaccggttacggtttaacccgg

SEQ ID NO: 180885 - DNA, 589 bp, Homo sapiens
  misc_feature: GYAE6OF02FFQPF.34.38.D05.1.454.CMB.1.raw
  modified_base (207)..(207): a, c, t, g, unknown or other
  misc_feature (207)..(207): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaacngccaccctctcctgccagggtcagtcagcgttctaacaccgacttcttcgcctggtacccagcagacgacctggccaggcctccccaggtcctcctcattcgtttggcgccgtccaccgagggtccacgtggcactcccagacaggttcaggtgcagtcgggtctgggactgacttcactctacaccatcagcagtacttggacgtccgtagtaacgttatttagactagttatacttactcgtacagtactaatacgtacgacgtacgtcgtacgttggtcggtacggttcggaccggaacgggtaccgtaagggtacggtaaacgtaccgaaacggtacgtacggtacggacgtacgacctaccgtacttcgtcgttacc

SEQ ID NO: 180886 - DNA, 546 bp, Homo sapiens
  misc_feature: GYAE6OF02G9NFC.34.38.D05.1.454.CMB.1.raw
  modified_base (206)..(206): a, c, t, g, unknown or other
  misc_feature (206)..(206): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgacttctcgcctggtaccagcagagacctggccaggctcccaggctcctcatctttggtgcgtccacgagggccactggcatcccagacaggttcagtggcagtggctggacagactcactcncaccatcagcagacttgagctagaagtatttgntagtattattactgtactagactaatatacgagacgctacgtgtagggtcgttcgggaccgaacgggtaccgaagggtacggtaaactacgaaacggtaacgtaggtacggacgtacgaccgtaccgacgttaccgtggttacc

SEQ ID NO: 180887 - DNA, 546 bp, Homo sapiens
  misc_feature: GYAE6OF02HRA0I.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcattctttggtcgccgtcccaccgagggcccacgtcggcactcccagacaggttcagtgcagtgggtctgggacaggtacttcactctcacatcagcagacttgacgcctagaagtatttgatagttattattactgtacagtactaatagtacgagacgctacgtggtcgggtcgttcggaccgtaacgggaccgaagggtacggaaagtacgaaacgaacgtaggtagacgtcgacgaccatctgttc

SEQ ID NO: 180888 - DNA, 720 bp, Homo sapiens
  misc_feature: GYAE6OF02IENMD.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgacgcagtcgccagacaccctgtctctgtctccgaaggggaaagacgccaccctctcctgcagggtcagtcagtcgttactaacaccgtacttcttccgctggtaccagcagacgacctggccaggcctcccaggctcctcattctttggtcgcgtaccaccgaggccacgtggcactcccgagactaggttcaggtggcaggtggtctgggacagacttcacttctaccactactacgaacgcgaacgtacgtttggaacgtaccgttaaggtaaagttacgtttttggacttaaggttaactttaactttaacgttacggttaccaaaggtaccttaaaagttaacgttaaccgggaaacgaaccgtaccgtaaccggttcgggttacgggggttacccggtttaccggggaacccgtaaaccgggggtaacccgttaaacgggggtaacgggtaaaaaccgttaaccggtaaaaaccggtaacgtttaacgggtacggtacccgttaacggaacccgttaacccgtagtttacccggttacggtttaaccccg

SEQ ID NO: 180889 - DNA, 566 bp, Homo sapiens
  misc_feature: GYAE6OF02H988V.34.38.D05.1.454.CMB.1.raw
  modified_base (398)..(398): a, c, t, g, unknown or other
  misc_feature (398)..(398): n is a, c, g, or t
  modified_base (449)..(449): a, c, t, g, unknown or other
  misc_feature (449)..(449): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagagccaccctctcctgcagggtcagtcagcgttctaacaccgacttcttcgcctggtaccagcagagacctggccaggcctcccaggctccctcattcctttggtcgccgtccaccgagggccaacgtggccactccccaagtacgaggttcagtcggctaggtggtctgggacaggtactcgactctcacntcagtcagtacttgacgctagtaagtatttgctagttatattactgtacanactaatatacgagacgctacgtgtgggtcgttacggaccgaacgggaccgaaggtacggaaagtaccgaaacggtaacgttagtacggactcggacctaccgacttcgtagttaccg

SEQ ID NO: 180890 - DNA, 558 bp, Homo sapiens
  misc_feature: GYAE6OF02F41K1.34.38.D05.1.454.CMB.1.raw
  modified_base (273)..(273): a, c, t, g, unknown or other
  misc_feature (273)..(273): n is a, c, g, or t
tcagtacacgtgatcacgaccggtgctcgatttagtatctgatagttagggtttggggagagaagagcgtgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagngacctggccaggctcccaggctcctcattctttggtgccgtccaccgagggccacgtggcactcccagacaggttcagtggcaggtggtctgggacagacttcactctcaccatcagcagacttgagtccgtagagtattttgctagttatattactgtcagctaatatacgagacgcacgttggtgggtcgttcggaccgaacgggaccgtaagggtacggaaagtaaccgaaaacggtaacgttacggtaggcgttacggacctaaccgacgttcgtgttccg

SEQ ID NO: 180891 - DNA, 571 bp, Homo sapiens
  misc_feature: GYAE6OF02HDCPI.34.38.D05.1.454.CMB.1.raw
  modified_base (565)..(566): a, c, t, g, unknown or other
  misc_feature (565)..(566): n is a, c, g, or t
  modified_base (568)..(571): a, c, t, g, unknown or other
  misc_feature (568)..(571): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccattcaccccctcagagacaacgccaagaacacactatatctgcaaatggacagcctgagagacggggacacggctgtgtattactgtgcggtcttttagtctacctatgccatatggttctgatatctggggccaagggacaatggtcaccgtctcttcagccctccaccgaacgggcccagtccggtccttcccccgtcggccacccctccctcccaacgacgccaccctccgtcgggggccaccgacgccgggccccgtcgggcctcggcccgtggtccgaacggtaccttaccttccctactccaccgttcgtactggagccgggcgtcgggacgtaacggccgcacgtacgnngnnnn

SEQ ID NO: 180892 - DNA, 582 bp, Homo sapiens
  misc_feature: GYAE6OF02HLVHL.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttactaacaccgacttcttcgcctggtaccagcagagacctggccaggcctcccaggctcctcatctttggtcgcgtccaccgagggccactggcatcccagacaggttcagtggcaggtggtctgggacagtacttcactctcaccatcagacagtacttgacgtctagtaagttatttcgactagttattacttacttgtactagtactaagttactacgagaccgctacgttggtcgggtcgttacggaccgaacgggaccgaagggtaacggtaaacgtaaccgaaaacggtaacgttagggtacggtacgtacggaccgtacctacgttcgttacgttacc

SEQ ID NO: 180893 - DNA, 401 bp, Homo sapiens
  misc_feature: GYAE6OF02IICME.34.38.D05.1.454.CMB.1.raw
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (390)..(390): a, c, t, g, unknown or other
  misc_feature (390)..(390): n is a, c, g, or t
  modified_base (396)..(401): a, c, t, g, unknown or other
  misc_feature (396)..(401): n is a, c, g, or t
tcagtacacgtgatcacgaccggtgctcgatttagtatctgatagttgggtttggggggaagaggaagactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggccgccctgcctccaggacnccacctccgagngcacagcggccctgggctgcctggtcaaggctacttccatcacgtgtactgagcgggctggcagggcncatagnnnnnn

SEQ ID NO: 180894 - DNA, 255 bp, Homo sapiens; identical to SEQ ID NO: 180720
  misc_feature: GYAE6OF02FGN5J.34.38.D05.1.454.CMB.1.raw
  modified_base (253)..(255): a, c, t, g, unknown or other
  misc_feature (253)..(255): n is a, c, g, or t

SEQ ID NO: 180895 - DNA, 551 bp, Homo sapiens
  misc_feature: GYAE6OF02GUET4.34.38.D05.1.454.CMB.1.raw
  modified_base (547)..(551): a, c, t, g, unknown or other
  misc_feature (547)..(551): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctcagagacaacgccaagaacacactatatctgcaaatgaacagtctgagagccgaggacacggctgtctattactgtgcaagaggtggctacaatcattggttttgattctcgtggggccaaggggacaagtggtcaccgtctcttcagcctccacgaagggcccagtccggtccttccccgtggccgccctgcctcccgaggacgccaccctccgagacgcacgagccggcccgtgggcctcgcccgtggtacgaacggtaccttaccgttccagtccacgttcgtacgtggacggcgggctcgggccgaaggcgacgacgtagnnnnn

SEQ ID NO: 180896 - DNA, 402 bp, Homo sapiens
  misc_feature: GYAE6OF02FVA8F.34.38.D05.1.454.CMB.1.raw
  modified_base (398)..(402): a, c, t, g, unknown or other
  misc_feature (398)..(402): n is a, c, g, or t
tcagtacacgtgatcacgaccggtgctcgatttagtatctgatagttgggtttcacgtattacgagtgatgggactgacacaatctacgcggactccgcgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagcacctcgagagcacagcggccctgggcctgcctggtcaaggactacttccatcacgtgtactgagcgggctggcaaggcgcatagnnnnn

SEQ ID NO: 180897 - DNA, 515 bp, Homo sapiens
  misc_feature: GYAE6OF02FNFS9.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcatctttggtgcgtccaccagggccactggcatcccagacaggttcagtgcagtgggtctgggacagacttcactctcaccatcagcagacttgagcctgaagtattttgctagttatattactgtctaacagttgtctcacacacgtgacgttcggcgaagggaccaagggtagaactacgaaacgaacgtagtggctagcacatctcgttcttctac

SEQ ID NO: 180898 - DNA, 576 bp, Homo sapiens
  misc_feature: GYAE6OF02HUXMP.34.38.D05.1.454.CMB.1.raw
  modified_base (402)..(402): a, c, t, g, unknown or other
  misc_feature (402)..(402): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaaattgtgttgacgcagtcgccagacaccctgtctctgtctccgaggggaaagagccaccctctcctgcagggtcagtcagcgttctaacaccgacttcttcgcctggtaccagcagagacctggccaggcctcccgaggcctcctcattcgttttggtcgccgtccaccgacgggcccacgtcggcactccccaagacaggttcaggtggctaggtgggtctagggacaggtacttcactctacaccntcagcagtacttgacgtccgtagtaagtattttgactagttattattactgtcagactaatatacgagacgctacgtggtcgggtcgttcggaccgaacgggtaccgaagggtacggaaacgtaacgaaacgtaacgtggtacggacgtacgacctaaccgacttcgtgttacc

SEQ ID NO: 180899 - DNA, 531 bp, Homo sapiens
  misc_feature: GYAE6OF02G0XT0.34.38.D05.1.454.CMB.1.raw
  modified_base (206)..(206): a, c, t, g, unknown or other
  misc_feature (206)..(206): n is a, c, g, or t
  modified_base (381)..(381): a, c, t, g, unknown or other
  misc_feature (381)..(381): n is a, c, g, or t
  modified_base (431)..(431): a, c, t, g, unknown or other
  misc_feature (431)..(431): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccaccctctcctgcagggtcagtcagcgttctaacaccgtacttctcgcctggtaccagcagagacctggccaggcctcccaggcctcctcatctttggtgcgtcccaccagggccactggcatcccagacaggttcagtgcaggtggtctgggacagacttcactctcaccntcagcagtactgacgcctagaagtattttgctagttattattactgtcanactaatatacgagacgcacgtgtcgggtcgttcggaccgaagggaccgaaggtacggaaactacgaaacgaacgtaggtggctcgaccaccactctgtcc

SEQ ID NO: 180900 - DNA, 683 bp, Homo sapiens
  misc_feature: GYAE6OF02H51KX.34.38.D05.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (673)..(673): a, c, t, g, unknown or other
  misc_feature (673)..(673): n is a, c, g, or t
tcagtacacgtgatcacgaccggtgctcgatttagtatctgatagttgggttttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaanacgccaccctctcctgcagggtcagtcagcgttcaacncgacttctcgctcggtaccagcagacgacctggccaggctcccgaggtcctcccgtcacgttccgttttgggtcgccgttacccgaaccgacggggcccaaccgttgggacctaacgttccccgaaggaccgtagggtttccaaggttcgggactagggtgggtcctaggggaccaaggtcctttacgaccttccgtaccaacctgttaccagccgtaacgaccgtttggacgtaccgttagaaacgttacttttacgacttaagttactttaatttaacgttgttacgacgactaagttactacgacgaaccgtcgtacgttcggtacgggttacgtccgggaccgtaacgggacgtaagggtacgtaaacgtaccgaacgtaaccggttagtaccggtacgtacgaccgtaccgtacgttaccgngtttaacccg

SEQ ID NO: 180901 - DNA, 576 bp, Homo sapiens
  misc_feature: GYAE6OF02G0HT0.34.38.D05.1.454.CMB.1.raw
  modified_base (304)..(304): a, c, t, g, unknown or other
  misc_feature (304)..(304): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaagagccaccctctcctgcagggtcagtcagcgttctaacaccgacttcttcgcctggtaccagcagagacctggccaggctcccaggctctcatcttggtncgtccaccagggccactggcatcccagacaggttcagtggctaggtgggtctgggacagacttcactctacaccatcacagactggacgcctagagtagtttcgcgtagtagttattactgtactaactagttcgtctactacacgtacgtcggtaccggttacggaccgaaacgggaaccgtaagggtacggaacgtacgaaaccggtaacgttaggtacggtaccgtcgaccaccgtacgttaccgttcgttaccttaccacttaccccg

SEQ ID NO: 180902 - DNA, 700 bp, Homo sapiens
  misc_feature: GYAE6OF02G77RQ.34.38.D05.1.454.CMB.1.raw
  modified_base (209)..(209): a, c, t, g, unknown or other
  misc_feature (209)..(209): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagaccaccctgtctctgtctccgaggggaaagngcccacctcctcctgcgagggtcagtcagtccgttactaaccaccgtactttcttccgccgtcggtaccagccaagacgtaccgtggccgaggtccctacccgaggtcctccctctattccgttttggcgtccgttcccaaccggacggggcccaagtcggacctacgtccccgaaggtaccgtacggttcaggtcggactagggttcggggtcgtacgggactaggtacctttcgacttctaccaaccgtatccgacgacacgtaccgttaggacgtccgtagtaagttaagttttcgacgtaagttaattaacgtttaacgttgtacgagtactaatacgttacggaagacgtactacgttgggttcggggtccggttaccgggaccggaacgggtaccggtaacgggtaacggtaaaccgtaaccgtaaaaccggtaacgttaggtacgggaccgttacggaccctaccgtacgttccgtacgttccg

SEQ ID NO: 180903 - DNA, 532 bp, Homo sapiens
  misc_feature: GYAE6OF02GA92D.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaangccaccctctcctgcagggtcagtcagcgttctaacaccgacttcttcgcctggtaccagcagagacctggccaggctcccaggcctcctcatctttggtcgcgtcccaccgagggccacgtggcactccccagacaggttcagtggcaggtggtcgtgggacagacttcactctcaccatcagcagacttgacgcctgaacgtatttcgactagttatattactgtacagtacaatatacgagacgctacgtgtcggtcgttcggaccgaacgggacgaaggtacggaaactacgaaacgaacgtgtgctagccacactcgtgtc

SEQ ID NO: 180904 - DNA, 549 bp, Homo sapiens
  misc_feature: GYAE6OF02GATQN.34.38.D05.1.454.CMB.1.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctccncatcttggtncgtccacgagggccactggcactcccagacaggttcagtggcaggtcggtctgggacaggacttcactctcaccatcagcagacttgacgtcctagaagtattttgctagttatattactgtacagactaatatacgagacgactacgtgtcgggcgttcggaccgtaacgggaccgaagggtacggaaactacgaaacggtaacgttacggtaggtcgtcgaccgacctacttccgtgttac

SEQ ID NO: 180905 - DNA, 591 bp, Homo sapiens
  misc_feature: GYAE6OF02IMFVB.34.38.D05.1.454.CMB.1.raw
  modified_base (346)..(346): a, c, t, g, unknown or other
  misc_feature (346)..(346): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (480)..(480): a, c, t, g, unknown or other
  misc_feature (480)..(480): n is a, c, g, or t
tcagtacacgtgatcacgaccggtgctcgatttagtatctgatagttgggtttgggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgaggggaaagacgcccacctcctcctgcgacgggtcagtcagtcgttctaacaccgtacttcctcgcctggtacccagccagagacctggccaggcctcccaggcctcctctattcgttggtgccgtccaccgacggccacgtggaccngtaccccagactacggttcagtggcgtaggtcgggtcgtggacagtacttcgactcnctacatcngcagtactgatcctgaagtatttgactagttacttattcgtgtactagacaagtatacgtagaccgtanacgttacgggtcgggtccgttacggaccgaagggaccgtaagggtacggaaattaaccgaaacggtaaccgtggtacggcgtacgtaccgtaaccgtagtccgtgttaccg

SEQ ID NO: 180906 - DNA, 558 bp, Homo sapiens
  misc_feature: GYAE6OF02GPRX4.34.38.D05.1.454.CMB.1.raw
  modified_base (308)..(308): a, c, t, g, unknown or other
  misc_feature (308)..(308): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttctcgcctggtaccagcagagacctggccaggcctcccaggcctcctcatctttggtnccgtccaccgagggccacgtggcatcccagacaggttcaggtggcaggtgggtctggggacaggtacttcactctacacctatcagcagacttgacgccgtagaagtatttgctagttatattactgtacagactaatatacgagacgtactacgtggtcgggtcgttaccggaccgaagggaccgaagggtaggaaactacgaaacggtaacgttggtaggacgtcggaccaccgtagtcgtgttaccg

SEQ ID NO: 180907 - DNA, 630 bp, Homo sapiens
  misc_feature: GYAE6OF02G666G.34.38.D05.1.454.CMB.1.raw
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggaagggctggtgtgggtttcacgtattacgagtgatgggactgacacaatctacgcggactccgtgaaggccgattccaccccctcagagacaacgccaagaacacactatatctgacaaaatgaacagtctgagacgccgaggacacggctgtctattactgtgcaaggaggtggactacaatctagttggttttgatcgtcgtcggggccgaggggacaagtcggtcaccgtcttacttcacgtccctaccaaccgtaacgggcccctacgtcccggttcccgttcccccgtcggtcccgtccccgtcgcccgtcccgacgggtacgcctaacccgtccgaaggtacgccgaacgaccggcccggtcccgtcgggtcctcggtccctacgggtaccgaacgggtaccttaccttccgacttaccgtacgttacgtactacggacggccgggtaccgtcgggacgaacgggccgacgtaggtacgngcgtngcg

SEQ ID NO: 180908 - DNA, 549 bp, Homo sapiens
  misc_feature: GYAE6OF02I3RRN.34.38.D05.1.454.CMB.1.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttctcgcctggtaccagcagagacctggccaggctcccaggctcctcatctttggngccgtccaccgagggcccacgtggcatcccagacaggttcagtggcaggtgggtctgggacagacttcactcncaccatcagcagacttgacgtcctagaacgtattttgactagttaatattactgtacagactaatatacgagacgctacgtgtcgggtcgttcggaccgaagggaccaagggtacgaaagtaccgaaacggtacgtacggtacggtacgtcgaccacgtacttctagttcc

SEQ ID NO: 180909 - DNA, 605 bp, Homo sapiens
  misc_feature: GYAE6OF02HWG5M.34.38.D05.1.454.CMB.1.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (599)..(599): a, c, t, g, unknown or other
  misc_feature (599)..(599): n is a, c, g, or t
  modified_base (602)..(602): a, c, t, g, unknown or other
  misc_feature (602)..(602): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccgagggaaggggctggtgtgggtttcacgtattacgagtgatgggactgacacaatctacgcggactccgtgaagggccgattccaccccctcagagacaacgccaagacacactatatctgacaaatgaacagtctgagagccgagacacggctgtctattacngtgcaaggaggtgactacaatcattggtttanatcgtcgtggggaccaaggacaagtcggctaccgtctcttacacgcctaccaccgaacggccctagtccggtcccttcccgtcggccctccctcgacctcgacggacgtcccaccgtaccggagtaccgaccgaacgtccggccggtcccgtcggggcctccgggcccggttacggtaccgtaaacggtacccttaaccgttcccgaattacccgtacgttcgtaccgtggacgggccgggtctgggaccgaacggtcgtacacgtagcgntgnacg

SEQ ID NO: 180910 - DNA, 526 bp, Homo sapiens
  misc_feature: GYAE6OF02G1GIT.34.38.D05.1.454.CMB.1.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (445)..(445): a, c, t, g, unknown or other
  misc_feature (445)..(445): n is a, c, g, or t
  modified_base (509)..(509): a, c, t, g, unknown or other
  misc_feature (509)..(509): n is a, c, g, or t
  modified_base (520)..(520): a, c, t, g, unknown or other
  misc_feature (520)..(520): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatgcccccggagaaattgtgttgacgcagtcgccagacaccctgtctctgtctccaggggaaagngccaccctctcctgcagggtcagtcagcgttctaacaccgacttcttcgcctggtaccagcagagacctggccaggctcccaggctcctcatcttggngcgtccacgngggccactggcatcccagacctaggttcagtggcaggtgggtctgggacagacttcactctcaccatccaccagactggacgcctagaagtatttgctagtgttattactgtacactagttgtctcacncgacgtgtacgttcggaccgaacggaccgaaggtagaactacgaacgaacgtgtggctgcactntcttgtcttcnttcccg

SEQ ID NO: 180911 - DNA, 567 bp, Homo sapiens
  misc_feature: GYAE6OF02F5M00.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagacgacctggccaggcctcccgaggcctcctcattcgtttggtcgccgtccaccgagggccacgtggcactcccagaccaggttcaggtggctaggtcgggtcgtgggacaggtacttcactctcacctatcacgcagtacttgacgcctagtagtatttgctagttatattactgtacagtactaatactacgagacgtcacgtggtcggtcgttacggacgaacgggacgaaggtacggaaacgtacgtaaacgtaacgtacgtacggtacgtacgtaccgtactactcgtagttc

SEQ ID NO: 180912 - DNA, 708 bp, Homo sapiens
  misc_feature: GYAE6OF02IRUIY.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagataccaccggagaaattgtgttgacgcagtctcagccaccctgtctttgtctcgagggacagacgccaccctctcctgcggggccagtcagagttattagtagctacttcttagcctgtatcagcaagaacctgcctggccgccaggcctcctacatctataatgacctatacgcgacgggtccacgtcggccgtacccgagtaccgaggttacaggtggcgagggttgggtccgtaggggacctaagtactttccaaccgttccgtacccgtaacctacgtaccgaacggaccgaacgtaaccggtagggtaccgtaccggtaaggtaaacgtttaacgtttttacggacgttaaggtttacgtttaagttttaacgttcggttacgacgttacgagtactaacgtacgtacgttaccggttacccgttaaccgttaccgttaccgttttaccgggacccggtaacggggtaaccgtaacgggtcggttaacgggaacgtaaccgtaaccgtaaaaaccggtacgttaacggtacggtaccgttaccggaccctaacccgtaacg

SEQ ID NO: 180913 - DNA, 752 bp, Homo sapiens
  misc_feature: GYAE6OF02F2Z8W.34.38.D05.1.454.CMB.1.raw
  modified_base (261)..(261): a, c, t, g, unknown or other
  misc_feature (261)..(261): n is a, c, g, or t
tcagtacacgtgatcacgaccggtgctcgatttagtatctgatagttggggtttgggggagagaagagctgctcagttaggacccagagggaaccatggaaaccccagcgcgacgcttctcttcctcctgctactctggctcccagatcgcccccggagaaattcgtgttgacgcagtcgcccagacacccgtcgtctctcgtcttcccacgggaaagacgccgaccctcttcctgcgagggtcagtcacgcgttctaacnccgacgttctcgccgtggtaccagcagtacgtaccgtcggccgaggtcctccgaggcctcctctacgtcgtttaggtcgtccgtcccaccgtagggaccctacgtggctacgtacccaagacctacggttcctaggtcgaccgtaggtacgggttccgtacgggtacctacggtacttcgaccgtcctaccgtaacctacgtaccgacgacgtaacggttaacgttcggaccgttccctaaggtaaacgtttcgtttacggaccgttaacgttacgttacgttaaccttcgggtaacctaaggtaacctaatttaccggtacggttaccgaaccgttaccggttacgttacgggtacggggttaccgtttaccggtaaccggtaacgggtacccgtaagggttaacggtaaccttaaccggaaaccggtaacggttcggtaacgggtacctacgggtaacccgtaacctacggttaccctttcggtacccg

SEQ ID NO: 180914 - DNA, 754 bp, Homo sapiens
  misc_feature: GYAE6OF02FHR1Y.34.38.D05.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagataccactggagaaatagtgatgacgcagtctccagccaccgtgtctgtgtctccgaggggaaangtcaccctntcctgcgagggccagccagagtgttagcagcaacttggcctggtaccagcagaaacctggccaggcctcccgagcctcctcatccttagtggtgctaactcccgaaccgtaggggccccacgttcgggttaactccccgagcccgtaagggttccaaggtcggccgaggttcggggtcttagggggaacctaagggttaaactttccgaaccgttcctaccgaaaccctataccgaacggccaacggtcccttacggcctaacggtcctaaggtaaacgttacttttttacggactttaacggtttttaactttaaccgttcggttaccgtacgtactaaaggttaaactttaaacgttaaaccggttccgggtaaccccgttacccgggggttaacccggtttacccgggacccggtaaaccggggtaacccggtaaacggggttaacgggtaaaccgtttaacccgtaaaaacccggtaaccgttagggtacgggtaccgtaccggtaccctaacccggtacttaccgtttaccgg

SEQ ID NO: 180915 - DNA, 641 bp, Homo sapiens
  misc_feature: GYAE6OF02HTEIQ.34.38.D05.1.454.CMB.1.raw
  modified_base (205)..(205): a, c, t, g, unknown or other
  misc_feature (205)..(205): n is a, c, g, or t
tcagtacacgtgatcacgaccggtgctcgatttagtatctgatagttgggtttggggagagaagagctgctcagttaggacccagagggaaccatggaagccccagcgcagcttctcttcctcctgctactctggctcccagacaccactggagaaatagtgatgacgcagtctccagccaccctgtctgtgtctcgaggggaangccacctctcctgcagggccagtcagagtgtggcagcaacttagcctaggtaccagacagaaaccgtggaccaggcctacccgagacgtcctcatctatcgactacactcccaacgacgggccacgtacgcttacttccgacgtccctagggttccagggttcggacgtaagggttcggggtccgtggggaacctaggtacgtttaccacgttcgtaccacctatcgaacgctaacgtcctgactacgtacgtagaactagtttctagtacttacttttattaccgtgttacacgtactacgttattaaacgtacggttaggtccggttaaggtaccggttaccggaaccggtaaaccgggtaacccggtaagggtaaccggtaaacgtaccggtaaaccgtaggttccggtacggtacgtaccgaccgtaacccg

SEQ ID NO: 180916 - DNA, 616 bp, Homo sapiens
  misc_feature: GYAE6OF02F8CGC.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttccttcgcctggtaccagcagagacctggccaggcctcccaggcctcctcattcgtttggtcgccgtcccaccgacgggccacgtcggccactccccaagaccgtaggttcaggtggcagggtgggtcgtggggacaggtacttcgaccttctccgaccatccgagctagtacttgacgccgtagaagttattttgctagttatactttacgtgtacagtactaatacgtacgagaccgcgtacgttgggtcgggtccggttaccggaccggaacgggtaccgtaacgggtaggtaaaacgttacgaaaaccgggtaacgttagggtacggtacgtcggaacctacctacgttaccgtgttacccg

SEQ ID NO: 180917 - DNA, 580 bp, Homo sapiens
  misc_feature: GYAE6OF02FJLAN.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagccacctctcctgcagggtcagtcagcgttctaacaccgtacttcttcgcctggtaccagcagacgacctggccaggcctcccgaggcctcctcattcgtttggcgtccgtccaccgaggggccacgtggcactcccagactaggttcaggtcggcaggtggtctgggacagacttcactctacaccatcagcagtacttgacgtccgtagaagtatttcgactagttaatattactgtacagtactaatatacgagacgctacgtcgtggtcgttacggaccgaacgggtaccgaagggtaacggtaaacgtacgaaaccggtaacgtcggtacggtacgtcggaccgtaccgtacgtacgttacgttaccg

SEQ ID NO: 180918 - DNA, 578 bp, Homo sapiens
  misc_feature: GYAE6OF02HPXPW.34.38.D05.1.454.CMB.1.raw
  modified_base (482)..(482): a, c, t, g, unknown or other
  misc_feature (482)..(482): n is a, c, g, or t
  modified_base (542)..(542): a, c, t, g, unknown or other
  misc_feature (542)..(542): n is a, c, g, or t
  modified_base (574)..(574): a, c, t, g, unknown or other
  misc_feature (574)..(574): n is a, c, g, or t
  modified_base (576)..(578): a, c, t, g, unknown or other
  misc_feature (576)..(578): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctgggtgtgggttctacgtattacgtagtgatgggacgtgacacaatactacgcggacgtccgtcggaagggaccggacttcctaccccctccccagagaacaaccgaccaacgaacaacactaatatctgcaaatagaacagtacttgagagccgaggacgacggctgtctattaactgtgcaagaggtggctacaatcactggttttgtatctcgtggggccgaaggaacgaataggtcgacccgtcgtcttcagcctcccacccgaagggcccactccggtccgttccccttccgggccgcccctcgccgttcccagggacgtccaccctccgganaggccacgaccgcggcccctggggctcgccgtggtacaacggactccttacactcacgtntacgtgaggccgggctggctacggcgcatagncnnn

SEQ ID NO: 180919 - DNA, 556 bp, Homo sapiens
  misc_feature: GYAE6OF02H05DK.34.38.D05.1.454.CMB.1.raw
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (423)..(424): a, c, t, g, unknown or other
  misc_feature (423)..(424): n is a, c, g, or t
  modified_base (437)..(437): a, c, t, g, unknown or other
  misc_feature (437)..(437): n is a, c, g, or t
tcagtacacgtgatcacgaccggtgctcgatttagtatctgatagttgggtttgggggagagaagagctgctcagttaggacccagagggaaccatggaaaccccagcgcagcttctcttcctcctgctactctggctcccagatgcccccggagaaattgtgttgacgcagtcgccagacaccctgtctctgtctcgaggggaaagagcccaccctctcctgcagggtcagtcagcgttactaacaccgtacttcttcgcctggtaccagcagacgacctggccaggcctcccaggtcctcctcattctttggcgtccgtcccaaccgacgggccaacgtggaccatcccagacctaggtcagtgcagtgggtctgggacagnttcactctcacntcgancanctgcgtagtntagaanttnnactatttatactntcagtcagtactaagtagcgtcgtagaccgttcggaccgaagggaccgtaagggtacgaaacgtaacgaaaacgtacgtggtacggacgtcgaacacctattccgttcgttacttaccg

SEQ ID NO: 180920 - DNA, 547 bp, Homo sapiens
  misc_feature: GYAE6OF02IR1AV.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccacctctcctgcagggtcagtcagcgttctaacaccgacttctcgcctggtaccagcagagacctggccaggcctccaggctcctcatctttggtgccgtccaccgacgggccacgtggccatcccagactaggttcaggtggcaggtggtctgggacagacttcactctcaccatcagcagacttgacgtcctagaagtatttcgactagtatattactgtcagacaatatacgagtacgcactggtcgggtcgttacggcgaaacgggaccgaagggtaggaaactaacgaaacgtaacgtacggtaggtacgtcgaccaaccgattcctgttacc

SEQ ID NO: 180921 - DNA, 579 bp, Homo sapiens
  misc_feature: GYAE6OF02GCIE8.34.38.D05.1.454.CMB.1.raw
  modified_base (205)..(205): a, c, t, g, unknown or other
  misc_feature (205)..(205): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccagggaaanagccaccctctcctgcagggtcagtcagcgttactaacaccgacttctcgcctggtaccagcagacgacctggaccaggcctcccgaggtcctcctctattcctttggcgcgtcccaccgaggccactggcactcccagacagttcagtgcaggtggtcgtggaccagaccttnaccttctacaccatcacncagactcgacgctacgtaagtattttgcgtagttattattacttcgtacatacgaatagtacgtacgacgctacgttagtcgggtcggttaccggacgaacgggtaccgaaggtagggtaaacgtaacctaaacgtaacgttcggtacggtacgtcggacctaaccgtacttacgtcgttcc

SEQ ID NO: 180922 - DNA, 599 bp, Homo sapiens
  misc_feature: GYAE6OF02G9FVR.34.38.D05.1.454.CMB.1.raw
  modified_base (206)..(206): a, c, t, g, unknown or other
  misc_feature (206)..(206): n is a, c, g, or t
  modified_base (345)..(345): a, c, t, g, unknown or other
  misc_feature (345)..(345): n is a, c, g, or t
  modified_base (392)..(392): a, c, t, g, unknown or other
  misc_feature (392)..(392): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaaattgtgttgacgcagtcgccagacaccctgtctctgtctccgaggggaaanagccacctctcctgcagggtcagtcagcgttctaacaccgtacttcttcgcctggtaccagcagacgacctggccaggcctcccgaggcctcctcattctttggcgccgtccaccgagggccatcggcactcccagacnggttcagtcggcaggtgggtctgggacagtacttcgactctacaccntcacgcagtacgttgacgtctagtaacgttatttacgactagttaattacttacgtgttacacgtactaactagtaccggacgacgacgtacgtggttacggggtaccgttaccgggaccgtaacgggacgtaagggtaacggaaacgtaaccgaaaccggtaacgttggtacggtactcggacctaccgtacgttcgtacgttccg

SEQ ID NO: 180923 - DNA, 546 bp, Homo sapiens
  misc_feature: GYAE6OF02IQIEJ.34.38.D05.1.454.CMB.1.raw
  modified_base (207)..(207): a, c, t, g, unknown or other
  misc_feature (207)..(207): n is a, c, g, or t
  modified_base (384)..(384): a, c, t, g, unknown or other
  misc_feature (384)..(384): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagngccaccctctcctgcagggtcagtcagcgttctaacaccgacttctcgcctggtaccagcagagacctggccaggctcccgaggcctcctcattctttggtcgcgtcccaccgagggccacgtggccactccccagacaggttcagtcgcaggtgggtctgggacagtactcactcncacatcagcagacttgacgcctagaagtattttgactagttaattattactgtacagactaatatacgagacgctacgtgtgggcgttcggaccgtaacgggacgaaggtaggaaactacgaaacgacgtaggtaggcgtacgaccaccgtatccgtgttac

SEQ ID NO: 180924 - DNA, 743 bp, Homo sapiens
  misc_feature: GYAE6OF02JNMCF.34.38.D05.1.454.CMB.1.raw
  modified_base (335)..(335): a, c, t, g, unknown or other
  misc_feature (335)..(335): n is a, c, g, or t
  modified_base (730)..(730): a, c, t, g, unknown or other
  misc_feature (730)..(730): n is a, c, g, or t
tcagtacacgtgatcacgaccggtgctcgatttagtatctgatagttgggtttggggtaggagaagagctgctcagttaggacccagagggaaccatggaaaccccagcgcagcttctcttcctcctgctactctggctcccagatgcccccggagaaattgtgttgacgcagtcgccagaccaccctgtcctctgtctccgaaggggaaagcgcccaccctctcctgcgacggccagtcagacgtattagccaacctaacttagcctagggtacccagtccaacgaaacctcggccacggacctcccgaaggcctcctactatctagtcggtcnccaatccccaaccgacgggccctacgttagggtacctccccggaaggcctaacgggttcaaggtcggccgtaggttcgggtacgtcggggaactagggtacgtttcccactcgttaaccgaccagttccgacgtcgtacgttcctggccttaagttccgtaggttaaacgttagttttccggtacgtttaagttttaaccgttactttcggtacgttacgaccgtttaaccttaaagttaagtaacggtttaccgtcccgttaacccgtacttacccgtaaacccgttcccggaaccgttaaaccgggctaaccggtaccgttaaggggaactaaccgggtttaaaaacgtaccggttacggtttacggtaccgttaaggcccgtaaacccgttntccgttttaacgg

SEQ ID NO: 180925 - DNA, 629 bp, Homo sapiens
  misc_feature: GYAE6OF02I95QG.34.38.D05.1.454.CMB.1.raw
  modified_base (243)..(243): a, c, t, g, unknown or other
  misc_feature (243)..(243): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagaaattgtgttgacgcagtcgccagaccaccctgtctctgtcctccgaagggaaagcgccacctctcctgcaggtcagtcagcgttcaacnccgtacttctcgcctacggtaccagtcagacgaccgttgacctaggcctacccgaggccttcctcacgtttcgttcggtcgccggttacccaaccgagggccctacgtcggacctacgtcccgaagaccgtaggttccaggttcggcgtaggtggtaccgtggaacacggtacttccgacttcctacacctagtcacgcacgtacttagacgtccgtagtaacgtatttagactagttaattacgttacgttagttacagactaatactacgtacgacgtacgtacgttcggtcgggtacgttcggacgaacgggtacgaaggtaggtaaacgtaacgaacgtaacgtggtacgtacgtacgacgtaactacgtcgttcgttaccg

SEQ ID NO: 180926 - DNA, 694 bp, Homo sapiens
  misc_feature: GYAE6OF02H483P.34.38.D05.1.454.CMB.1.raw
  modified_base (207)..(207): a, c, t, g, unknown or other
  misc_feature (207)..(207): n is a, c, g, or t
tcagtacacgtgatcacgaccggtgctcgatttagtatctgatagttgggtttggggagagaagagctgctcagttaggaccagagggaaccatggaaaccccagcgcagcttctcttcctcctgctactctggctcccagatcgcccccggagaaattgtgttgacgcagtcgccagacaccctgtctctgtctccgaggggaaanacgccaccctctcctgcgagggtcagtcagcgttacaacacgtacttctccgctcggtaccagcagacgacctggccacggctcccgaggtcctcctatacttcgtttcggtcgccgtcccaccgaggccacgtcggacactcccgagacgtaggttcagtcggactaggtcggtcgtacgggactaacgtcgttacacgttccgtaccacctacgtaccgacgtaccgtaacgtaccgtttggaaccgtccgttaaggtaaacgttacgttttacggaacgttaaaggtttaactttaacgtttacgtcgttaacgaggtaacctaagttacgtacggtacgtaaccgtcgtaaccgttggtccgggtacgttaccgggaaccgaaaggggtaacccgtaaagggttaaccggtaaactaaccggaaacggtaaccgttggtaccggtcgtacgacccgtaacgtacgttaccgtacgtttacccg

SEQ ID NO: 180927 - DNA, 645 bp, Homo sapiens
  misc_feature: GYAE6OF02JCLFM.34.38.D05.1.454.CMB.1.raw
  modified_base (207)..(207): a, c, t, g, unknown or other
  misc_feature (207)..(207): n is a, c, g, or t
  modified_base (321)..(321): a, c, t, g, unknown or other
  misc_feature (321)..(321): n is a, c, g, or t
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
tcagtacacgtgatcacgaccggtgctcgatttagtatctgatagttgggtttggggtagagaagagctgctcagttaggacccagagggaaccatggaaaccccagcgcagcttctcttcctcctgctactctggctcccagatgcccccggagaaattgtgtgacgcagtcgccagacaccctgtctctgtctccgaggggaaanagccaccctctcctgcagggtcagtcagtcgttctaacaccgacttctcgcctggtaccagcagacgacctggccaggcctcccaggctcctcatctttggtgccgtccaccgngggcccacgtcggcattcccccagtaccgaggttccaggtggctaggttcggggtactgggacaggtacctttcaccgttctacacccntcacgcagacttgacgtcctagaagttattttcgactaaggttacttaactttacgtnttaccgagtaccgtaaattacgtaccggtagaaccgtcgtaacgttggtcgggtccgttacggacccgaacgggtaccgtaaagggtcggtaaaacgttaaccgtaaaacggaccgtttaacggtacgggtacccgttaggaccccgtaacccgtaacgtttaccgcggtttaaccg

SEQ ID NO: 180928 - DNA, 687 bp, Homo sapiens
  misc_feature: GYAE6OF02G6SM2.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgagggaaagacgccaccctctcctgcgagggtcagtcgacgcgttacctaacaccgtacttccttcgccttcggtaccagcagacgtaccgtggccacggcctcccgaggcctcctctattcgtttggtcgtccgtcccaccgacgggccacgtggcctactcccgagaccgtaggttcaggtcggctaggtcgggttcgtgggaacacggtacctttcaccttcgtaccacctatcgagacctaacggtacttacggacgtccgtaaggtaaacgttagttttcgaccgtaagttaacttaacgtttaaccttgttaaccgtacgtacgtaaacttacgtacgtaacggtaccgtacgtaaccggttcggttacgggtccggtttaccgggaccggtaaccgggaccgtaacggtaacggtaacgtaaccgaaaacggtacgtacggtaccggacgttacggaccgtaccgtacgttcgtacgttaccg

SEQ ID NO: 180929 - DNA, 682 bp, Homo sapiens
  misc_feature: GYAE6OF02HCU2M.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaattgtgttgacgcagtcgccagaccaccctgtctctgtctccgaggggaaagagccaccctctcctgcagggtcagtcagtcgttacaacaccgtacttccttcgcctggtaccagcagagacctggccaggcctccgaggcctctctatcgtttggcgccgtccaccgagggccagtcggcactcccgagtacgaggttcaggtcggctagggttcgggtactacggggactaggtactttaccgaccttccgtaccaacctacgttccgaacgccgaaggtaaccgtttacggacgtaccgttaggtaaagttacgttttacgacgttaacggttatttaacgtttacgttcgttactaacggtactaaacgttacgtacggtaacgaccggtactacggttgggtacggggttccggttaccgggaccggtaacgggaccggtaagggtaacggaaacgtaaccggtaaaacgtacgtacgggtacggtacgtacgacctaaccggtactttcggttaccttacg

SEQ ID NO: 180930 - DNA, 514 bp, Homo sapiens
  misc_feature: GYAE6OF02GEIEG.34.38.D05.1.454.CMB.1.raw
  modified_base (395)..(395): a, c, t, g, unknown or other
  misc_feature (395)..(395): n is a, c, g, or t
  modified_base (479)..(479): a, c, t, g, unknown or other
  misc_feature (479)..(479): n is a, c, g, or t
  modified_base (510)..(514): a, c, t, g, unknown or other
  misc_feature (510)..(514): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctcagagacaacgccaagaacacactatatctgacaaaatgaaacagtctgagagccgaggacacggctgtctattactgtgcaaggaggtggctacaatcatggttttgatctcgtgggccaagggacaagtggtcaccgtctcttcagcctcaccaggcccatcgtctcccgngccgcctgcctcaggcgccacctccgagacgcacacgccggccctgggctcgccgtggtacgaacggcttacctccatcacgtntactggacggcggctggacaggcgacatagnnnnn

SEQ ID NO: 180931 - DNA, 765 bp, Homo sapiens
  misc_feature: GYAE6OF02IFJ3U.34.38.D05.1.454.CMB.1.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagtacacgtgatcacgaccggtgctcgatttagtatctgatagttgggtttggggagagaagagctgctcagttaggaccagagggaaccatggaaaccccagcgcagcttctcttcctcctgctactctggctcccagatcgcccccggagaaattgtgttgacgcagtcgccagacaccctgtctctgtctccgaggggaaagagccaccctctcctgcgagggtcagtcagtcgttactaaccaccgtacttcttcgcctggtaccagcacgngacctggccaggcctccgaggcctccctnacttcgtttggcgtccgtcccaccgacgggccctaacgtcggaccactccccgaagaccgtacgggttcaggtcggcgtaggttggggtcctagggacacggtactttacacttctaccaccatcagcacgtacgttcgacgtaccgttagaacgttagttttacgacgtaaggtttaaactttagtttaacgttacggtacgtaaacggtaactaaacgtttacgttaaccgggtaacgtaacccggtaaccgttaaccggtttcggggttaccgggggttacccggttttaacccggggaacccggggttaaacggggtaaccccgggtaaaacggggttaacggggtaaaaacgttaaacccgggtaaaaaaccgggtaaccggtttacgggttaaccgggtaacgttacgggtaaccccgtaaccggttaacgtttcccgtaggttttaccccg

SEQ ID NO: 180932 - DNA, 571 bp, Homo sapiens
  misc_feature: GYAE6OF02IGI95.34.38.D05.1.454.CMB.1.raw
  modified_base (566)..(566): a, c, t, g, unknown or other
  misc_feature (566)..(566): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagacgccaccctctcctgcagggtcagtcagcgttctaacaccgacttctcgcctggtaccagcagagacctggccaggcctcccgaggcctccctcacttctttgggtcgtccgtcccaccgagggcccacgtcggcactccccagacaggttcagtggctaggtgggtctgggacagtaccttcacttctccacctatccacgcaacgtacgttgacgtctagaagtatttgactagttaattattacgttgtacagactaatagtacgagacgctacgtggtcgggtcggttacggacgaacgggaccgaaggtaggaaacgtacaaacggacgtgtaggctcgacctacctactcgtnttccg

SEQ ID NO: 180933 - DNA, 622 bp, Homo sapiens
  misc_feature: GYAE6OF02IZJY8.34.38.D05.1.454.CMB.1.raw
  modified_base (210)..(210): a, c, t, g, unknown or other
  misc_feature (210)..(210): n is a, c, g, or t
  modified_base (440)..(440): a, c, t, g, unknown or other
  misc_feature (440)..(440): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgactactctggctcccagatcgcccccggagaaattgtgttgacgcagtcgccagacaccctgtctctgtctccgaggggaaagngccaccctctcctgcagggtcagtcagcgttactaacaccgtacttcttccgcctggtaccagcagacgacctggccaggcctcccgaggtcctcctactagttcgtttggtcgccgtccgaccgacgggccacgtcggcacgtcccaagaccgtaggttcaggttcggcgtagggttcgggtcgtgggactacgtacttcactcctcacctatcgagcagtacttgacnccgtagaagttagtttgctaagttatattacgtatacgagtactaagtatacgaacgtacgacgtacgtcggttcggtccggttaccggacggtaacgggacgtaacgggtacggtaaacgtaaccgaaacggtaacgtacggtacggtacgtacggaccgaccgtagtaccgttacgttcc

SEQ ID NO: 180934 - DNA, 533 bp, Homo sapiens
  misc_feature: GYAE6OF02H0ZDH.34.38.D05.1.454.CMB.1.raw
  modified_base (308)..(308): a, c, t, g, unknown or other
  misc_feature (308)..(308): n is a, c, g, or t
tcagtacacgtgatcacgaccggtgctcgatttagtatctgatagttgggtttggggagagaagagctgctcagttaggacccagagggaaccatggaaaccccagcgcagcttctccttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagagacctggccaggctcccaggctcctcattctttggngcgtcccaccagggccactggcatcccagacaggttcagtggcaggtggctgggacagacttcactctcaccatcagcagacttgacgcctagaagtattttgctagttattattactgtcagacaatatcgagacgcactgtgggtcgttcggaccgtaagggaccgtaaggtaggaaactacgaaacgtaacgtaggtaggcgtagaccaaccatcgtgttcg

SEQ ID NO: 180935 - DNA, 761 bp, Homo sapiens
  misc_feature: GYAE6OF02GSNC6.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagaaattgtgttgacgcagtcgccagacaccctgtctctgtctccgaggggaaagagccaccctctccgtgcgagggtcagtcagtccgttactaaccaccgtacttcctcgccttggtaccagcaaggacgacctggccaggccctacccgaggccttccctcctacgtttcgttttcgggtccgtccggtcccgaacccggacggggccctacgtcgggacctaacctccccgaaggtaaccgtagggtttaccgagggtcggacggtaagggttcggggtacggtacggggaactaacggtacctttaccgaacttccgtaccacccgtaactcgacgaccgtaacggtaacgtttcggaacgtaccgttaaggtaaacgttacggttttacgaacgttaacgtttaactttacgtttacgttgttaccaagtactaaacttacgtacgtaacgtacgtacgtacgttacggggtcgggttacccggttacgggaacccgtaacggggaacccgtaaggggtaacggtaaacgttaaccggaaaaccggtaacggttacggacggtaccgtacggaccctaaccgtacgtttccgttacgttacccg

SEQ ID NO: 180936 - DNA, 833 bp, Homo sapiens
  misc_feature: GYAE6OF02F3YXO.34.38.D05.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
tcagtacacgtgatcacgaccggtgctcgatttagtatctgatagttgggtttggggagagaagagctgctcagttaggacccagagggaaccatggaaaccccagctcagcttctcttcctcctgctactctggcctccagataccaccggagaaattgtgttgacacagtctccagccacctgtctttgtctccgaggggaanagccaccctctcctgcaggccagtcagagtgttagcggctacttacgcctggtaccagcaagaaacctggaccaggcctcccgaggtcctctcatctangatcgaccgtaccaaacgcggggacctacgtcggacctaacgtccccgaggtacccgtaaggggtttccaagggttcgggaccgtaacggggttcggggtcctacgggggaccctaaggtaacctttccgaaccttccgtaacccgaaccctagttaccgaacggaccgtaaccgtacccgttaaacggaaaccggttaacccgttaaaacggtttaacgttttacggtaacctttaaaacgtttttaacgtttaaccgttacggtttacctaacggttaccgttacggttaccggttaaacgtacccgtaaaccggtttccgggtaccccgttaccggtttaccggaaccgggttcccggtaccccggttttaccggggacccggggttaaccggggtacccgtaaccgggtaaccgggttaacggggtaaaccggtttaaaccggtttaaaaaccggtaaccgtttacgggtacgggttaccggttaccgggtaacccgtaacccgttaccgtttaccgtttaccgg

SEQ ID NO: 180937 - DNA, 708 bp, Homo sapiens
  misc_feature: GYAE6OF02GCV4Y.34.38.D05.1.454.CMB.1.raw
tcagtacacgtgatcacgaccggtgctcgatttagtatctgatagttgggtttggggtaggagaagagctgctcagttaggacccagagggaaccatggaaaccccagcgcagcttctcttcctcctgctactctggctcccagatcgcccccggagaaattgtgttgacgcagtcgccagacaccctgtctctgtctccaggggaaagagccaccctctcctgcagggtcagtcagccgttctaacaccgtacttccttcgcccttggtacccagcagacgtacctggccaggcctccccaggccttccctcattctttggtcgaccgtcccaccgagggccacgtgggccaacgtccccaggacctacgggtttccaaggtcggctacggtggggtcctggggaacaggaccttcgaccttcgctacccatcacggctacgtacttcggacgtccgtagaagtacttttgccgtaagttaattacgtttaacgttcgtacgtagaccgttaaatacgttacggaacgtaccgtaccgtaacggttcgggtacggggttaccggtttacccgggtaaccgggaaacccggggtaccggtaaaacggggttaacggtaaaaccggttaaccaaaacccgggttaaccgttacgggtaacggtccggttacggacccgtaaccccgtacgttaccgtttcggttacccg

SEQ ID NO: 180938 - DNA, 631 bp, Homo sapiens
  misc_feature: GYAE6OF02H1FFI.34.38.D05.1.454.CMB.1.raw
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaaattgtgttgacgcagtcgccagacaccctgtctctgtctccgagggaaagagccacctctcctgcagggtcagtcagcgttctaacacgcttctcgctggtaccagcagacgcctggccaggctccgagcctcnctnttctttggncgttccacgngggcccatggcactcccgagacgtaggttccagtcggcagggttgggtcgtacgggactagtacttcgaccgtctaccaccctagtcagcgaacgtacttacggacgtacgtagtaaacggttattttacgacttaaggttaactttagtttaacgttcgtacgtacgaacttaaagttacgtacgacggtaccgcgtaacgttcgggttcgggtaccgtacggtaccggaagggtaccgtaagggtacggtaaataaccggaaacgtaacggtacggtacggacttacggtaccctaacgtcgtttaccgtggttaccc

SEQ ID NO: 180939 - DNA, 731 bp, Homo sapiens
  misc_feature: GYAE6OF02H6VVT.34.38.D05.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgcagacacctgtctctgtctccgagggaancgccaccctntcctgcagggtcaggtcagcgttctaacaccgacttctcgccgtcggtaccagcaagacgacctcggccaggcctccgaggtctcccttcactttcgtttgggtcgtccgtcccaccgtacggggacccctacgtcgggacctaacgtccccaaggacctaacgggtttccaaggttcgggaccgttagggttcggggtcgtaggggaacctaaggtacctttacgacctttccttaccgaaccctacgttacgtacgaacgtaacggttaaccgttttcggaaccgttaccgtaggtaaacggttacgtttttaccggacgtttaaagttaagttttaacttacgtttaccggttacgtaagtaccttaaagttacgttaccggagtacccgacggtcgttacgggttcgggtacggtttaccgggaccgtaaacgggaccgtaaagggtaacggtaaacgtaacgaaacggtaacgttggtacgtccgagtacacccgtacttccgttcttaccg

SEQ ID NO: 180940 - DNA, 851 bp, Homo sapiens
  misc_feature: GYAE6OF02FMNFA.34.38.D05.1.454.CMB.1.raw
  modified_base (327)..(327): a, c, t, g, unknown or other
  misc_feature (327)..(327): n is a, c, g, or t
  modified_base (356)..(356): a, c, t, g, unknown or other
  misc_feature (356)..(356): n is a, c, g, or t
  modified_base (758)..(758): a, c, t, g, unknown or other
  misc_feature (758)..(758): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctggtgtgggtttcacgtattacgagtgatgggactgacacaatctacgcggacctcgtagacggccattcccacccctcagacgacaaccgcaaagaacacactatactctagacaaagtcgaactagtctgaagacggaccgaggaaccacgggcttcgtacttattacgtgtgacgaaggnggtcggactacgaatctagttggttttanattcgttacggtcggggaaccgaaaggggacctaaaggttcggtaccctaacccggtctttccctttacgacggtcccccttacccgaaacccgtaaccgggggtcccccctaagggtttccccgggtttacccccgttttccccccggtacggggtccccgtacccccggttcgtccccggttacccggaacgggtaacccgtaccccgtaacccccggtaccccgggtaaggacccgaaccccgaacccggtaaccgggtcccccgggttaccccggttggggggtccccttaccgggtacccccgggtttaggtaaacccggtaaacccgggttaacccttttaacccgtttacccgaaacccgtttacccgttaaccgggtttcccggtttaaccggngggtacccgggttacccgggggttaccggttacgggggaaacccgttaaccggggggccgtaaccgtaacggttacggaccgtagccgtagcg

SEQ ID NO: 180941 - DNA, 785 bp, Homo sapiens
  misc_feature: GYAE6OF02II1DO.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagaattgtgttgacgcagtcgccagacaccctgtctctgtctcgaagggaaagagccaccctctcctgcgagggtcagtcgagtcgttacctaaaccaccgtactttcttccgccgttacggtaccacgtcacggacgaccgtggccgaggtcctacccgaggtcctccctctatttccgttttggtcgtccgtacccaaccgacgggccacgttcggcctaccgtacccgaacgtacgtacggttacgaggtcggacgtaggtgggtccgtagggacacggtacttacgaccttccgtaccaccgtataccgacgaccgtaaggtacgttcggaacgtccgttaaggtaacgttacgttttcgacgttaagttaactttaacgtttacgttacgtacgtacgtaactaaacgttacgtaacggtaccggtaccgtaccgttaaccggttacgggttaccgggggtaccgtttaacccggggaacccgggtaaacggggtaacccggttaaaggggtttaaccgggtaaaaacgtttaacccggaaaaaacggttaaccggttaacgggtaacgggttaccgaaccggttaacccgtaaacccggtttacgttaccggtttaccggtttaaccc

SEQ ID NO: 180942 - DNA, 799 bp, Homo sapiens
  misc_feature: GYAE6OF02GHK7T.34.38.D05.1.454.CMB.1.raw
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccagggagggctggtgtgggtttcacgtattacgagtgatgggactgacacgaatcgtacgcggactccgtgaagggccgattccaccccctccagacgacaaccgccaagaccacactatatctgacaaatcgaacagtctgagagccgaggaccacggctgtctattacngtgcaagngtggctacaatcatggtttgatctcgtgggaccaaggggaccaagtcggtacaccggttctctttcgacggtcccttacccgaacccgaaacggggtccccctaagttcccgggtttccctttcccccccggtacggtccccggtacccccgttcgcccgttaccccggtacgggaaccggtcccgtaacccccgttacccggaacggtaccggaccccgtaaccgaacccgggtccccggggacccccggttagggggtacccttaccggggtaccccctttaccgggggttaacgtaaacccgggggttaaccctttaacccggtttaccccgtaacgtttaaccccggttaaccgggttaccggtttaacccgtggggtaacccgggtacccgggggtacccgttacccgggggtaacccggttaaaccggggtacccggtaacccggtaacgtttaccggggaccgacggttacccgaggtcccg

SEQ ID NO: 180943 - DNA, 565 bp, Homo sapiens
  misc_feature: GYAE6OF02F8MZU.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgtacttctcgcctggtaccagcagagacctggccaggcctcccagacctcctcattaatggtgcatactacgacgggccccctgggcactcccgagacaggttcaggtggcagtgggtctgggacagacttcacgtctcaccatcaccagacgtggacgccgtagaagtatttgactagtattaattctagtcagactaatatcgacgacgctacgttggtcgggtcgttaccgggaccgaacgggaaccgtagggtacggaaacgtacgaaaccggtaactggttacggctacggctacctagtcgttgtacttaccc

SEQ ID NO: 180944 - DNA, 640 bp, Homo sapiens
  misc_feature: GYAE6OF02HIDEG.34.38.D05.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
  modified_base (606)..(606): a, c, t, g, unknown or other
  misc_feature (606)..(606): n is a, c, g, or t
tcagtacacgtgatcacgaccggtgctcgatttagtatctgatagttgggtttgggagagaagagctgctcagttaggacccagaggaaccatggaacccagcgcagcttctcttcctcctgctactctggctccagatgccccgagaaattgtgttgacgcagtcgccagacaccctgtctactgtctccagggaacagccacctcncctgcagggtcagtcagcgttctaacnccgtacttctcgcctggtaccagcacgagacctggccacggctccccaaggctccgtcactcttttcggngccgttccaccgaggccaagtcggactgtccccagaccgaaggttccaagtcggacacgtcggggttacagggactagggtaacctttcaaaccttgttaacaccccgtaattccgacgactacggtacctttggacgtccttaaggaactacgtttttcggcctaaggttaatttaattaccgttaggtacctaaggtacctaaattaacgtacgttaacgacgtactaaccgttaggtccgggtacgttacggaccgtaaggaccgtaaggtacggaacttaccgaaacgtacgtaggngttacgacggacctaccgaattccgtagttaccg

SEQ ID NO: 180945 - DNA, 627 bp, Homo sapiens
  misc_feature: GYAE6OF02FLEBI.34.38.D05.1.454.CMB.1.raw
  modified_base (619)..(619): a, c, t, g, unknown or other
  misc_feature (619)..(619): n is a, c, g, or t
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaaggccattccaccccctcagagaccaacgccaagaaccacactatatctgacaaatgaacagtctgagagccgaggaccacggctgtctattactgtgcaagaggtgcacaatcatggttttgatctcgtggggaccaaggacaatcggtcaccgttctcttcgacgtccctaccaacccgaacgggcccctagtcccggttcccttcccccgtggcccggtcccctagccctccgacggacgcccacccgtccgagacgaccacgacggcccggtccctggggtcccttacgggcccgttacgggtacccgaaacgggtaacctttacccgttacccgaacgttccgaccgttagtaccgttaggaccggtccggggtacgtccgggaccggtaagggcccgacgtaggtacgncgtancgn
